United States Patent 10,407,724 (METHODS AND COMPOSITIONS FOR SCREENING AND TREATING DEVELOPMENTAL DISORDERS) - sequence listing, part 54

SEQ ID NO: 1378 - DNA, 50058 bp, Homo sapiens
tggacgccgggttccggtcctggcccccccgccatccccccaacagaacagggtcatgaaaaggtaaggcggggacaggggatgcagggatggtggtgggaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaatacccccgccaaggaccttgagggcatccaggcccccagcacccctcgccccaagctcccaccccttcctcaaggttctggaacacccttccagcctcttccaagcatcaggattcgggtggggagagaccgatgttgtgtgtgtgtgttgggaggtgaggggggaggaaacgggatgccgtctgcagcacaactcgaggttgtggggggagctgttgatcgaagtggccgctcctctcttctctgttggatgctgtggggggcaatgaagacagggacaccctaggaatttctggcaccctcctcctcctccccgcttggggacaggctgtgctatgtacaggatctaagtggggtgactagggaggccagagctcggtgggggggcacccaggatgttgggaaggatagggtttgaaaccaaaaggggatccttaagggaggacaggagccggaacccggactcctgggtccttgggggaagaggggagctggggacctggactcttggttcctgcagggagaggaggctgggcactggagttccagagtcttggggcaggaggggcctggcctcctgggtcctgggaaagaacaggaccgaatgcccagactcccaaggcctgggggaggaaggggctgccagaaggactcctgggtctttacgggaggaggtaggggatagcgcttccgtctgaggaaggcaggctgggagctcagtctcctgagtccctgacagggcaggagatgagtgttggggactttagccctatgcagatggaagtggaaacggaggctcatgaggaggtagagatggaggcggggggagcggggggttgtccagaggctggactctgtgatccctgagggcgtgggttctgggggttgggccttcagagtcctggaggactggggatgcccctcctcaggccctggagtgggggaggctgctctccctaatccctgtggttaggaactgagcatgcagcccccgtgagaagggtggggccgggggctgccctcctgggcctcagtagggagtgggacgcggggtccctaagagcagaagccaggtaggggtgggtctgggagaggcagaggaggggctggagggtgagcagccactgggaatggaggggagcgtgagtgttaaccccgcgggggccaggccacagctgtgggttattttggggcggagtgggggggttattctgagcgctgattgagccagctgcttggggaagggcaatggaaaggaggagcgaagagaagccaggatcggggagggatgggcatactaggagcccccaaccccttccctggggagacaggggcccgagatctctgggaaggtgaggtggtgggcagaggggacgggctgtggcctcgaggcaggggaggggtggtggacctttcccccgccctggctgtctgtggggtggacgaggcctgcgctaccatggcaaccagacaggagcatgacagccaggagagaacccttccttgtctggaccctcaccccttctggaagcccctagtgcggactccagtccttctctgggaaccaggagtccagactcccagtgccctcctccctcagtcccaggcaggacccaggagcctggctcccagcccaaccaccccaggcggctagtattcaacagggggcacaggaagagaggctgtatttcctctaatttaccaaattgctctgggctgggtgccagggacccccacacccaccccacccagctctccacagctgtgccccccaaccccacatcccagatggggccatgactcccttgctttgagaatgaggggatggggacaggactaaggggacaaaatgggttaggggttgtggtcagggtgaggagtaaggtcatgtggggattttctctccttggggtgccccactaatttctctctttctctccccacacacctgaccccttttccctctcattttttctctcccttttcctcccttttatttctgctccctcctgccactcgccttccccgccttactttcatgtctgtactgggcacctccctggtgggggtcccgatcttggccttgcttcgctatttctgtcctcctgttttcgctccgctctgcctgcctccctcaatctcaattgtttccccatcctttatgtgcgcgtgtctcttggtggccttggggtctctgtctccctcttcctgccttgctgtcttcttctctgtccaactttcttgcctcgcttatctctcccgccttcctgcatctcttcccgcctctatcatcctctccctgggcctccctcattcctgtttctgtcactccgtcctctctctctccgtcttctccccgtctctgctgcttccgtctctctccttcttcctgccgctctttccctccccgtctccctgggcctctctctgctcctatcttgatcccatctctgtgggtgtccccatccccaccttgtctatcttcctctctctcccctcttacctctgtatcttcccctgaccccattatccaccctcgtctttgcgtctcccccaatcccatactccacttcttcctatctctgtctcgccctatctctgcgtctctccctgtttcacctcttcctctggtgtttcttccccacctctcccttccacctccctctgctgtgtctgtctctccctctgtctctgcctgtctctcctccatctctctctctccgtctccccctctctctcccctccatctctctctacctctgcccgtctctccctctgtctctcctccatttctctctccctctgtctctctcccttccatctctctcgtcctccgttcctgtctctccctctgttccatcaccccgaccgctccctgtcctccccatctcggcgcctgtccctcgctgcatctcctcctctgtgcgtctctttatctcgtctccctgtccctgcgtctcccgtctgtgcctccctctcctccccgtctctcccggcccgggcgctcagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggtgcgcgcgaccggggcggggcggggccacaggaggggcggggacagccgctgaggggcgggactgggacagccagcgggggcggggcctagagggggcggggactgtcctgtgggtccgagtctgggacaaggtgggcccagatggtaggcagggcttagggctagattagaggcggggctgacttggagggggctggtctatagggtaagctgggcctttagggtcagaaagaggccagtcctcgatgatcagagtatagggaggacgtgggcccattcattgcaggtaagggtctgtagtaaaggcgagtcgagggaagggttaggggctgggaacgaaaagggactagccccaaatggcaaaatctgagggaggggtgggacctaggatcagcacaggaagaagtcagttgaaaaggaatgggcctgggcgcggtggctcacgcctgtaatcccagcgctttggaaagccgaggccggcggatcacttgaggtcacaggagtttgagaccagcctggccaacatggtgaaaccccgtctctactaaatatacaaaaattagccgggcgttgtggcgggcgcctgtaatcccaactactcgggagggtgaggcaagagaattgcttgaatccgggaggcggaggctgcggtgagccgagatcgtgccactgcactccagcctgggcgacacagtgagactctgtccaaaagaaaaagaaaaggaatggagttcagaaagaaaggggcgaagtctagtggagaggtggcagctaggaagtatcagaggtatcaggtaccaaggacagagtttggggaggcgttcggccggtagagcatagggtctagaagtcagccagggatggaggagccatcttctaagtggaagtcggaaaagaggaagagtcattagagagaggaggacgggcaaggggtagaaccaggaagcaaggaattgagatttggtgcgaggccagtcagggaaggagtgagtcagaaaagggggcggggctagccagttgggggcggggccagcgaggggcggggcctaagcactctaataaaggggtgggtctagggaggaagccggtcctgagagtagggtttgagaaggggcataccccgctgtgaggtgtggaaagcgagagtccagaggatgggcaggaggatgaaggcttatggtggaggccgacccagccaatgacagatcaaagccaggagcctgctgggaagggatggtagaggctggagctggccagagcctggagaaaggcctgactcccaagggcacagaaggggccagttgtagcggacctctggtagagaaggagagaattggaccaagcctgctctgtggattgagaatgggtcagctaggaggtggggcctgagaaggggcggggcctctccagaggtggggccagcgcaacccagaggtggagcttcattcaatctgcccattccctgctgtgcgggcctgtggctgtgtgactgcatcactgttgtatgcagaggctcgtagtcctctcctgtccagagcattctgggaaggacctctgtccaactttcttgttctccttggcatggtacttttcagagatttgtaggtagatgccctgggaggcgaacttatttcttaactgccacttccaaggcatactcaaaagacgtgatccctcgtgccttcattgctgctgagaagtgtggtcctctctgtttcattgtccgctgggcactgcggtcggctcagtgtacgcccatagcattctgggaaatgtagtccccgtgctgcccctggatggaagaaagaatgatcttcacagctccatctgtgccccactgaatgctgggaatgtggtcccctcagcacacctccacctgctgaaggaagaggttctccttgcattacaataagacctcatttccggccaggtgcactggctcacacctgtaatcccagcactttgggaggccgaggcgggcagatcacctgaggccaggagtttgaggccagcctggccaacatggagaaaccccatctctgctgaaaatatgaaaattagccgggcatggtggcgcatgcctgtaatcccagctactcaggaggctgaggcaggagtaatcgcttgaacctgggaggcggaggttgcagtgagccgagattgcagtgagccgagatcttgccactgcactccagcctgggggacagagtgagactgttctcaaaaaaaaaaaaaaaacaataaacaaaaagaactcattccctcaggacaactgcagtatcccctgtgcgcctagggagaaagcccacttgctgttctcattgcattacaggaagatttattgagagctgattctgtgccagggctgttttaattcctagggaatacagttctagagggggggggaaaaaaagagagggagacaaggtccctgccttatagagcttgcattttaatggtgagacagacaaaaccagtaacagtaaaatccggctgtcctggaggaaatcaacacaggatgttgtaatgactgaggatggagtttcaatagatggcagtcaggggaggcctccctgaggcggtgacacctgagctggaggtgtcaggtggaggtctggcatggaggaggtagggaaaagtgtccccaggagaggcaacaacaaaggacaaagcccttgaagcaggaaggagcttgatgtatttgaggaagagcaagaagggagtgtggctggagcccactgggggattggggtggcaggagatgaggtcagagaagcaacgggggccagttcacgcagggccttggggccacggtgaggactttggctttgattctgaggtagaatcactggaaggttttcaattgagaagggatgtgatccaattaatattttgaaacaatcactctggctgctgtttggagaatagactggaagatgcaagattgaaaacaaagataggctgggcgcagtggctcatgcctggaatcccaccactttgggaggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagaaagaaagagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagctttcagtgagccgagattgcgccactgcggtccgcagtccggcctgggcgacagagcaagactccgtctcaaaaaaaaaaaaaaaaaaaaaaaagattctttactcctttacgagagagagagagagagagagagagagagagagagagagaatagggaacagtcttgagataggggaaagatcgagcaatctgtttttgacatgctaattttgagacaccttggaaatccaagaggagatattgaataaaaaggaggataggggccaggcatggtggctcacacctgtaatcccagcactttgggaagccgaggcaggcagatcacttgagttcagaagttcgagaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaaaaaaaaaaaaaaaaggctggaggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggatagcatgggagacagtatttaaactcatgggcctggttgagatcaccagggagagaggaatagagaagagaacagtaaggcactcctagtgtttagaatttagaattctggctgaggaagaagggccagcaaaggaggcagaggaagaggtgacagagaggtaggaggaaaaccaaagaagggaaaggacactctgcaaagcttcttccagtagggaaataccatcagcaccctcattgcatgctgggagatgtagtctcctcactgccttcagggaaccagtccctctcagtggctgctgggggctgtagttcccttaccggatgctggttgtattaatgacagtgatgttagctgctggaacggatgaacccccaaatctcagtggatcacccaacaggaggttgtttctcattcatataaaatccaggccaggcacagtggctcacgcctgtaattccagcactttgggaggccaaagcgggtggatcatctgaggtcaggagttcaagaccagcctggccaacatggagaaaacccgtctctaccagaaatacaaaaattagttgggcgtggtggcgcacgcctatagtcccagctactcgggaggctgaggcaggagaactgcttgaacccgggaggcggatgttgcagtgagccgagattgtgccattgcactccagtctgggcaacaagagtgaaattccatctcaaaaaaaaaaaaaaaaaatccaaacaggtgttcctgattggaggtggctttcctccgtatggtgactcggggtttcaggctctcaccctcttgtagctctgtaatccccttcagaggactaagcttcaagagtaaggttttattaggctgggcacggcaggagaatcacttgaacccaggaggcggaggttgcagtgagccaagatcatgccgctgctcaccggcctgggcgacagagcaagattctgtctcaaaaaaacaaaaaacaaaaaaacaaaacaaaaaactaaggttttatggatgagtctagaataactcatcacgtggctaaacctaatccagatctagccctgtgccccaggaggaaaaggagatgggtttagtgaacctgtcgagtcagtctgccatattgggagctgtggtccccttattcattgctgagaaataaggtccccacatcggcaggcctgacatcctcctccctccctggcaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtgagtggggctggaatgggaggggtgtgggagggctcccagagcctaactacctcagtattcactgaatgagtggctcaaatgggccacatctgctctttgagcctcagttttcttttctgtaaagtgggtgcaattgggtctcttttctgaggttaaatcaagtaatttggaaaaagcacctgagataaagtgagtgtattactatatttcatgactctaagatgcataatgtttcacattttaatgtctttgaaaacgagatgtgtcttataattgatgacttatcatggcttaattggcagcacttttgtctttctttgtggtacatcttataattgagagcattttagatttagtctaaatacctagactataaactgagcttcagtagcaaaaaagacccaacaatccagtggcccagatgaggtcgaagtttgttcctctctcacgtaacaaccctgataaggagactgctgttccatgtgatcattcagggacccaggattctcccacactgttactctggcatctctgcatggtcgaagtgggtcgtggggatgtctgaattgtagctcatgagaaggggaaaagagaggaagtggacagcaagcactttccttttgagtaagtgaggcagaaaggacacgcctcataccttactgttgagaacgtagtcatatggtcagggctggcttactggttgttgacagtggtgtccattctgattggttggacgtctattggaattagctagacgtctattctgattagctagacgcctattctgattgactagacgtccattccgataggctagacgtccattcctggctagacgtccattctgattggctagtgcctgtgcagcgccgattgctacatattttgaatattactcctgcacatggcctggccaactgcaaggaagagtgggaaatgtcagtcctagctggacaggtgtgtgcccaacttacgcactattattttagaagaggcgaacagagtttgttggaaaatagcatctccacggtaggaagctctgggagtggaaaaattggtaagtttggtgacagaacagtgaaaagagagacctttaatcctgaacgaggatggggtgaatttgggaagagatgatggttggggaagaagacctaagagagggtaattgagaactggtgacttgggaatcaggatccccgaaaaagaggatgagaaaagcatcccttcttcataaatacttactgagcacccgctaggaactagggctcatgctgggcgctgggaacatagatgaataagaccatgaacttattcttcaaagaacgcagggtcctgtaagagtggcagacagggacagggataatggcaacgcagcatgatgcttgcagtaatggaggtcatgcgggcatggcgggggcacggggaggagcactggctaagccaggagattttcggatgcatgaagcagagtctcactggagtttccttagggaaaagggggtttattggaaaaataaacacacagaggaattaaagccaggaattgaggctaagcctggggccagctactctttcagctctttctggttctttctttttttctttttctttctttctttttcctttttctttttttttttgagacggagtctcactctgtcgcccagctggagtgcgatggcgtgatctgggctcactgcaacctccacctcctgagttcaagcgattctcctgcctcagcctcctgagtagctggggttacaggcacgtgccaccatgcccggctaattttttttgtatttttagtagagatgccatgttggtcaggccagtctcgaactcctaacctcaaatgaactgcccacctcggcctcccaaagtgctgggattccagccgtgagccaccgagcccagctggttctgtctttcttattctatgctttctccctccctccctctgtccatctccttcctctctctctctctttctctttgtttctcaggcttgcctctcccagacgctgttcagttctttacccagaatttcttctccctcataacttcagctcttgctggtcacaactcatccctccagatctcatagcaaaatgtcatcccaagagaggaaatgtattagcctcagtctgccttccaaaccaggttgcacaagtcacaagtcagcctgtggagtcaggaaggtttctaggagaaggtatctgagctgtgacctgagggatgaattgctcattgattcatttattgattgaaacgccctttattgaaagtctgctatgtgccaagcattgctttaggcacagggtgtatatagtgttaaataaggtccctgctctctcagagcttacaatctgataaaagagaaatgcaatgagcaaataagtaaagaaaaggaaatatcaagcaggcaataacttctgctatgaaaatcaaactggggaatgtgataagaaatgcatagggggctatgctaggtggggtggtcaggaaaggcctttctgaataggtgaaatttggaggttaaaaaacatggataggccgggctgtggctcatgcctgtaatctcagcatttcgggaggctgaggcaggaggatcgctagaggccaggagttccaggccagcctgggtaacatagtgagaactccatctctacaaaaaatttaaagattagctgggcgttggccgggcgtggtggctcacacctgtaatcccagcactttgggaggccgaggcgggcggatcacaaggtcaggagatcgagaccatcctggctaacagggtgaaaccctgtctctactaaaaatacaaaaaattagccaggcgtggtggcgggcgcctgtagtcccagctactcgggaggctgaggcaggagaatggcatgaacccgggaggcggagcttgcagtgagccgagatcgagccactgcactccagcctgggtgacagagtgagactccatctcaaaaaaaaaaaaaaaaaaatctgggcgtggtagtgtgtgcctgtagtcctagctacttgggaggctgacatgggaggatcacttgagccttggagatcgaggctgtaatgaactgtgatctcttcactgcagtccagcctgtgcaacaaagtgagaccctgtctctaaaataatttaaaaaattaaaatttaagaaataggtaggcaaggtgtggtggctcacacctgtaatctcagggctttgggaggctgaggtgggcggatcacttgaggtcaggagttcaagaccagcctggccaacacagggaaacaccatctctactaaaaactacaaaacttagccgggcgtggtgacaggcacctgtaatcctagctgcttgggaggctgaggcaggagaatcacttgaacctgggaggtgaaggttgcagtgagccgagaccataccactgcactccagcctcagtgacagagcaagactctgtcttaaaaaaaaaaaaaaagagagaaagaaagaaatggataaagcgaaggagccaagtattggaagatctcagtgaagggagagggaacagcaggtgcaaaggctctggggctggaactgccttgtcttagtctgttttgtgttgctatgacagaatatcataggctgggtaattataatgaatggaaatttgttggctcttggttctggaggctgggaagtccaacatcaagatgtcaccgtctgatgagggtcttctttcagcatcattacatgagggaaggcatcacatggtagaagggcaaagagaggagtgagggaagatcaagcaaacccactcctgcaaccacagcattagtccatttgtgagggtactggagccccatgacctaaatgcttcttaaagtttccacctcctaattcccaataccatcacaatggcaatggcaattaaatttcttttttttttttttttttttttgagatgaagtctcactctgttgcccaggcgggagtgcagtgatgtgatcttggctcattgcaacctccacctcctggattcaagcgattctcctgcctcagcctccgagtagctgggaccacaggtgcctgccaccacacctggctaatttttgtatttttgtagagatggggtttcactatgttggccaggctgctctcaaactcctgacctcaggtgatccacccacctcagcctcccaaagtgttgggattacgggcgtgagccactgcacctggccgtaaatttcaatatgagttttggagcggacagacatccaaatcatagcttgcctgttcggaagcctgtttgggagcctgcactgctggtgtggctagaacatagtgggcaaggggaaggaaggtatgagtagcggatggagagggttgcagggcccagcttgtgaagggcctttaggccagggggcaggggtttggacatgattcttttttttcttttttttgagatacagtctcgctctgttgccctggctggagtgcagtggcacaatcttggttcagtgcaacctcaacctccctcccgggtttaagtgattgtcctgcctcagcctcctgaatatctgggattacaggtgcccgccaccatgcccggctaattcttgtatttttagtagagacggggtttcaccatgttggccaggctggtctaaaactcctgacctcaagtgatctgcccccctcagcctcccaaagtgctgggattacaggcgtgaaccactgcgcccagcctggacttgattctgagagtagtggggagttcaccggaaatagtattccagtcaggggaaacgagcatatgcaaaaacccagaggggagagaaacttgggcagatggtgggaccacaatagttccaagcagatgaaggccacagaattaggagtcagagtgacaggccaggcgtggtggctcacgcctgtaatcccagcactttgggaggccgaggcgggcggatcacgaggtcaagagattgagaccatcctggccgacacagcaaaaccccgtctctactaaaaatacacaaattagctggacatggtggtgcacgcctgtaatcccagctactcgggaggctgaggcaggagaaccgcttgaacccaggagacggaggttgcagtgagctgagatcgtgccactgcactccagcctgggcaacagagtgagactctgactcaaaaaaaaaaaaaaaaaaaaaaaagcagtcggagtgtgggtggcaccaggcctttgccttcaatgcaggttgagaggcctggatctgttccacagcactggtgagccaggggtgggttatgagcaggagacgggtggcgtgagttttgggtatagaaagacgcctctgggacctggtggggaacagactggagtagagagattggaggctggaggccaggcaggaggctgggatgagggcctaggagggctgtggggaggcacagaagaagacagggcagagagagccccaggccaggaagaaggagacttggggaccgataggctgggtagcgggagggaggaaggcggctaagagtctagtccagtgactgggtggatgacatgagagacagtcagagtacccagggtgatgttgcatagtgaagatattgaggagtccagggacacccccggccatccccagccctgggcacttctaaccagaggaagagacatttgagctcagtctttaagacacatggagttggtcaaggctgggtacagcggctcgtgccagtaatcccagcactttgggaggtcaaagcaagtagatcatctgagcttgggacatggcgaaacctcgtctccaccaaaaatacaaaaattagttgggcatggcggtgcacatttaaagtcccagcagcttcacaggaggctgaggtggaaggatcacttgagcctgtgaggcagaggttgcagtgagccaagatcacgccattgcactgcaatctgggtgacagagtgagaccccgtctcaaaataataataataataataataataataataataataataataggccggcagtggtggctcacgcctgtaatcccagaactttgggaggccgaggtgggcagatcacaaggtgaggagttcaagaccagcctgaccaacatggtgaaaccctgtctctactaaaaatacaaaattaggcaggcgcggtggtgcttgcctgtaatcccagctactcaggaggctgaggcaggagaatcgcttggacctgggaggcggaggttccagcgagctgagattgcaccattgcactccagcctaggtgacagagcaagactccatctcaataataaataaataaataaataagaagaatagttggtcaggataaggggtggtataaggtttttcaggcagagagaacagcatctgcaaagtcctagagataagaaatcacttgacatgtttgggagacaccttgaagccagtgttgatagagaaaaaaaaaaagaattttggggtgaaaagagtttgaagtttgagggtgggaactctcagagatgcggcttcagaggaaggcaaagccagaacaaaaacagactctaggggcctggcacagtgattcacacctgtaatcccactatgttgggaggttgaggtgggaggatcacttgaactcaggagttcaagaccagcctgggaaaagtagtgagaccctatctctacttaaaaaaaaaaagaggctgggcgtggtggctcatgcctgtaatcccagcactttggaaggccgaggcaggcggatcacaaggtcaggagatcaagaccatcctggctaacacggtgaaaccccgtctctactaaaaaaaatacaaaaaattagctgggtgtggtggcaggtgcctgtagtcccagttacttgtgaggctgaggcaggagaatggcgtgaacctgggaggtggagcttgcagtgagccaagatcgcaccactacactccagcctgggcgacagagcgagactctgtctcaaaaataaataaataaatacatacatacatacataaaaatttaaaaaaaagaaaagaagaaagagaaagaaaagaaagaaagaaagagaaagaaaagaaagaaagaaagaaagaaagaaagaaagaaagaaagaaagaaagaaagaaagaaagagagagaaagaaagaggcgggccaggccaggcgcggtggctcacgcttgtaatcccagccctttgggaggctgaggcgggcggatcacctgaggtcatgagttcgagaccaccctggtcaacatggtgaaaccctgtctctactaaaaatacaaaaaattagccgggcatggtcgtgggcgcctgtaatcccagctactcgggaggctgaggcaggagaattgcttgaacccgggaggcggaggttgcagtgagctgagaccacaccattgcactccagcctgggcaacaagagcaaaactctgtctcaagaaacaaaaacaaaaacaaacaaaaaaccacacattaaaaaaaaaaaaaaaagaaagaggagggcatggtggctcatgcctgtaatcccaacactttgggaggctgaggcaggtggatcactgaggctgaggtcaggagttctagaccagtctggccaacatggtgaaaccccatctctactaaaaatacaaaaattagctggacatggtggtgaacacctgcaatcccagctactcaggaggctgaggcaggagaattgcttgaacccgggaggcggaggttgcagtgagccgagaccataccattgcactccagcctgggcaacaagagcaagactctgtctcaaaaaacaaaaacaaaaacaaacaaaaaaaccacacattaaaaaaaaaaaaaaagaaagagggcatggtggctcatgcctgtaatcccaacactttgggaggctgaggcaggtggatcactgaggctgaggtcaggagttctagaccagtctggccaacatggtgaaaccccatctctactaaaaatacaaaaattagctggacatggtggtgaacacctgcaatcccagctactcaggaggctgaggcaggaggattgcttgaaccaggaggcggaggttgcagtgagcgaagatcatgccactgcactccagcctgggtgacagagcaagactctgtctcaaaaaacaaaacaaaaacaaaaacaaacaaaatattagccaagcatggtggtgcatgtctataatcccagctacttgggaggctgaggcaggagaatcacttgaacccaggaagtggaggtggcagtgagccaagatcataccactgcactccagcctgggagacagagcaagactctgtctcaaaaaaaaaaaaaaaaaaaaagaccagcctgggaaaaatagtgaaaccccatctctactttaaaaaagaaggaaagaaaaggggactctagggcctcaacaccaagctgaaagagagtctggaaccttatcctggggggcactgggcagccaaggggagggtgctgagcagggaaggggtatattcgtgtttttgagaccttggaggtaaaagaagagagattccagctgggggctggggctggtctgcagaaaggggactttctctgccttccgctgccaaggtccagcccaggccccagcatgtcccctttccctcctcctgggcaggtacttcatgaacatcacgtgggataaccgggattactccttcaatgaggacggcttcctagtgaacccctccctggtggtcatctccctcaccagagacaggacgtgggaggtggtgagtcgtagccccagacctcaggcatggcagagggtgtggactcctgcatcctggcagagggggggcttgaggtcgtggactaagagggaggaggggacaaggagcctggactcctgggtcctgggatctgaaggtgggaggggctcctgggtcttggaagaagctgctgcccacacacctaggtctgagggaagaggatcatggaggccaggatacaccgggaagtcttcccaggaagcctgactctctttccctttggccaaggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacaggtgacagctcgggatccaggagttccggctccaaaacccgcctcccgtgaagcccagtagtctgggcccccagccccctcctcccttgggacccaggacccacaaagccctccagcttggtgaccttaggcaaacctcagaattctttgagcctgagtttcccctgaaagcgctaaccatagttttagctgccgcctatcccttcctccatatcctctcttcatgagagagtctaaggagggggtccccaaactccccaagcctggtcactgcccgcagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgagggggcggacgggaggcggggaatcttcggggcggagtcgagaggcgggcacagccgggcgtggtggctcacgcctgtaatcccagcactttgggaagccgaggcgggcgaattgcctgagctcaggggttcgagaccagtttgggcaaaacggtgaaaccccgtctctactaaaatgcaaaaaattagccgtgcgtggtggcgggcgcctgtaatcccagctactcgggaggctgaggcaggagaattgcttgaacccgggaggcggaggttgcagtaagcggagatcgcgccactgcactccagcctgggcacagagtgagactcagtctcaaaaaataataataaaaaaaaagaggtcggcaccctggggcaggggcgcggccaaattgaggaaacacctgattggggcctggggcggggtcgcgggagggacatgccttggaacagggggcggggtcaggaggtgtcaggggcggggtttggaggagggactttggagcagaggaggcggggctaggagggtgggactcctaggggaagggggcagggctgggaggagggactttggggcagtggaggcggggctaggagggtgggactcctaggggaagggggcggggctgggaggagggactttggtacagaggaggaggggccaggagggtgagaatctaggggaagagggtggggctgggaagatctggaccaaggccttgaggtcttgctgggagcagccgggtaggacgcgggctaccaattcccaatcttgttccccatttctcacctccgcccttccctgccccactcttcgtccccctcctcacccacctcgcaatccctcttggccccttccctcaccctgtcactggtctgctcccggggcccgtctctgctcgccgtccgtgtcagtctgtccgcttgagccgggttcccccgcccactcctcatcgcccccaccccaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcggtaatctggggccctgggacagggagctagccctaggcaaagtagccgtccccaaccgtgtgggccctgggatcagaaaacctgggttcccggtatcatcggtacttgaacccgctgtgcaacttcggtgaagtgacatcatttctgaacctcagtttcctaatctacaagatggaagaaataatttccctacccagaagacatttcatcaagaggctaaagaagcttgagctcaggagccttctcttgcactgcagcttccaagccctgcacctggttttgtattcataaggttgaattattttttctcaaagagagccctccaaattgtgcaagcttcaggccccacaaaacccaagtgttttcctgtactaggtatgagatgaagagaacaaattagcatggtaccaataccttgtaagcacttaagtcaccatcagtgtttactgagcatctactatgtgccaggtggtgggctccacactgggaacacagtggcaaatgaggaagacacaaatccctgtccagtaggatctctcagccttgtgaaggaggcagaagataagcttctacttctctctctctctctctttttttttttttcagacagagtctcactctgtcgcccaggctggaatgcagtggcaccatctcggctcactgcaacctcaacctgcctctcaggtttaagcgattctcctgcctcagcctgccaagtaactgggatcacaggcatgcaccaccacgcctggccaatttttgtatttttagtagagacggggtttcaccatggtggccagcctaatctcaaactcctgacctcaggtgatctgcccacctcagcctcccaaaatgctggaattacaggcgtgagccactgcacccggacaagggttttaactacagaagatggtgtggggatatataatcagatttaagtttttaaaatatccagctctgtgtaatcccagctactccggaggctgaggtgtaaggatggcttgaacccaggaggcagaggttgcagtgagccaagatggcaccaccgcactccagcctggatgacagagccagaccctatctctaaaaaagaacaaagaaaaaaatcccactctgtggaagcaagtggctggtggggatgctactgcaaggtttatgccagagacagagtgggggtgtgcaataggaaggtgacagcagacagatgcagggtgtggttagagagctgcccaccagatgggctggtggctttgagatggattgggtagagggaccattgctgagctggagaagcgtacatcggccaagggcaacagtgcttgtcagttcccacttgctctctgaagtgtgagcaaagctcctgggagaggggaggggctggaagaagagccatcccttcctttgtgttttgttttctgtttatttcgcccagtggtgtctcctgtggcctcccctttgcaccaaggtctctgcagggcacactgagaagcaccacgtggggcccctgcttgcaggcagcacactgcagaggagtgacaaggtcctatttatgccccaccaagttgcccagcagaggtgacaggcgtgtccccagctgccgcagtgacagtccagggtgctgaccttgctgtgacgggggcagtcctgacagctcacacttggccctggaaagttgaatcacctggtcctaatctcaatgaaatggtgatttgggtttattgttggtgagctcccaggggctaaacacagttatcgaatgtgaggaggggacacatgaatgggaggttgtctaatggacagggcagggtgttaactctagcagggacacctaggagacaaggaagagagggtgtcgctgattcaggcacctgcgagttcttttttttttttttttttgagacagagtcttgctctgtcacccaggctggagtgcagtggcacgatctcagctcactgcaacctccacctcctgggttcaagcaattctcctgcctcagcctactgagtagttgggactacaggcgcccaccacgacacccagctaattttgtatttttagtagagatggggtttcaccatgttggccaggctggtcttgaactcctgaccttaggtgatcctcccacctcggcctcccaaagtactgggattacaggcgtgaaccaccacacccagccacctgtgagttttgagtaaagcatgggtgcttgagagagtgatcaggacagaaaggagagtgtgacaaggctgagtggcagggactttgtcctgggggtgctagggagcctggggagggctgtaagcaggggaggggccaggtcctctctgtgctgtgtgggggataggctgtaggggacagacaggagctcaggaggctggggaaatggttggtgggaggagatgaggcctgagccctgttggccatgagaatggagaggagaggcccaagtagcatcaggggcaggagcgtggggctggatactgacaggctgtggccagcgagggagaaggagggaggaagggaggacggcaaatgaggtttgggcctgtgactgggtggatggtggggctcccatcatgaggagcgtgggagctggtctgggctcagcatgggacatgatgaatggcctgaggagatggctggggtaggtggaggcttgggcctgtgactcaggaaacatttaggagacagtttctatttggtggctgaaaccacagaaatgcctgcgacggctctctttgagaatggctgcctcctaggggtatgggtgtgccataagactatcttggagatggagaagcagagatagggccagaataggatggggtcagatctgggctgcaccttgttccctgctggtagtaccctagggttttttttctttcttttttcttccttttttttttttgtagagacagggagttcaaggccagtctggtcttgaactccaggcgtcaagtgatcctcctgcctcagcctcccaaagttctgggagtacaggcgtgaggcaccgccccagcctgatccccgagtcttttgcttggctgagccataaccacgcactcccttgtccccagagccctacagccccgccgtgtgggtgatgatgttcgtcatgtgcctcactgtggtcgccgtcactgttttcatcttcgagtacctcagtcctgttggttacaaccgcagcctggccacgggcaagcgtgagtcccccttcctccatcccccgcctcggagatcccgaaccacagagacagagaactacatttcccagcagcccctggagggggggcggtcaagctagggcctctcgggaggtgccagatgccttgagggccactgggaattgtagttctttctttttttttttttcccttccttattgagaagggatttggggtccatgtccacgtcctggccccctgcaggccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaaggtgtgtgtgggcccagggctgggctggagctggggctggggctggaggtcacagagcttgtcatgtggtagattagaggggattcttgcggggggcgggggtgagaggggtggggggagggcgggaaggggtctcttcccaaggagaattccagaatggtagaatggaatgttgtggatgaagaaagaacacggttcacgatgagctatttaaaatattcctagggaagagggtgtccctgaatgttctaggggcagttgtgtcaaataggatattctagaaccagtgcttctctcaaactgtgaggaaggattaatttttgaaacttctaaggctgggcgcggtggctcacacctgtaatcccagcacgttgggaggccgaggcgggcggatcacgaggtcaggagatcgagaccatcctggctaacacggtgaaaccccgtctcttctaaaagtacataaaattagccgggcgtggtgacaggcacctgtagtcccagctacccgggaggctgaggcaggagaatggcgtgaacccaggaggcagagcttgcagtgagccgagatcgccccactgcactccagccagcgcgacagagttagactctgtctcaaaaaaacaaaaaactgctagtccattgcagacaatgcttttgtaaaattcaacggaaatgaattattagaaaagtaaaataagatctaaaaccaagacagacaaaagtcaaacctggccaggaacggtggctcacgcctgtaatcccagcactttgggaggccgaggtgggtggatcacctgaggtcaggagttcgagaccagcctggccaacatagtgaaacctcgtctctaataaaaatacaaaaattagccaggcgtggtagtgggtgcctgtagtcccagctacttgggaggctgaggcaggagaatcgcttgaacccgggaggcggaggttacagtgagccatgattacgccacaaatagaactgattcctagcctgggtgacagagcgagactctgcctaaaaaaaagccaaactcacatttttatttattagattcaacagacgaaaaagaattctgtcaaatcactctaaatgctcactctctccattcctgtacacatctcactgcaatcaccgtttgttgagggactggtggtttgcagagcatactttgagactaaagtgattaactagctgggtgtcatgacctattagaggcttgagaaatcagtttgatgggttgcaataagcattttttaatggaatggagtagaatagaatagttgcctgcatcttatgtataagtttggttttacaaaacttgttttagttgtctgggcgcggtggcttatgcctgtaatcccagcactttgggaggccaaggcgggcggatcacctgaggttggtagttcgagaccagcctgaccaacatggagaaaccccatctctactaaaaatacaaaactggctgggcatggtggtatgtgcctgtaatcccagctactcgggaggctgaggcaggagaatcagttgaacctgggaggcggaggttgcagtgagctgacagtgtgccattgcactccagcctgggcaacaagagcaagactccgtttaaaaaaaaaaaagtgaactatttctgaacggattggtaaatagcaacagctcccagctcctgccatgccagcctctactcccaggacctcccgcgattcagtaagtgaagacttaacacctggcacatcaggggcctcagggaggcttctcgtgaacttttggatcacgtgtctgcaaccgtgtgtgctgggtgggagtggaaaagcattccctaatgtagtgagcgagtgttgagaaatattgaacactcctgggactggggtgtctgccagatagcgggtgtgtctcagaatgggtgatttatgttagggatgtccctgcggagggtgccctaatcactccccattctgccccagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggtcagcgcagactcgggccgggggtgggggttgggccgctggggacctgaggatgctcaaagatggcaaggggtccaggttcattcattcagtcccagaggtcagccctgggtgggtcagcttggagggcggaggtcactgagggtggaagtggactcctcctcccaggagcaggctccttgggatattttctgggatgcagtatttctggattctggggtgagactgatggggctcaaatctttgctcttccccttcttggctttgtgaccttgggcaagttactcagcctctctgaacctctgtttcctcctctgtaaaatgaggataacaagagtatccccactgtaatgatcataaggttgttacaagaattatactagtaagccgggcacggtggctcatgcctgtaatcccagcactttcagaggccaaggcaggcggatcacaaggtcaggagatcgagaccatcctggccaacatggtgaaacctggtctctacaaaaaatacaaaaattagctgggcgtggtggcacgcgcctgtagtcccagatacttgggaggctgaggcaggagaatcgcttgaacctgggagtcggaggttgcagtgagccgagatcatgccactgcactccagcctggcgacagagcgagactccgtctcaaaaaaaaaaaaaagaattaaactagttagtccactcagaacatttatttatttatttagaacagtgcccggtgcactataggtgtttgctgatattatcattatcattagacctgaactcactggaatcaatgcttagattgtgtttcttatctttttacatccctttcccaaatcatagggatgaagttaaattcagaggccaggcgcagtagctcacgcctataatcccagcactttgtgaggcggagacgggcagatcacttcaggtcaggagttggagaccacctggccaacatagtgaaaccccatctctacttaaaatacaaaaattaggctgggtgcggcaacaggctcttgggaggccgagacgggcagatcatttgaggtcaggagtttgagaacagcctggccaacatgatgaaaccttgtctctacttaaaatacaaaaattagccgggcgtggtggcgggcgcctgtaatctcagctgcttgggaggctgaggcaggaggatcgcttgaatgcaggaggcggaggttgcagtgagccgagactgtgccattgcactccagcctgggcaacagagacagactccgtctcaaaaagaaaacaatacaaaaaaagttgagttcaggccccaaagtgcagcccacgaatacaacaaggctgagcacagtaactctctccccgtcctgcatttactcagtccttccgtgtgcatttttcttatcctctgctgtacgctaagcggtgaacaaatagacccgattcctaggtctagaggtgggaaatgaacaataaacatgcaaacagaaaaatcaagatctcttcagaaagtgatggtgagctagagggcggcagggctgggatattttcaccagggtgttcagggtgggcttctcggaggaggtgacatttgtgcagagccctgcaggaggtgaaagagctagccaggtggacttccggaagcagagccttcagacggagggaacagagtgtgcaaagggcctgaggaaggtgcagtgttggtttactggaggaacagcaagaaggccagtgtggttgaagggcaaggagctgaggtgagagagtagatgaggggaggattctgggcatgaggccaaggtcagggctggactttatgctaaaggcggtgagaagccttgaggtgtggagattttacgtaaggaagggtatgatctgatttctgtttttgtttgttttgagacaggatctcactctgttgcccaggctggagtgcagtagttcgatctcagctcactgcaacctccgccttccctgggttcaagcaattctcccacctcagcctcctgagtagctgggattacaggcgtgcactactatgcctggctaatttttgtatttttggtagagatgaggtttcaccatgttggtcaggctggtcttgaactcctgacatgaggtgatctgcctgcctcagcctcccaaagtgctgggattagaggcgtgagccaccatgcctggcttaaaaaaatttctaatgcccaatgcagtggctcacacctgtaatcctaaagctttgtgaggccaaggtgagaggatcacttaagaccaggagttcaagaccagcctgtgaaacatagtgagacccccttgactcacaaaaaaaaaaatttttttttttttttttttttttgagacagagtctcgctctgttgcccaggctggagtgcagtggcacaatctcggctcactgcaagcgccgcctcccgggttcacgccattctcctgcctcagcctcccgagtagctgggactacaggcgcccaccaccacgcccagctaattttttgtatttttaatagagacggggtttcaccgtgttagccaggatggtctcgatctcctgacctcgtgatccacccgcctcagcctcccaaagtgctgggattacaggcgtgagccaccgcgcctggctggaaattacttttaataatatattttacctaactatgtccaaaatattattttgacacgtaatcagtataaacatgggtgagaccgtttacataatttttttccccacacgctgtctttgatatctgtggcattttacactcacagcacatctaggttcagagtgaccacatttcaagtgatccacagccctagtggcgtgtcactgctgcactggaccgcccaggtcgacatcacccaaatgcaaaaagtttcctagtcaacataatgaacagaaaatataaaagggcgctggccgccccccaggaccctgggactttttcacttccttactcacccagagcattctccccagccagcctgctgactcatctctcccccttcccccttcttccgttttcttctcgccagcccttccctccaggaaggaccctgagaattccagattctctcttctctctctctctctctctctcacacaaaacagggtgcctttccaggctgccacctcccacctctgcttcacttgcgccttcctcagaaggcagggatggctgcaaacagaatcactttcctcttttaccccttcagggatacctcacactgccagcctgctcagtccttgcagtgggagagcaagaattcagagactctcagtgggcgggcgggggggatcccattttctttttttgagatggagtctcgctctgttgcccaggctggagtgcagtgctgcaatctcggctcactgcaacctccgcttcccgggttcaagcgattctcctgcctcagcctcccgagtatttgggattacaggcatataccaccatccccggctaatttttctatttttagtagacatgtgatttcactatgttggtcaggctggtcttgaactcctaaccttaagtgattcacctgcttcggcctcccaaagtgctgggattacaggcgtgagccaccgtatccagcggatggcactttccaaatctacttggttcccaagttttggatagcaagtggtgagaatgtgactagcaagacagaccagccccatctctcaaaatgaacctaaatctgtccccgccttgagttcagagaaagcaggatacctgtattttttttcccatacaaatgtcagccacatcaccagcctttaataagtaaaaatagctgaggcctcatcccgtgtctttttatagatatttttcatcttttttttattgagatatatacatagatacagtgaggtacagtgaggtacaaaaagcgtgcaactcattatttatacattcatagacatccatgtgaccaggtccagattaaggtatggtgaatttcccggcttctcataaagcttcccctgcccctccagtcaccatagaatatcatataattagttttgcctgattttgaacgtcctctaaacagaatcaaacagtgcatataataccttcctgtctggcttattttcctcagtgttatcaccagattgttccttcattgctgaataccgttgagtataccattatataaatataccataattctttcattctactgctggtggacattcaggttattgccagtgtttggccattatgaatattgctttttttcttttctcttctttctttttctttctttctttctttctttttttttttttttttctgaaacagagtctctctctattgcccaggctggagtgcagttgcgcgatctcggctcactgcaatctccgtctcctgggtttgagcggttctcctgcctcagcctcccaagttgctggaattacaggcgcctgccaccacgcccagctaatttttgtatgtttagtagagatggggtttcaccatcttggccagactggcctcaaactcctgacctcaggtgatccaaccgccttggcctccaaaagagctgggattacaggcataagccatcatgcctagctgaatattctcttttttaaacatgtgtaattgcctcttttttttttattttttatttttatttatttatttattttttcagacagagttttcctctgttgcccagactggagtccagtggtgcaatctctgctcactgcaacctccacctcccaggttcaggcgattctcctgcctcagtctcctgagcaggtgggattacaggcacacaccaccatgcccggctaatttttgtatttttagtaaagacggggtctcaccatgttggccaggctggtctcaaattcctgacctcaagtgatctgcccacctcggactcccaaagtgctgggattacaggcgtgagccaccacaccttggcccattatgaatattctactatgaacattcttgtacaagtgtttgggggacatacacattccttttccttggttgtattcccataggtggaactacccggtcatagggagagtatgcttagctataacagatactgtcagacatcttccaaaacagttaggcacagtggctcatgcctgtaatcccagcactttgggaggctgaggcaggcaggtcacttgaagtcaggagttcgagaccagcctggccaacatggcgaaaccctgtctctacaaaaaaatacaaaaattagccaggtgtgctggcaggcacctgtaatcccagctactcaggaggctgaggtaggagaactgcatgagccctggaggcagaggttgcagtgagccaagaccacaccactgcactccagcctggctgacagagtgagactccctctcaaaacaacaaaacaaaacaaaacaacaacaacaaaaatccaaagtggttgtaccaatttacactctcatcagcaatgcaagagagttctacttgttccatatccttcttgcctccttgccagggcttgggatcattcctatatcttcttttctttttttttttttttttttttttttgagacagagtctcactctgttgtccaggctggagtgcagtggcgcgatctcggctcactacaacctccgcctcctgggttcaagcaattctctgcctcagcctcctgagtagctgggattacaggcatctgccactatgcccgggtaatttttgtatttttagtagagatggggtttcaccatcttggccaggttgatccaccttgaactcttgaccttgtgatccgcccgtctcggcctcccaaagtgctgggattacaggcgtgagccaccctccttggtctactcctgtatctttttaatttactttgatgtttattatatatcaagtcctgttctaactaatttaagttcacaattagtttgcaaaaaattaatcaaatcaatgttttgattcatagtcctggaggctaggcatcctcttggctccttcagagggctgtgagggaaggatctgtccaggcctgcctctccttggctgttgactcttgatccctgtatctcttcccatcatcttccctctgtttgtgtctctgtggccaagttcttttttttttttttttttgagatggagtgttgcccaggctggagtgcagtgacatgatctcggctcactgcaacctctgccctctgggttcaagtgattctcctgcctcagcctccttagtagctggtattataggcatccgccaccacgcctggctaatttttgtatttttagcagagatgggtttttgccatgttggccaggctggtctcgaactcctgacctcaggtgatatacccacctcagcttcccaaagtgctgggattacaggtgtgaaccaccgaacccagtcaagctcccccctccccctccccgctttttttttttttaattgagacggactttcactcttgttgccccggctggagtgcagtggcacaatctcggctcactgcaacctccacctcccgggttccagtgattctcttgcctcagcctccctcctgtagctgagattacaggcgtgtgccaccaagccccgctaatttttgtatttttagtagagacggagtttcaccatattgctcaggctggtctcaaactcccatcctcaggtgatccgcctgccacggcctcccaaagtgcttggattacaggcgtgagccactgcgcccggcccaagttcccctttttataaggacactagtcatactggattagagcccaccttaatgatctcattttaactggattccctctgcagaggccctatatacaaataaggtcgcattctgaagtactaggggctaggacttcaatatgtgaatttggtgagggaacacaactaaacccttaagacctcataaaaaatcttaggtgggtatgattggaaacatgaggagcagcaagcttcttgcatctgctaagtggcagaactaggactggaaccctggcagcccagttctacagcccaggttctcaccactaggctatattgcctcacatgtgcactgagtaacccagaatcactccttttgtccccctccctagaagcttcatgattcacaaaggacacccctgtgtttctcattgtcatctcttgctctaatttcctgcttctgctgaattctttttctccagtatcccttgttactttttcttttttttctaatttttagttctatatttatcagagttctccatccacatagtttggagagtcagatacaagaatttcagtttagtttagtttggtttgggagtcaaggtcgcactctgtcacccaggctggagtgcagtggcatagtcacagctcattgcagcctcaagctcctgggctcaagtgatcctcccgccttagcctcccaagcagctgggactacaggtgtgcacccccacatctgattaattttattttatttatttatttttttgagatggagtcttgctttgtcacccaggctggagtgcagtggcgtgatcttggctcactgcaacctctgcctcctgggttcaagtgattctcctgcctcagcctcctgagtagctgggattacagaagcctgccaccacgcccagctaacttttgtattttcaatagagacagggtttcgccacgttggccaggctggtctcgaactcctgacctaggtaatctgcccacctcggcctcccaaagtgctgggattacaggcatgagccaccgggcccggcctaattttaattttttaatgtgtgtgtgtgtgtgtgtgtgtgtagagatggggttctcactatgttgcttaggctggtcttgaattcccaggctcaagtgatcctcctgcctcagcctcccaaagcaccaggattacgggcacgagccaccgtgcctggaaagaattttatctttaaggaaaaaaatggcaccctccatttctctcagcccagaggaatctactttcaccttgtttattgtatcactttgtgatttatctccctatctctaaataccatgtttgcatgactacctcttgatttttcaattttaggcatttttccatccgcttctcactatggaagacatactcatactcttatttaaatcaattcagcctcccacattgtgactctgacagatgaatattcagtgtttacatgttatgactatgtaaatgctctcacagctgccacagtagtaaaccgtgattactttcctctcctacacaattctttgtttttctttcttttttttcttgagacagggtctcactatgttgcccaggctggagtgcagtggcgtgatcttggctcactgcaatctgtgcctcccaggttcaagtgattctcctgcctcagcctcccgattagctggactacaggcgtgcgccactgcgcctggctaattttggtaattttagtagaggtggggtttcaccatgttggccaggctggtctcaaactcctgacctcaagtgattggcctgcctcagcctcccaaagtgctacgattacaggcgggagccatagctcccagctgatagggggtttcaccatgttggccaggctggtctcaaactcctgagctcaagggatctgcccacctcagcctcccaaagtgttgggattacaggtgtgagccaccatgcctggtctatttttcttgaggttagtaactgtcttttttctttttctttcctttttcagttgcttcatggctgtgttttctttgtggttaactaattcaaacccaaattatctgtttactgtctaaatctcttcttggtatgttcagaagtatattaatatacttaatatgttagaagtatcagatactctgttaatttcttttttcttttttcttttttttttttttttgagacagggtctctctctgtcactcaggctggagcacagtggcacgatcttggctcactgcagcctctgcctcctgggttcaagcgattctcatgcctcagcctcccaaatagctgggattacagtcgtgcaccaccacgcccagctaatttttgtattttttgtaaagtggggtttcgccatattgaagagcttggtctcaaattcctggcctcaagtaatctgttcacctcggcctcccaagtgctgggattacaggtgtgagccactgtgcctggccttgtcaatttcatcttattgaagaagttgctcttatggccttctggcctgctccagcctgggcatagccgccatcttgggatcacctttcaccttcatcccttcatctctggtttggatcctgttgtagcacaaattctaactctttctgggttttgcttccttgttcttttgagcttcctgacagaggcacatagcgggtatatttttggagacattgcaaatctgaaaagtctttttttctgtccttgtacttgatggacagtcaggctgggtatagaattctgcattagagctcattttccttcagaatttggaagagtcactctattgttttctaatatccagtgctactgtagagaaatccaagatcattctgattcctatgcctttgtatgtaacctgttgtttcttttccttgtccttggtggactgacatttatcagtgacatgccttgatctgtttcccttttttttttttttttgagacggagtttcactcttgttgcccaggctggagtgcaatggcacgatctcagctcactgcaacctccacctcccaggtacaagcaattctcctgtctcagcctcccaagcagctccgattacaggcatgtggcaccatgcccagctaatttctttgtatttagtagagatggggtttcaccatgttagtcaggctggttgcaaacttctgacctcaggtgatccacccgccccagcctcccaaagtgctgggattataggtgtgtgccaccgcgcccggcctgctttcctttcttttcttttatcttttctttattttttatttttttgagacagagtcttgctctgtcaccaggctgaagtgcagtggcgtgatcttggcttactgcaacctctgcctcccgggttcaagccattctcctgcctcagcctaccgagtagctggactacaggtgcccaccaccaagcccagctaatttttgtatttttagtagagacggggtttcaccgtgttggccaggatggtctcgatctcctgaccttgtgatccgcctgcctcagcctcccaaagtgctgggattacaggcgtgagccaccgcacccggccttctttttctttctttttttttttttttagaggcaggttctcattatgttttccaggctggtcttgaactcctgggctcaagcgatcctcctgccttggcttcccaaaatgctgggattacaggcatgagccatgcgcatggccattgatctgtttccgttgctgggtctttcaatcgtattctcatgtcatttgttctgagaaaatttcttgaattttcttaaattcttttatgtacaatatctccctctccttcatttctctgtttgtttatttatttatgtttagagacagggtctcactctgttccccaggctagagtgcagtgaggcaatcatagctcactgcagccttgacatcctgggctcaagcaatcctctcgcctcagcctcccgagtagcttggactacaggtgtgtgccactttcgtgtagagacgggggtctcactatgttgcccaggctgctcttgaactcctaggatcaagcgatcctaccaccttggcctccaaaagtgttaggattacaggtgtgaggcaccatgcctggccagaaactggactttctttttttttttttttatttcattttgcttttttttgagacagagtcttgctctgtcacccaggctggagtgcagtggcacgatctctgctcactgcaacctccacctcccgggttcaagtgattctcctgcctcagcctcccgagtagctggttctacaggcgcccgcaaccatgcccagctaatttttgtattttcagtagaggtggggtttcaccatgttggccaggctggtcttgaactcctgacctcaaatgatccacccacctcagcctcccaaagtgctgggattacaggcgtgacaccacctgcaatacaggtgcaatggctcacacctgtaatcccagcactttgggaggacgagaagggcggattgcctgaggtcaggagttcaagaccagcctgaccaacatggtgaaaccccatctctactaaaaatacaaaaattagccgggcatgatggtgggcgcctgtaatcccagctactcgggaggctgaggcagaatcgcttgaacccgggaggtggaggttgcagtgagctgagaccagcacattgcactccagcctgggcaacaatagcataactctatctcaaaaataaaaatagaaaataaagaataaataaataaaatttaaatgcaaatagccatatgtggcgagctagtggttgccatagaggacagcactagaaaattccatctttacagtgaggcacaagggagaggcagctcccagggctctggccggctcgcaggccaaacgtgggctcaccctaccgcttccggcaagtaaccccacagggggagaaaggaaatgcacgtcctaaaaagaaatagagaaacacagcttctcctcccagccagttcttggtgccctttccatgagagatgtgcaatttctcactcactcaagaggggcaaaaaaggaaatatcaaggcccctttccgtaatgtaagcattatttttttttcttttggatcaattaaaatatggatgcattcacactcacacattccaaactaacagtacacactgttctcatcttgcctttttccacggagaaagcccttttggcatcttttctgtgttaatggaatcctacttctcagctccagtgtctgggccatggaaggcctcccttggaccagtctgagtttactcatttggccgcttcttttctttttttttttttttgagatggagtctcgctctgttgcccaggctggagtgcagtggcgcgatctcggctcactgcaggctctgcctcccgggttcataccattctcctgcctcagcttcccgagtagctgggactacaggcgcccgccacctcatccagctaattttttgtatttttttagtagagacggggtttcaccgtgttagccaggatggtttagatctcctgacctcgtgatccgcctgcctccgcctcccaaagtgctggcattacaggcacaagccaccgcgcctggcggccgcttcttctattttcttttgagatgcagtctcgctctgtcacccaggctggagtgcagtggtgtgatctcagctcactgcaacctccacctcctgggatcaagtgattctcctgcctcagcctcccgagtagctggaactacaggcacacgcaaccacacccagctagttctttttatttttagtagagatggggtttcaccatattggccaggctggtcttgaacttctgacctgagatgatccgcccacctcagcctcccaaagtgttcttgggattacaggcgtgagccaccatgcctggcccacttcttttcttttctttcgaacttcttttttaaaaatttttaattgtatttttttttttacagatggtctcactatgttgcccaggctggtctcaaactcctggcctcaagcaatcctcccaccttggcctcccaaagcgatgggatgacaagcttgagtgaccactccctacctgaacttttgttaaatttattcctaaatattttattttattttattttttatttttttgccagtgtcaaactcctgaccccaaggaatctgctggcctcagcctcccaaagtgctgggattataggcatgagccaccgcacccagcctggaattgttttaatttcattttaattgttcattgctagtatataggaatataatttatttcacatattttgtaatttatttcgtatattgatcttgtatcatgaaccttgttgaacttctattagccataataatttttattgtggatcctttgggatttttctatatacaattctattaattcgctagggcagccataacaaaataccatagactgagtggcttacacaacagaaatgtatcgccccacagttgtagaggctagaaggtcaaaatcaaggtgtcggcagtgatggctccttttgagggctgtgggaggacctcttccagaccttcctccttggcttgtaaaaagctgccgtcttcctctgtctcttcaccttgtctaccctttaagtgcccattcagccacttgtttttttttttttttttttgagacggagtcttgctcttgctccattgcccgggcaccatctcagctcactgcaacgtccgcctcccaggtttaaacaattctcctgcctcagcctcccaagtagctgagattacaggcgtgtgccaccacacctgactaatttttgtatttttagtagcaacagggtttcgccatgttggccaggctggtcatgaacttctgaactcaggtgatccgctcgaggttcaagcaattctcctgcctcagcctcccgagtggctgagattacaggcacatgccaccacacccggctaatttttgtatttttagtagagatggggtttcactatgttggccaagctggttatgaactcccgacctcaggagatccgtgccccgggcggcctcccaaagtgctggggttagaagcatgagccaccacacccagccgtccagccatttcttagtaagcacctagtgtgtgctaggcactgttctagaccctgtggatacagtggtgaatcagacgggcaaagtccctgcctcatggaacttaaattccagtgaagggagacgtgcaatgcacggaataaatgagaatattctatagtgcattccaaggggatacgcgctatgggtaaaaatagggcagggtgaatgcatttggaaaactggggcgggagactggaggttgcagtatcaaatagggtgctcaggaaggtgtctttggagcaaacacctgacggaggttgtaactgcccagtgggttcacgttgcccgctgcctagacagagccgatttatcaagacggggggtctgcaatggaaaaagagtcattcacgcagagccggctgtgtgggagaccggagttttattatcactcacatcagtctgcctgagcatttgggaaccagagtttttaaagataatttggcgggtaggggcttgggaagcggggagtgctgattggtcaggttggagttggactcacaggcggtcgaagtgaggttttcttgctgttttctgttcctgggtgggatggcagaactggctgagccagattaccagtctgggtggcgtcagctgatccatagagtgtagggtctgtagaatatctcaagcactcatcttaggttttacagtaatgatgtcatccccaggagcaatcgggggagccagaggctgcatggcccctaaccttaatttctaatcttgcagctaatttgttagtcctgcaaaggtagactagtccccaggcaagaagggggtctttttaggaaagggctagtatcgattttgtttcagagtcaaaccatgaacagaattccttcccaaagttggtttggcctatgcccaggaataagcaaggacaacttaagggttagaagcaagatggagtcagtcaggcaaaggcactttcaaggtgagagagtgagtcaggcagctgtctaggagaagaatgttccagcaggcagaacagccagtgcaaaggccctggggcaggagcgagctggagaggtccaggtgcatctcccaggccagagtgagggggggcttgggagatgagggcagatgggtaaggagggatggggtgtcaggtggcacagggcctctaaactcgaggtgatccaagtcactctgagtgacgaggggagccaagagggggtggtgagctgaaaagggacagcgctgactcaaatgttaagatccctctggtgacagagtgggaacaaacaagaaagaaaggacggatgcagggaattttaatttttccccaacctacacccaaacaaaggctgtaggaaatggctgaggtctttttgttttgttttgttttgttttcgagacagggtctccctctgtaacccaggctggagtacatggcacaatcatagctcactgcaacctcatcctcctaccctcaagcgatcctcccacctcagcctcccaagtagctgagatgacaggcatgcaccaccaaacccggctaatttttaaagtttttgtagagacaggtctccctttgttgcccaagctggtctcgaactcctggacccaagcagtcctcctgcctcagcctcccaaagtgctgggatgacaggcatgagccagggcccctggaatggctgagttttaatagatatttagggaccatgaaggggtggtggatgcgagaggggagggagacagtatatcccagaaaaactgagcaaaccattgaaagtgaatgctgttagagctcctctttctgaaatctctcaaatatttccaccactggaagccttgacttttagctttctccaaaatgtaacttgagtctctccttccactcccgcttgtcctctgaggacccctggagacactcctcccatcttatcccagtcccagcccttctatccctaactctagaaactccacattcttcccacttaaacatcaatagcacttcacctttcacccccaagggcatcttcctaaacaaagagaaacgtagggaaaaattacagtttgcctacaaggcagaagtgcctgcaggcagtggtggtatttttctcgcctatacttatattccagatgtcatatgggaactccctgttaggatctatataaaattaattcaaaccccattctccaacggtgggatgatgaatgtcctccccacgtttctgctaattctccggagcttcacattctccacccctgagtctttgcttcagctagagacattcaatttgggggatccacttcctgtctgtttccccacttagcatgtatggactaattcagtccttttctctaatttccacgcaaacaaccacacacacacggcatttatatgtgagcctgtgagtgcgtggacagggtttttctgaaggtttggggacataggaggacttaaatcaacagacaggctaactactcaagactagaggttaagtattcttctctggaagatcctttggcttctcttcaactcagcatccagccgcctttttttttttttttttttttttttttttgagacggagtcttgctctgtcgcccaggctggagtgtagtggtgcgatctcggctcactgcaacctctgcctcccgagttcaaacgattctcttgcctcagcctcctgagtaactgggactacagatgcctgccaccacgtctggctaattttttgtatttttagtagagacagggtttcaccgtgttagccaggatggtctcgatctcctgacctcgtgatccgcctgcctcggcctcccaaagtgctgggattacaggcattagccaccgtgcccggcctaatttttgtatttttaatagagacggggtttcgccatgttggccaggctggtatcgaactcctgacctcatgtgatccgcccgcctcagcctcccaaagcgctgggattacaggcgtgagtcactgcgcccggccaatatgaactcatattctatataggattctgggagtaatttttgtgttcatttgttttgtttttagagacagggtatccctctgtcacccaggctggggtgcaatggtgtcatcatagctcactgcagcttcaaactcctgggctgaagggatcctcctgcctcagcctcctgagtagctgggaatataggtgcatcaccacacctggctaatttttttttttttttatagaggcagggtatcactatgtggcccaggctggtctcaaactcctgggctcaggcgatcctcctgccttggcctcccaaagtgttgggattacaggcatgagccatcatgcccagcctaactttttaaaaaatacaccccataaggtcaggtgtgaaagctcatgcctgtaatcccagcattttgggaggctgaggcaggaggattgcttcagcccaggagtttgagaccagcctgggaaacagagtgagaccccatctctaaaaacaaacaaacaaacaaataaataaataaatatttaaaaaatatataaaatacaccccatacatccttacctgtcagagcataagcatttatctcataccacagaagagttacacagtattcctctgtgtggattcatttattcattcattcatttattctgcaaatatctatcaaccccgtcctacatgccaggaactatgccccagccacagatgagaataagaccaactgggaccctgggggtcttgcagtctcatggggaaggttgagattaatcaaacaaccacagaaataaatgtaaaatgacagcagttgtaaatgagagtgatagcagcatgtgccataacaaatgcatccatgagaactaactccacagccctgcccttcttcccaccaagtcttagaaatcagggcctaggctgggcacggtggctcatgcctataatcccagcaccttgggagaaacccactttgggaagccaaggtgggacgataacctgaggttgggagtttgagaccagcctgaccaacatggagaaaccccatctccactaaaagtacagaattagccaggcgtggtggcacatgcctgtaatcccagctactccggaggctgagacaggagaatcgtttgatccggggaggcggaggttgtggtgagcccagatcgcaccattgcactccagcctgggcagggcctaggccaagtgtggtggctcacgcctgtaatcccagcattttgggaggctgagttgggtggatcaactgaggtcaggagttcaagaccagcctggccaacatggtgaaaccccatctctactaaaaatacaaaattagccgtgtgtggtggtgcatgcctataatcccagctacttgggtggctgaggcaggagaatcccttgaacctgggaggtggaggttgcagtgagctgagatcacgcctctgcactccagcctgggggacaagagtgaaactcggtctcaagaaaaaaaaaataaataaataaataaatcagggcctagtgggagaacccaagcaagttatgtgtctgggtctgtgttttcccatctgaaaagaatggttatctccctacaggctcacacctgtagtcccagtactttgggtggccaaggcgggaagatcacttgagcccaggagttagagcccagcctgggcaacatggaaaaaccctgtctctacaaaaaatacaaaaattagccagatgtggtgatgtgtgcctttagtcccagctactgaggaggctgaggcaggaggttcggttgaaccgaagaggtcaaggctgcagtgagctatgatggtgccactgcattccagcttgggcaacatagtgagacctcgtctcaggaaaacaaaaaaaaagtgtccttagactagatagaacaatgcttggcacaatataactgatcattcacttgcattatttttttccctcaatcttcctctttatttgttttgagatggcatctctctctgtcacccaggctggagtgcagtggctcgattttggctcacagcaacctctgcctcccaggttcaagcaattctcctgcctcaacctcctgagtagctgggattacaggtgcctgccaccacacctggctaatttttgtattttcagtagagatggggtttcaccatgttggccagactggtctggaactcctgagctgacaggtgatccacctgccttggcttcccaaagtgctgggattacagccatgagctaccatggccagtctcaatcctcttttttaaaatgcaagagtaaatggactctttggagggctatggtgaggagtaaaggaataactatttcattaacagtcacagctggccaggtgcggttgctcacgcctgtaatctcagcactttgggaggctgagacaggtggaccacaaggacaggggttcgagatcagcctggccaacatggtggaaccccgtctctactaaaaatgcaaaaattagctgggcgtggtagtgggcacctataatcccagctacttgggaggctgaggcaggagaatcgcttgaacccaggagtcggatcttgcagtgagccgagactgtgccactgcactccagcctgggtgacagagtgagactctgtctcaaaaaaaaaaaaaaaaaaaaaaagaaagaaaaagtcacagttaacacttctccagcacctcctttgcatgaggtactatctaagctttccctatagtccctgctactggggaggctgagataggaggatcgcttgagcccaggatttctggtccagcctggacaacatagcaagaccctgtctcttaaacaacatacttttgcaacaactctgaagggagatactgctgccatgcccattttactgatgttgaaactgaggcactgagaagtgcaatgatttgctcaagagctcagggccagttaggatttggagcagttggaggttacaggtgaggaggttccaggcctggcggccagggcatctaggtgggactgaccctaccctccattccccctccccccaggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatggtgcggctgcacacagggatttccacagcggagagggggagggcgaggcccctgggttccggggaagaaagggacaaagacccggacaccagggtctgagggaggaaggggctaagggcctacattcccacatcacagacaagggtcctcagagggtactcatagcaggtgacttttgaccgcccctccctagatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccagggtatggggcagagagggaggcagagagggggagatggcaggggcggggacaaaggtaaagccgagcagagacaaggagatgtgggtcgagatgtggatagtggggaagagagcgggaaacacaggcgggtaaatggagaggagagagggactgaggggaggcgggcaggcgtcctgggcatctcgcgctgacccccgtcctgtccccggacccgcagggcatgtacagctgctgcagcgctgaggccgccccaccgcccgccaagcccccgccgccgccacagcccctgcccagccccgcgtaccccgcgccgcggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccgccctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgccgcgccgcgccgcccccgtgcccttacctcgatctcgagccgtcgccgtcggactcggaggactcggagagcctgggcggcgcgtcgctgggcggcctggagccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatcactgtgcagctccccggccccagccgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctca

SEQ ID NO: 1379 - DNA, 8985 bp, Homo sapiens
gaaaggtttcattttcttctgtttatttcaagagaacaaagattcaaccatcagttctgtacaaaaacatggtgtgagagccatgggatcctcgggccagcccccttcccgcacttgagccccgggcccccctaatttgccaaaaaaccaggagaagaccaaaaaattcaaactctggggaaaaaaattactatgaaaaaaaatcaggggagaccttcctgggcctccctttctccctatccccaatctagaaatttagtgggggtcgcggttcatggccatggcaggaggtggggcagatgggtgtcggcagatttagtgtttggcaaccagtggggctgggggtgggatctgggagggagccgaggggcctggggaagggaaaagatcttggaccctgccccggcccataggacactcaaaaacactttataaaaattggggccacagagtagaagaaaaacgagtcatcagaatcaaaaactaaagagtggaaagatttttttttcttgtctaaaaggcaaaaaactacaaacagcccaagtcctgagctccccaagacctggatcctccactgtccccctgaaacccggcaggaggcgggatggggagcacaagaggtgggttcttaaaaaagtcacccctggatgggaaagctcttcatcttctgccgccttcctctgcctcccgctgctgccgaggagagagatggagaggaccggggctatgccggcaaactcaacttcttcccctttaggactgtgaggagagaaaacagggagggcattaccgctggggcccctgcagggaggggacagcctcccacagccagagcagggcaggcacgctagatgggcagatccacagggagggaggtcccccaggactcacagatacattcctggtttctttccttcctaccctttctcactactggcaattttctttctttctttttttgagacaaggtcccactctgtagcccaggctggagtgcagtggcatagtcacagctccatgcagccttgacctcctcaagcaattctcccacctcagcctcccaaggagctgggaccacaggcgtgcaccaccatgcccagctaatttttttatttttttattttttatagtgacagggtcttgctatgttgctctggaactcctaggcttaagaaatctccctgcctcagtctcccaaagtgctgggattacaggtatgagccaccatgcccaactaattctttctttacttgttcattcaccatctcccccaccagaataaaagggaaatggaggcctttgtctatcttttctcctcctaatgtatccccagagcctagcacctggctggggacatagaaagtactcaatacatttgttgcatgaataaatgaatgaatttcagtgggctgagtccctgccctgcctggcctacgctccaagtgacatgggggctaaggacagaaactccttagcccttagggaggcagaggctaacggtctgaattcctaggaggatggtaggcctgccaccccagaaacccggcgaagaaatgctcccttctttgcataatacaggggtaaggagaccccagtccccagggagggcaggagctgcagaaataggaggttcccttccagccgtcccacattccagctacctttggtgatatagaggtagaagaaatcgcagtagaggactgtctggaccaggcctgccacaatggcgatgaggtcgaagaagccctcgaaatggtagcgccagatccagttgaagagatagagcgtgcggtaaacgcctagcgcaaacaagtagtggctggtgatggtctccgcctcgccggtcttgctcaccatgaacagctgcggcaagatggccactgactccaggtagatggagaaggtccagaggatctgcagagaggccggggacatgatgaggtgggaggggacagggcgggagaaaaggcagaggacaacattgcagttacaggtgccgcgaaggtggagagaaggaaggtgatccaggtgctgccaagtgccagacacagttctgcccgagttactggtacctctgatttaatcatcaccatggcccggcgaggagatcctatgattagcacacttattctacagatgaggaaactgacaccagagaaggtaagatactcgcccaagaccatgtagccagcaagcagcagagcaatgattcgaaccaaggattcgcagtccgttctcatgaacactttgcaattgcgcctctctgaaaggcaggctgggttggaatcttgccttggaaatttcccttcctttttctttttcttttttttttttttgagatggagtatcactctgtcacccaggctggagtgccatggggtgatctcggctcactgcaacctctgcctcttgggttcaagcgtttctcctgcctcagcctcctgagtagctgggattacaggtgcccaccaccacacccggctaatttttgtatttgtagtagagacagggttttgccttgttggccaggctggtctcgaactcctgacctcaggtggtctgcctgccttggcctcccaaagtgctgggattacaggcatgagccaccgtgccgggcccacatgccatttcttgtggcaggctgcatatgctgttcccacagcaggaaaagctcttcccctacactgtcacacatctgcctcctccgtattctcccagcctcagctcattagtcacctcccgagagggaccctccctggccatccttcccccaggactgtcacatcaccccatcttatctccttcctggccactcgcaccagcaattgagctctgtgagggctgggatcctacttcttgttcaccccgtggccctagcacctagcacagttcctgaatgagtgaggaaatgggagttagcatctataaaggggtccccatgtgctcagcacaggccaccatttagggagcactgacaaccatcattcatgagcaggacaggacatcatgggacagggaagaagacatctgccagccccctttcagtccccagctccctgaaagtgccacctggggtgatctgtgatctgcagacacactgaaacctcagagagcaaagccaggtggcaggtgtggctccttggttgtcttggtttgtggaaggaaggtggggggcaccaggacctattcataacaactcatgcttttctagcatttacgacatccaaggcatcgctccttagggtgttaactggcctgagccttaaccccatgaggtaggtactgttgtcattcccattctacagatgaggaaactgaggcccaaaggataagaaacgtgtccagattcccactgaagcacgtagagtccaggacctgctcccagaatcatccagaatcctccagggaggctctcgtgaagccaggttagttgatgctgctgggaaacgaacccattaaattgatgcccattcaactctcacccctggggttgcccttagggaacagagtcaccgtttaaagagagacagaaggtctgttgctttttttttttttttttcctgaggccgagtttcactcttgtcacccaggctggagtgcagtggcgcgatctcggctcactgcaaacctccacctcacgggttcaagtgattctcctgccttaacctcccaagtggctggaattataggcactcaccaccacgccctgctaatttttgtatttttttagtaaagacagggtttcaccatgttggccaggctggtcttgaactcctcacctcaagtgatccacccacctcaccctcccaaagtgctgggatcacaggcgtgagccactgcgcccagtcttgcatttttatctattccatgctgtttgaattttttttttttttttttgagatggcgtcttgctctgtcacccaggctggagtacagtagcacgatctcagctcactgcaacctctgctgcccgggttcaagtgattctcctgcctcagcttcccgagtagctgggattacaggtgcatgccaccatgcccggctaatttttgtatttttaatagacagggggtttcagcatcttggccaggctggtcttgaacccctgacctcgtgatccacgatccacctgtctcagcctcccaaagtgctgggattcaggcgtgagccactgcgcccagcctgatgtctgaatttttaaagaatattttccttaggtcaggcacggcagctcacacctgtaatcccagcactttggaaggctgaggcaggtggatcacttgaggccaggagttcaagatcaccctggtcaacatagcaaaaccctgtctctcctaaaaatacaaaaaaattttacctgggtgtggtggctcatgcctgtaatcccagctactcgggacgctgaggcacgagaattgcttgaacctgggaggcagaggttgcagtgagcagagatcgtgccactgcactccagtctgggtgacacagcaagacttaaaaaaaaaaaaaaaaaaaagacgcctgggttctggtctggcctcctccaccttcagcaagccgcactacctccctcagcctcagtctccccatcttcaaaatgggtctagtaatccctagtcaacagggcagttatgagctaagtcaagggcttggataagtgatccaagcaaggtggtaacaatatgtttgcaaagtccagggcctggagccaagcccaggattcccaccacagcatgatgcagcctccctctgatatctctgacccatgggccaaagtcaccctctgttggatttgtctggcctatacagtgcttttagagatatgttttgaaggccaggcacggtggctcatgcctgtaatcctagcactttgggaagctgagatgggagaattgcttaagaccaggagttcaagaccagcctgtcaacatggtgaaaccccatctctactagaaacacaaaaattagccaggcgtggtggcaagcacctgtaatcccagctactcgggaggctgaggcaggagaaacgcttgacctgggaggcagaggttgcagtgagccaagatcgtgccactgcactccagcctgggcgacagaatgagagtccatctcaaaaaagaaaaaaaaaaaaaaaaaagaaatatagtctgaatctgtggctaaaattttaaaatgagacatcttgcctgaaaactcctgaattatggcttctgttgaaaagatcagcacatctggccacccaggcctatcttcctataaggcaggagtgggcacaggtaagaaaaggttaccctgaatttatgattcctgccaggccccaggaggcaagagatcgcaaacttagcactggctctcgcaaaattcctcccaggagtttgtacaggtcccagcaaaacaccatggaataaaaatcattaacagcgaacatttaaaagtaaaagtatcagagatgggactaaacacttcagtcattgaacattgattgacacagcacttcctacctcatcccagatactgtgctttattaataccaacctctcatttgaaccctatgacataggaactgattatctccattttacagatgaggaaactgaggcacagggtagttatgtgatttgcccagaatcccatagctgctacatggtagaggcagggtccaaatccttacactctgattctagagtctttatgtgttttgacaccaggcagtgctgcaaagtctcagtaaattctcacaatgacctgatcacaactttacaaatgtggaaaccgaggtacagagaggtcaagtcacatgcacgggatcatgctaatagaaactagcagatttggagccgggcgcggtggctcatgcctgtaatcccagcactttgggaggctgaggagagtggatcacctgaggtcaggaattcgagaccagcctggccaatatgttgaaaccctgtctctactaaaaatacaaaaaataacctggcttggtggtgggcatctgcaatctcagctactcgggaggctgaggcaggagaatcgcttgaacctgggaggtggaggttgcagtgagccagaatcatgccactgcctccagtctgggcaaccgagcgagactttgtcgaaagagaaaggaaaaaagaaagaaaggaagaaaaggaagaaaaggaagaaaggaagaaaggaaggaaagaagaaagaaaggaaagaaaggaagaaagaaagaaaggaaagaaagagaaagaaaggaaggaaggaaggaggaaaggaagaaaggaaggaggaaaggaagaaggaaaggaagaaagaaaggaaggaaggaagaaagaaaggaaggaagaaaggaagaaaggaaagaaagaaagaaagaaggaaagaaagaaagaaaaaagaaactagcagatttggaattcaaattcaagaaggctgggccaggaatggtggctcacgcctgtaatcccagcactttgggaggccaagacaggcagattatttgagcccaggagttcaagaccagcctggtcaacatgtgaaaccctgtctggactaaaaatacaaaaattagcagagcatggtgatgtgcacctgtcttcccaactactcgggaggctgaggtaggataattgcttgaacctgggaggcgggggttgcagtgagccgagatcatgccactgcactccagtctgggcaacagagcgagactttgtctccagaaaaaaaagaatccctaagcctcagtttcctcatctgtaaagtggggctgctgagaaaagtaagtaggtgaaatgcttagggtagtgactgacacatagcgagtcttgctgctgttgtgttaatttcctctgaccccagagcccatgcactgaacttatgcatcctaaaataaggcagtttgggcacaccctgcagaaggaagcctgtgagagggtctcctgtcatagctactctgccacaaccatccccccaaataaggagtcacagcaaggcgcctacctccagaggggtgaagtcatgattgaccaggaacgccagaatggctgtgggaacgaccaggaactccactctgaacgtgtcatggttcccatcgtaagtagctttgaacttgctataaatcaaccagaccgtggtgaaggagcaggctatgtagaccacctgaggagggggatgatgagaaggggcctcaactcacaggcctgtgccccagtaggctcagagcccggagtccaggcccctccctcagacgcaggagtccagacccccaacccctcctccctcagacccaggagtccaagcccccagcccctcctccctcagacccaggagtccaggcccccaacccctcctccctcagatccaggagtccaagcccccagcccctcctccctcagacccaggagtccaggcccccaacccctcctccctcagaccctggagtccaggcccccagcccctcctccctcagacccaggagtccagggccccattccctcctccctcagatccaggagtccaggcccagcccctcctccctcagacccaagagtccaggcccagcccctcctccctcagacccaggagtccaggccccagtcccttcctccctcagacccaaaagtccaggcccccggcccctcctccctcagacccaggagtccagacccccaacccctcctccctcagacccaggagtccaggcctcagtcccttcttccctcagacccaagagtccaggcccccggcccctcctccctcagacccaggagtccaggcccccagcccctcctccctcagacctaggagtctgggacccacacccggctcctctgcctcagtgggggccagagaggtggggtggagcctctaccttcatacacgtgttgtagagtgagatgtagttggtgaagaggtccagatatcgggcagtgaacaccacagcaaacaggacctggctcttccctgaaattcctgtggtccagagacagagaaagagagagagagagagacagagagagagagagagacagacagacagacagacagacagaaggagagaggaagctgggggtgggctgcatgggcaataaactaaggcagggcgcccgggaccagcctggaggcagctctggagtgcagctgtccccggaggcctccccagcccgccccgcctgagcagggccctttcccacggaccacagccagggggcagcccaggcccccgaagctactccagcccgaggctccgtcccagactaggcctcatggctacccctggcccctcagggtcctcccgcagtctggacctgaggtgaggcctagggaggaccttccctgacctcaggccccggatccggtcacctccctcccgttcccttcctggccgccacggtccacgtcaccaactcacagccacctccccgcctgccatggttccctgttcccggtccatgaaccctcgggctgcccagattggggctgggggtggctgaattgggggcctaaagccattcacatgaaactgtatgcacccccgccagtctggggaagggagctgatcccctggagacccagaacctagaagagagatccccagcaagcagtgggggtggaacctgtgcccctagtgcccccaaacccttcctgagtcctgcgacgtcccccaacccccgcccgcaatctctctccttcgccagccctggtgggcctctcaccggcgcacgagcgggacttccagattttgagcagtagcaagatgatggcgaggaggtgggagaggtctcccaggaatcggaagagattcatggctggggaaccctggcagggctgagcgggagggaggcaggctggcgggggggtgccccccgaggctgctggtctgaacgggtagctgggctggggggacggaagagggaccctaggtgcgctccgctccggggaggggactttgggagggggagcaaaggctggagctggcggcggagctggagccgggaagag

SEQ ID NO: 1380 - DNA, 31700 bp, Homo sapiens
cgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctac

SEQ ID NO: 1381 - DNA, 65105 bp, Homo sapiens
gatcggtctcttctgttccgcgtcctccacctcggtagcccctggtgactctgtcacagcctctgttgacctatgatctgcagggagacgcacagccaggacatcctggaacctgggaaagggtgagtgtgcggggttgggcaacccgagaagggagaccaggctgtgaaaccagcagaaccggcctctccacagcccgctcccaggtcgccgacctgagtccccgctggcgcagctccgtcccaggcccctctggccgcaagatggcggctgggcccacagccgggaccccagcgtccagccccgtccgtgcggggccatgtctggagccccctgagcaagctcttcacgcagcctcgagtatttcccaggttgttcagggatgccaggcgggtcataagagcagaatcccgacccggtgtttgcgtgggaagaactgcagcctatggggctcccagtgtcttttgttaaacattttgtttgagacggagtcttgctctgtcgcccaggctgaagtgcagtgcgtgttcacggcaacctccgcctctcaggctctggtgattctcgtgcctccgcctcccgagaagctgggattacagacctgcgccaccccgcctggctaatttttgtatttctagtagagaagtggtttcgccatggcggaaggtggtctggaactcctggcctcaagtgatccgccagccttggccccccaaagtgctaagattaggaggagcatgaggcactgcgccaagcctcttctcttaaaaattaaagggagtcagggttaaaaccttaaagaggttatttgagccgtgattggtgaaatggaaagcaccccagccatagtatgtggcccacctgagagacataaagcaaagggttttataaagggcgtgtgagaaggcaaaccaaatgcaagaattggttagttatgtagtcaccttatttgtatgatacaggtggaaatttcctggttatgtaatcagaggttaattgcaggtttatgattggttaataaaattcaattatgattgaattttgtttccgcctaaaatagtaatctataagatataaactcgagttaggttttacattttttacttatgaacacagggcactagggccacttcagtctaatttcctgctttttaattactttaacactccacaggaggaggactggttttcctctgtgacttcctaatgtatggcaagcaggacttcttctaatccactaccctcttcccctagcttaactaaggcttgcagtaaaattataaatttccactttctttcctacattctcaaatgtaggaaatgaggacaaacaacttcctctctccaatttacaacactatcaactatttgtcctttattgtgcatttcagacacagtgttttaattgttaatcatgtttttacactgcagtggatggcaggtttttaaagatttgttttctgtttgtaaacacttttttattggagacagagtttcattcttgttgcccatgctggagtgcaatggcatgatctcagctcactgaagcctctgcctcccaggttcaagtgattctcctgcctcagcctcccaagtagctgggattataggctgccaccactgtgccctgctaatttttatattttgagtagagagtgggttttgtcttgttggccaggctggtcttgaactcctgacctcagatgatttatctgcctcagcctcccaagtctgtaaacattttatgtgagaaaaaaagtagaaaataatcctctggaactccactttaaaaaaaaaaaaaagtctgcgcctctccttcttttatcttccctaggcacacacaccctactagtacgtctttgggttgaagttttgctttggagaaattacagggcctttacagcagccctttagtctattcttggtaatgagtttcagaactgtctggggtaactcaacatacccacagtggccatatatcttggagtgtctaatgagtatcatcccctgagtcgtctcttagaggacagtctgaggagtaagagtgtagcctctcagaagagcaactggatggcctaggcctgtggaaaatttccttgtatactatttgtctaaaaagctaacctcttagaaaattaaaattattttttcacaaaggaatgcttctacactgttggtgggagtgtaaattagttcaaccattatggaagacatggtgggaactccctgaagacctcaagacaggaataccatttgacccagcaatccattattgggtatttacccaaagcaatatgaattattctattataaaggcacatgcatgcgtatgtgcaccgcagcacacttcacgatagcaaagacatggaatcaacctaaatgcctatcagtgatagactggataaagaaaatgtacatataaaacatggagtactgtgcatctataaaaaaaaaatgagattatgtccattgcaggaatgtggatggaactgtaagccattattcttagcaaactaacacaggaatagaaaactaaataccacatgttctcattataagtgggagttaaataatgggaacacatagacccgtagaggggaacaacacatgctagagcctattggaggagggagaggatcaggaaaaataacttatgggtagtaggcttaatacctgggcgatgaagtaatctgcacaacaaacccccatgacacaaatttacctatgtaaaaaatttgcaatgtacccttgaacttaaaagttaaaaaaataatttgttagcttttccaataattccctgatagcgttttgattttatgtgtgtatgacacctattatgtatcagaaatttggattacacagatgaacagggttcaacatacctgccgtgtaggagtttatagttcattagcatggataggtgtgtaaaaaattaatttattctggagaataatacttgtacataaaaagacataaggtattgagctgtaaggtaatagtgatcaattctgccactaacatagcagtgggaatatcaaggagggctttatagaagaggtgacatttgagtgggtgtcattgtttaatagaactttttgtattaatgttgctggtgcggatatttcatttcctttttttttttttttttttttttttttgagatggagtctcactctctttcccaggctagagtgcagtggtgcagtctcggctcactacaacctccacttcccaggttcgagtgattctcccaccgcagcctcccgagtagctgggattataggcatgagccactgtgcccagcctcagagtgtaccctttaaaaaattattttaaaaaaattttacctcttgactctgaaatatattgagaggtcttcccccaatgagataaaaatgaacaagtgtgtaaacagttaagaagttttttctcaagctaattttttttttttttttttgagacagagtcttgctctgtcacccaggctggagggcagtggcgcgatctccccggctcactgcaagctccgcctcccgggttcacgccattctcctgcctcagccttccgagtagctgggactacaggcgcccaccaccttgcccggctaattttttgtatatttagtagagacagggtttcaccgtgttagccaggatggtcttgatctcctgacctcgtgatccgcccgcctcggcctcccaaagtgctgggattacaggcctgagccaccgtgccgggccaaatgtttttttttttttttttgagacggagtttcgctcttgttacccaggctggagtgcagtgtcgttatcttggctcactacaatcttcacctcctgggttcaaccaattctcctacctcagcgtcctgagtagctgggattacaagcgcctgctatcaaggccggctaattttttgaatttttgtttgtttgcttgtttgttttgtgtttttgggagacagagtcttgctctgtcatccaggctggagtgcggtggcatgatctcggctcactgaaacctctgcctcccggtttcaaaccattctcctgcctcagcctcctgagtagacaggtgcgtgccaccacgcccagctaattgtatttttagtagagacggggtttcgccatgttgcccaggctgttctcgaactcctgacctcagattatccacctgcctcgccctcccaaagatttggggttacaggcgtgaaccacggtgcccggcctaattttttgtatttttagtacatacggggtttcattatgtttgccaggctggtctctaactcatgacctcaggtggtccatctgcctggggctctcaaagtgcagggattacaggtgtgagccaccacgcctggcctctcaacctgatttttatttttagtagacacattggtgatgagacaatcaaatgttcgcattgatgagaaaaggcagaaatgatttttgttctctggattcttgaaataaaattttttccaaaggacaagaagatcccatcccagtaaggcaatgcaagaacctgcaagcaaaatgtacctgagactcacagtggggtacaaagtgtctcctgggaaggtggtcactgagtaatttaatgggcaggatggggatgacagaatattttgagtgatattatggtctgacttgacagtggagtcagacatgtttgtgtcccaatcagcactgccacttcctgagtttgtcaccttggaaagattttttcacttatttcaatttcagtttttttttttttttttttttttgagacagagtctagctctgtcgcccaggctggagtgcagtggtacaatcttggctcaccacaacctccgcctcccgggttcaagctgttctcctgcctcagcctcctgagtagctgggattacaggcgcccaccagcatgcccagctaatttttctatttttagtagagacggggtttcactgtgttggccaggctggtctggaactcctgaccttatgatctgcccacctcagcttcccaaagtgctgggattacaagcgtgagccaccacgcccggcccaatttcagttttttaataactgtaaattacatttcatcagaagagcttaaaagatgtttaaaaagtcaacgactatgaaaggtatatttcagaaaaatctagtgatatgttttatttgttaaatttatgtttttttctggttgtgtaattttaaatagaaccccaggggtttgctttgagaatgctaccagagaagagaaataggaaaaatcttttttccattatggctatacaaagtgaatacatttccacaagcaaatatgatagattaattggtgcattgtatatatttctcaaaccatcagctcctctttttttcaaagtctagaatttgtaatggtggatatctctgttctgtattctgttgtctagatatccaagtttaatgcaaaattttatgacatggaacttgacactttctagaaatgttcacatatggttgtttattaaattatctctcatggaaatatttaaatgacatgtttattgtctgaaaaggacagatatttaagctttttttttttttttttctttttttttgagaaagagtctcgttcttttgcccaggctggagtgcagtggtacaatcttggctcactacaaccttcacctcgcaggttcaagcgattctcctgcctcagcctccctagtagctgggattacaggtacacaccaccaggcccatctaatttttctatatttagtagagacagggtttcaccatgttggccaggctgttctcaaactcctgacctcagccaatccgcccgcctcaacctcttaaagtgatgggattacaggtgtgagccattgtgcttggccccctttaactattttatgtgactcttctctcttacctgaacgttgcccaaaaagagattgtgacatatatttgggcccagcaccaaggtgatgtaactctcctcttcagccgggccttgcccacagaagagagaatgacttattcctgagtttagcatacaggtgatttgattcttctgctgactcccagaagtcactgtaacatatatctgggtccatcgctgagactgtgtgactctcttctccctgggacctgtccacagtggggattgtgacgtattgcttggccaagcacctacgtgatatgactcttttcttaggcctgggccctacccactggagtgattttgacacattgctgggcctagctcaaaggttatatgtgacttcacacttcttcctgggccctacccatgaggggcactgtgtcttaactctgagacacttaattaggtgatgtgactctcttttttcgagatggagtctggctctgtcacccaggctggagtgcagtggcaaaatcttggctcactgcaacctccacctcctgggttcaagtgattcaactgcctcagcctcatgagtagctgggattataggcatgcaccgccacagtcagctactttttgtatttttagtagagatgaggtttcaccatgttggccaggctggtctcaaattcctgacctcaagtgatccacctgccttgacctcccaaagtgctgggattacaggcgtgagccacgatgcccggccgatgtgtctcttttgtttggaccctcttcttgggatattgtgacatattgctgggcccaaaatctaggtgatgtgactctactctttggtctctgcccaaaaagggattgtggcatatcactgggtcaagaacctagatgaggtgactctcctctccagtctgggacctgcacacattgtgtgttgagacatatcactgggtctaacacctaggtaatgcaactctcctgcaagggccccgcccacagaagtattatgaaatatctttatattaatcacctaggtgatgtgacactcctcttctgcctgggaactgcaaaaaaagtattattacatatcactgggcccagcacctaggtgatgtgactctttgctcatgcatgtgctctgcgaactggggtgtttgttacatatagttgggcctaaaccctaggtcatgtgattctttcattttcctgagccatactcatagcattttgacatatttttgggcccataatttagatgatgtgactctcttgcatgggccctccccataaaggtagtgtgacatattgttgagcccagtacataggtgatgtgactcatagttctctatggattgggctttgcccaagcagggattgtgatgtgttgctggactcaccacctacgtgttatgactctcctcttctgcctaagccctgcatgcattgtgtgttgtgacatatgcctggattcagcacttaggtgatataactttatgacatgggaactgcccatggaagtattatgacatgtctcctttccatcacctaggtgatgtgacccttttatttttcttgtttctggcatattttgggtatagtgacgtatcattgagttcaacacccatgaaatggaggcttctgcctgagcccagcacataagtggccttgtgaaatatctttgcattcattatctaggagatttaaccccccttttctgcctgcaccctgaccactgggaagattgtgacgaatcaccggtctcagcaatcaggtgatctgtttttcctgcctggtccttgcccacagatcattgtaacatatcactgggcctagcatctaggtgatgtgactctgctgactgtattctgctttcagggggagattttaacataaccctaatcaagcacccatgtgtgggtgtggcacttctgccttatccctgccctcagagaagattgtgacatatcactgccccaaaatgcggtgatgtgagtctactggtcaatacctattcactggtgggattgtgatgcatatcttatccaaacttacaggtgcaataatgactctcatacctctaaacaaccagtagcagatgtagtttctctcatagccagcgtcaggaaaatgagtaatatcctgggcctcctctttgtatgaaggtcataaagaattaacactctctcacatactgtgtaaagttgtcaagaggtacagagaatgtcctaacagaactcagcacacaggggaggttgtgacactcatatgcatagcctgccaacagtaaagactgtcatccttccacataaacacagctcaatgttgaggttctgaatctcatacccagctgcagtcaaaagttggaaaattgaatgtcatgttaattcagtccatagagaggtcagtgtctctgagaccaagattcagcacatgtgtgagttgttgacttcaataaatgacacaatttgcaggagggattgaggttttcatacacaaatccagaccgtcattgagactcattcatgtacttatacccaacatacagagggtattatgtctcatacctagaactaaaaaaatgtgtgaaattgttaatctcatacctccaccttcatccagatgtgattgtgacatacaattctgcccagcaactgagtgatttgactctcctgcctgggcccagtgtacagacggggttgtgccatattgctcaacccagcatttaggtgatgtgaatctattcttttgtcctagtgcttttcacagagggcattggacatatcactgtgagtaatgtccaggtgatgtgacttttctctacttcctgggcttttcccaagaagggactgtaatatatttctgggtccagaacctaggtgatgtgactctcctctcctgcctggtttctgttgtacattgtgttattgacatgtggctggttctaataccttggtgatgtaaatctcctgtatgggccctgcccacagaggtgttatatcttttcattcatcacctaggtgatgtaattctgtttttctgcctgggccctgccggaagggaggattgtggcatatcactaggcccagcacctaggtgatatgattcacctgtttttcctgtgcctcacatattttgagtactgtaaaatattactagacctaccacctatgggattgcgtgctcctgcctgggctctgcccacagggacattgtgacatatatctgcatccatgaagtaaaagatgtgacatttcttgcctgcaccctgccctgcacaggaaagattgtgacatatccctggaaccagacacaaggtgatttggctcttctgcctctgtcttgcccccagggagcattgtgacagtgctgtgactctgttgcctgtgctgtgctttcaggagagaattgtaacatatccctggctgagcacctaggtgatgtgacactgctgcttggttccttccctcagggaagatatccttggctgaaatcccaggtgatgtgactctcctcctaactccctacctacaggttaaatggtgacatatactatagtcagcttataagtgcgatgattactctcataactcaagtcagctattagaagaaatagtgtctctcatagcttgccttagatgagtcacatccttggtctctctttttatgaaggtcataaagaattgccaccctcccacatatcatataatgcccttgagtgttacaaagagtgttatcccagggcacagcacaaaagtgagcttgtttctaatatgcacacctcgccaaccattaggattatcaccttcacacatggaaagagcccattgctgaggtcttgaatctcaaatgcaaacactgtccacagttggaattgtgactgtcatatatgagcctccagccacagttgagatggtgacacatttctaaactcagaacatagcagatgaggactactatccaaacccaaccaactggagagatgtttaccccaatacctgggcttagggccagaagtatggtcatgggtgcttacaaacatgattttagagtaaattgtgactctcatttatactggataaagccattgagtagtacagagagtgtactagccgggttgcattgagttgagatcgtgccactgcaccccagcccaggtggcagtctgagactccgtctcctcctgtgtgtatgtgtgtgtatatatatatatatatttttattttggatggagtatctctctgttgcccaggctggagtgcagtggcacgatctcagctcactgcaagctccacctcccaggtgcacgccattgttctgcctcagccactccagtagctggtactacaggtgcctgccaccacgcctggctaatttgatatatatatatatatatatcaaattttttttttttaagacagagtctcactgtcacccaggctggagtgcagtggcgtgatctcagctcactgcaacctccacctcctgggttcaagtgattctcctgcctcagcgtcctgagtagctgggattacaggcacgcaccaccatgcccagataacttttgtatttttagtagagatggagtttcaccatgttcaccaggatggtctcgatctcctgacctcatgatctgcccgcctcagtctcccaaagtgctgagattacaggcgtgagccaccacagccggcctggagatttttactgttgtatgaacacacatcaaatagcatacatcatcattttctcacataaacatagcctactcttgaagttctgactctcacacatagaggtagtcagaggtggaaaaattgactctcatatgtggattcagtttgcaggtgagttgatgacacttagagcaagattcagcacacctgtgagtctgtgacttcactaattagacaaagtccacaggaggagtataggctgtcaggtacaaatttagttcatcgttgaaattgtaactcctgttcttagacacaatatataggaagggttaacttcctattcctaaaaccagaacatgtgtgggattgttaatttcatccctgcaccttcctgcaggtttaattgtaacattttcagcacctgagtgatctgactcttgcctaagaccagcccacagatggaatagtgacatattgctgaaccctgaactgaaaggatgtgactctatttttctgtgttggtgctgctcacaggggacattgtgacatatcgctgggccttgcacttaggtgatgtgagtctcctcctttgccttggcactgcccacagaatgcattgtcacgtatctctgggccccacacccaggttatgtgactctcctgactgtcccctgaccacataagcaattatgacatattgctgggtccgactctctggtataactctactgccaacaaggagcattgtgacatatatttccactcatcatcaaagtgatgtgactctcttctcctgcctattccctgctcacagtgggagttgtgacatatcacttggctccgtaccaaacaaatgtgattcttcttccatcatgagttctgctggcaagggagattgagacatattatggagctctacaccaatgtgacattactgttttgcctgggcctggacctcagaagccattgtgacatattactgggctcaacaaggtaacatgagtctcctgtatggaccctgacaacagagcattgtgacatctttaagagcatcaactatttgatgtgactctccttttacacaaggcttccctcatatgagagattgtgacataccttctggcccagaaatcagatgacatgtttcttctgcctgagctttgcttacagggagcattgtgacatatcactggtctcagcacccatgtgatatgactctactgtctgtgccctgatttcaggaggaaattgaacttatccctgactgagcacccaggttttaactcttctgcctggtgtctgctctcagagaagattgtgacatatccctggcctgttacccagatgatgtaactctcctgctcactccctatccacaggggagattgtgacatatacctttgttcagatcataggtgtgatgtttactctcatatcaaaaatcagccaataagagacaaactatctttcatatgtgggcttgggaaaatgagtaagattctggctctcccctttgtaggaaggtcagagagaattacactctcacatattgtatgaagccccgggtggtacagagagtgtcctaacaggttgcagaaaacatgagattgtttttgtgtatgcacactttgccagttgttaagattatcaccttcatccatggacagagcctactggtgtggtcttaaatcttacaggtggatgcagtgcagagttgaaattgtgactgttgtaagtgaacatcaggcaacagctgaggtggtgacttattaataagcctagcttataggtaggtggcaactctcatatctggacccagccattacagaggtgttaactctcatatctgggcatagagccacaggtacgatcatgggtccatagcagcagcaaagtctcccagccacaaaagattgcgactctcacgtgtaccttataaattcctcaggtggtacagagagtgttctaactaggctcagtgtagagtttaggttttcacactcatgcacacccagccaacagtaaagattttcatcttttcacatgaacacagtccactggaggttctgaatctcatatgcagagacagtcacaagttggaaaatttactctcataagtgaattcagtccaaaggtaagttggtgactttcagaccaagattgaacacacctattagtctgtgattccactaaggtgacacagccagtaagagggattgagtctgtcattcagtgattcaattcattctaaaaattgtgacttgtgtgcttagatccaacatacaggaggtgttgactttcataccaagaactggggtatatacaggattgttaatgtcatccctggtctttcctgcaggtgtgattttggcacacacttctgcccagcaccttagtaatgtaattcttcagaattggcccagcctacaaataggattgtgccacactgctggacccagcgcctaagtgatgtaactctgttctgccttggtgctacttgaaaaagacattgtaatatatctcagagccttacacccaggtaatgtgagtctcctctcatgccttgctgctgcacacagaagcaggatatgcacaggattgttaatctcatcttggaccttcctgcacgtgtgactgtgacagatgcttctgtgtagaacctgagtgattttactctcctgtctggatttaacccacagatgaatcgtgacatatcgctggaccagaaactaggtgatgtgaccccattgtcttgcctctgtgctttccacatggggcatttggacatatcactgtgccttgcacccaggggatgggagttttctctcctgctttggtgccatccacagtgaacattgtgaaatattgctgccctcccccctagtttatgttactctcctgcctctgctttgctcacatgggtcattgtgacagtgtgacatactgctgggtctaaaactcaggtagtgtaactctcttgtttgggttctgcctgcaggagccattgtgacatatctctgtgctcatcacccaggtgatgtgactcccttttactgcctggtttcttctcacaaaacatcttgtgacatattgctaggccccatacctagctggtatgactcttttaggctccacctgctgcagagattgtaacaaactgctgggcccagcagcataatgatattactcttttgccttgggcctgccctcagaaagcactgtaacattcatgggcccaatgccgaggtgatgtgtgtcttcagcctggaccctgcccacagggggcattgtaacatatcacttggctcattagatgtttgatgttatcccctcccctctcctaccctgtgtttgcctataagagacattgtcacaagtttctgggcccagcacctaggtgatatcttcctgggacctgccatatggggattgtgatatatcgcatggcccagtacttacttgatgtgactctcctctcatgcctgggccctgcttacaggtgtgattgtgacacatagcttggcctagcccctaggttatgttactttcctcttatccttcagttattttcacaaggggcattgtgacatattgctggactgggaacccaggtgatgtgactctcctctactgcctgaaatacaaccaaaaagaaagtttgatatattgcttggccaggatcctaggtgacgttattcttttctcctgcctaaaccctgcatacattatgtattttgacacatcgttgaggccaacacctaggtgatgtaactctcctgcatgggctttgcctacaggggtatgatgatgtatcttttcattcatcacccaggtggtatgactctccacttatgcctgggccttgatgaaacagaaattgcgacatatccctggacttggcacttaggtgatgtaactcacctttattgccagggcatggaatattatgagtattgtgacaaatctcttggcctgacacctaggggatgagagactcctgcctgggccctgcccacaggatgctttgtggcctgtcttctggttttattacctagaaagatgtagatgtgactttcctcttctgcctgcattcttcccacagagaagattgtgacatcactggacccagcaattagaaaatgtttctctcctgcctgagccttgcccacaagaacattgtgacatatccttgggctcagcacccaggtgatggaactctaccacctgtgccctgtctacttaggctattgtgaagtatagctggtttcaatacccaggtgatgtaactctcctgccaggccactgccttccagtgatattgtgacatgtctttgtgccaatcacccaggtgatgtgaatcttttcacctgcctggtccttgttcactaggggataataatacatattgctggtttcagcaccaagctgatgtgacttgtctcttcttcgtagattctatcccccaaaaaactgacatatcactaggcccatcagcaaagttattttgcctggtcctgcccttaaaagacattgtgacatattgcagtgaccagaaccaatgtaatttgtctcttgcctaaaccctgcctactgggggaattgtgatagatctcttggccaatcaactgtttgatgtgactttcctttgtgggttttttgttttgtttttgatggagtttcactcttgtttcccaggctggaatgcaatggcgcaatctcggctaaccgcaacctctgcctcccaggttcaagcgattctactgcctcagcctcccaagtagctgggattacaggcctgcaccaccacgcccagctaattttttgtatttttagtagagacagggtttcttcatgttggtcagactggtctcgaattcctgacctcaggttatctgcccacttcggccccccagagtactgggattacaggtgtgagccactgtgcctggtgactctgtttttttaccagggctttgccaatagtagagatcgtgacctatctctgggcctaacacctagatgttatgactttcctctcctgcctggtccatgcccacagaaaagagagtgacttaccgctaggctcaacacacaagtgatgcgattcttctgcatgatcccagcccacaccgcttactgtgacatctctagacccatcacctggatgatgtgactcttcttcttgggaactgtccataatgaggattgtgacacatcacttggcctagcacttatgtgataagactcttcatttgcctgggccgatcaatttgggcgactgtgtcatatagctttactcagcccctaggttactctcctgtttttcctgagtcctacccacagaggtcattgcaacatatttctgagcccctcatttaggtaatttgactgactctcctgcctgggccttctgctcagtgatttttgtgacactttttttttttttttttttttttgagacggagtctcgctctgtcgcccaggctggagtgcagtggcgcaatctctgctcactgcaagctccgcctcctgggctcatgccattctcctgcctcagcctcccaagtagctgggactacaggcgcccgccaccacacccggctaattttttgtatttttagtagaggcggggtttcactgtgttagccaggatggtctcgatctcctgacctcatgatccacccgcctcagcctcccaaagtgctgggattacaggcgtgagccactgcgcccggccatgacacattttttgactgagctcctaggtaataagactcttctccattgcttggactctgtcagagaaggtattgtgatgtatcactgggcctaacacctaggtgaagatactgtcttctcctgcctggacactccataaattgtatattttgatatgttgctggggttaacacatgggtgattcagctctctcacatggatcataagcatggggttattaggacatttatttttgctaatcacctaagtgatatgactcctccctgaaccctgtcagaaggaaagattgtgacttattactgaaaccagaacttaggtgatgcgactcttctgtctagcaaccacgtattttgggtattgggacatttcacatgtccaaacacctagaagaatgggagactttggcctcgtcctgtccacagggtttcttgtgacacatatctgtatccattacataaaagatgtgatgccttttctatctgcaccctgcccacaggaaagattgtgacatacttcaggccccagccaccaagtgatgtgtctcttctgaatgtgcataactttcaggagaaaattgtaacacgtcactggttgagaacccagatgatgtgactctcctgccttgtcacagtcctcagggaaaagaaattacatatcagtggcccagcatccaggtgacgtcgctctcctgcgtgatttctgccaagaagttcgttggtaacctacatctcagcccagctcacaggtctgatgataactaatacctcttaccggtcaatagaagagatactgtctctcacagctaggcttacaaaaaggagtaaaatcccaggtctcctctctgtatgaaggttatagagaattaccactctctcgtatattgtataaagcactcggatggtacagagcatgtcatcataggacccagcagacagatcatgtttcatgtaaacacaccctgccaatttttagaattgtcatcctcacacatggaaaagcccaccgatgaggccataattctcatgcacagatgcaggccacagttaaaactgtgactatcggccgggcgcggtggctcacacctgtaatcccagcactttgggaggctgaggtgggcggatcacaaggtcaggagatcgagaccatcctggctaacgtggtgaaaccccatctgtactaaaaatacaaaaaattagccaggcgaggtggtgggcgcctgtagtcccagccacttgggaggctgaggcaggagaatggcatgaacctgggggatggagtctgcagtgagctgagatcgtgccactgcactccagcctgggcaacagtgagactccgtctcaaacaaaacaaaacaaaacaaaaaacaaaactgactatcatttgtgaacatgtggccacatttgagatggtaactctataagatcatgggtccagagcagcacaacgttctcagagcaggttgcaactctcatgcacaccatatacagtcctcaagagagtgcccttacagggccaagcacacaggtgagattgtgaaacttatattcacacccagtcaatagcaaagattgtcatccacttaaatacagcctacttttgaggttctgaacctcacttttggagatagttgaattggaaaattgactctcatttgtggattttgtccacagttgggttagtgacttttttctttgagacagtctcgctctgtcacccaggctggagtgcagtggcatgatctcggctcactgcaacctccacctaccaggttcaagcgattctttcacctcagccttcagagtagctgggactaccggtgcatgccacaatgcctggctaatttttgcatttttactagagacagggtttcaccatgttggccagactggtctcgaactcctgacctcatgatctgcccacctcggcctcccaaagtgttgggattacaggtgtgaccgccatgcgtggcctcgggttagtgactctgtaaccaaaattcaacacacctttgtgactgtaacctcactaaggagaataatttatttatttattttgagatggagtttcgctcttcttacccagactagagtgcagtggtgtgatcttggctcactgcaacttctgcctcctgggttcaagtgattctcctgcctcagccttccgagtagctgggattacagatgcccaccaccacacaggctaattttttgtatttttagtagagatggggtttcaccatgttggtcaggctggtctcgaactcctgacctcaagtgatctgcccacctcggcctcccaaggtggtgggattacaggtgtaagccaccatgcccagcctaaggcacataatttgcaaaggaaattgaggctctcatgcacaaatccagtccaccattgagactgtaacccctgtacttagacccaacatacaggaggtgttgattctcatcccttgactcaggacatgtgtgtaattgttaatgtcatcacaagacctttctacaaatgtcttgtgacatacaccttggcccagcatctgagttatttgtctctttttcctgggcccagttcacagggctgtatcactggacccagacccttggtaatgtgattctattctgccttgatacagcccacaagggtcattgtgacatatcacagggtgttgcacccaggtggtttgagtctcctcttctgccttggtgctacccacaggtgtattgtgacatattgctgggtctgtgttatgagaatcttttgcttttgccctaaacatataggccattgtaacattgctgagtccaacacccaggtgatgtaacgcttcatcctggacctgtctacagaggggattgtactgtatgtcttcaccaatcaccctggaaatgtgatttacttttcctgcctgttccctaatcacagggggtattgggacatactattgggtccagcacctagctgacgtgacatttttctttttttaaggttctgcttagaaaagagattatgacatatgactgtccctaacactaaggtgatgtaacttcttttgttttggctctgcccttagaaggcattgagacatactgctgggcctagcactaagatgatgtgagtcctctgcctgaatcctgactacagggagcattgtgacatatttcttcacccattacaatctctcctatagaccaagctcaggtaaatgccctttatacctacgtgatgtgacattcctcttctgccggggccatgcccacagaatagagagtgacttattgctggggcaagcaaaacagtgatgtaattattttgcctggtccctgcacacaggagtcactgtgatatatgtttgggcctcccacctagataatgtgactcttttcttctggggtttgtccacagtgggaattgtgatatgccacgtgacatagctcctgtgtgatgtgactcctcttcattcttgacttcttccaactgggttgattggaatataaagctgagcccagcacctaggctatgtctctcctcttgtctatgagccctacccacaagagacattgtgacatgtctctaggcttctcacctaggtaatgtgacttgtttgcctaggccatcccctcaggggtattgtgaaatactgctggaccaagaacctaggtgatgtgactctctgctactgcttggggtgtgcttaaggggaaattgtgatgtgcatttaggtgcgtccatcacctacatggtgttactctcctctcctgcctgagatctgcatgcatcatgtatttcttttaattaattaattaattgttttgagatggagttttgctcttgttgcctaggttggagtgcaatggcaccatgtcagctcaccacaacctccacctctcaggttcaagcaattctcttggctcagccttctgagtagctggaattacaggcatgcaccaccactcccacctaattttgtatttttgatagagacggggcttctccatgttggtcaggctgttctcaaactcctgacctcaggtgatttgactgtcttagcctcccacagtgctgagcttataggcaggtgccaccacacctggctggaatcatttatttcaacatatctctgggtccaacaacatggtgatgcaactttcctgcatgggccctcccacagaaatattctaatacatcttttcattcattatcttggtgatgtgacttttctattctgcttgagcactgccaaaaaaaaaaaaaaaaagattgtgacagatttctggaccaagcacctaggtgatatgactttactcacttgcctgaaacctgcatattttggttattgtgacatatcactgaagcaaacacctaggggttggaaagtttctgcctgagcccttcccacagagagccttgggatgtatttttttaatccatcacctgggagatgaaaccctatacttctgcctgcattctgcccatagagaagattgtgacatattgctgggtcaagcaaccagctgttctgtctgtccttctggactttgcccacagtgagtcttgtgacatatatctgagcccagcatgcaggtgatcttactctttttcctgtgtcctgctttcaggagaggattgtaacatctctggttgagaaccctgtgatgtgactcttctgcctggtgcatgctctcggggaagattgtgacataaccctggcccagcacacagttgatgtgactcttgtgtttgttctctacccacaggtggaattgtgacatataacttgacaaagcacacagatgtaatgatgactctcatacctcaaagaagccagtaggagagataatgttgctcacagctacgcttaggaaaacaaagaatatcctggctcttctttctgtacaaatgtcatagagaattaccactctctcacatctgtaaagccctagtgtgttatagagaatgtcataacagggtccaccatgcagatgagattgcatttgtcctatgcacagcccaccaacctttagaattgtcaccctcacacatgggcagagcccactgggtgaggtcctgaatctcacatgaatgcactccacagttggaactttgactgtcatatgtgaacatctggccgcagttgagatggtgactcatttctaaacctagctcataggaaggtgaggactctattatctggactcagccaattagagagatgttgactctgggcttagaaccacagaaaaggttctggatttccttcttgtatgaaggtcacagaggatcaccactgttgcctattgtatgaagccctcaggtgacacagataatgtcgtaggagtacacagcacacaggtggatactgtctcttgcatgcacactcagacaacagtaaagactgtcattctcccacacaaacatatcccactgttgaggttctgaatctcaaatatggagtctgttgatagttgcagaattgagtctcatatatgggcctggtcaacaggtggactggtgactctgagaccaaatttcagcacacatatgaggctgtgactgcactgacggtctgcagaagaaattttggctctcttgcaaaaattctgtcagctattgagattgttactcatgtacttagacccaatatacaggaggtattgactcccatatctagaacgtggacacgtatggaatttctaatctcattcctggactttctttcagatgtgattgaatgtgtctgctaagcgttttagtgatttgacttttctgccttagcccagcccacagatgagattgtgacatatctcttgactctgcacctcaaaagaagtgactctttttccagccttggtgttgccctcaggtggcattgtgacatatggctgggctttccacttaggtgatgggaatctttttttcttgccttggtgctgtgcacaagttgcattgtgacatattgctaagatctgcactcaggttatgtgaatttgctttttttccctaagccctgaatattttgcaagttaggacatattactagccccaacacctataaaaagggaggcttctgcttgggccctttctacagggccttgtgacatatctctgcatcagtcacctaggagatgtgactctccatttttgcctacactctgcccacagaaaaattatcactaggcccaggtaccagacaatgtgtctttcttgcatggccttttaccatagaaagcattgttacctattgctgggctcagcacctaggtgatgtcattgctgcctgtcttgctttcaggagaaggttgtaacatattcctggctgagtattaaagtgatgtgacactcctgtctggtccctgccctcaggaaagattgtgatgtattcttggccaaaaacccaggtgatgttactctcctcctttctgcctgttcacaggtaggattgtaaaatatattttggtctagctcacaggtgcaatggtgactctcatacctcaaaccatctaataggagaggtgctgtcttttatagctaggcctagggtaatgattaagatcctcggtctccttttttgtacaaagtcataggaaattaccactttcttgtatactatacacatctcttgtggtacagtgagtgtcattccagggttcagcacacaggtgagattgtggttctcatgtgcacaccccaccaattgttagaattgtcaccataatacaatccacagttaaaattgtgactgtcatatgtgaacatccagccagagttggaatgatgatttatttctaaatccagtactttagcgggtgaaaattctatctggacccatgaaaaatttacctgggcttagggccagagtaaacacagtttacaggaggaatgaaggctctcatgcgccaatccagttcattggtgaaattgtcagtactgtacttagacccaacatagaaaatgtggtgattctcttacctagaactgggacctgtgcgggattgttaatttattactggaccttcctgcgggagtgattatcacatatgcctatgttcagcacctgagtgatatgattttgctgcctggtcccagtctgaagataagattgtgatttatcactggatccagcacctcggtgatttgactcttctttttttggggacccaacaaattttaagtattgtcaattttgggtgaatcctgcacccatgttatgtgactctcccaaatgtgccttacatgttgtgccatattggggctcaatatatcacattagacattgttacatattgctgggttaaacacccaggtgatgtaactttttttttctgggactgcgtgcaggggaccttgtgacataactcaatgtccatcaccatactgatgttactctcttctcctgcctggtctctgctcacagagaaattgtgacagattactggcctagcatctaggtgatgtgactctcctctttttttcaggctccgcatatttgggtattgtgacatattgctgaactcaacacctaagggatgagagtctcctacctgtgcccttcctataggggacattgtgacatgtctctgcattcctcacctaggagatgtgactctcatcttctgcttgcaccctgcctacatggaaagctgtggcatattgctgtggtcagcaaccagatgatgtgtttctcctgcctgggtcttaataaagacaggaaagatggttgacatattactgggcccagcatccaggtgatgtgggtctcatcttctgcctggtccctgcttacagagaaattgtagcatattgctacacccagcacctagcttatgtgactcttctcttcttttaggttttgccttcagatgacattgtgacatcgctgggccctgcattgacaatttgtgactcttctgcctgtgatttgcacacttgggccattgtgacatattactgggtgtgacactcaggggatgtaatttttatgcctgggccttgcctataggcggcattttgaaatgtctttgtggctgggtgtggtgactcatgcctgtaatcccagtactttgggaggctgagggaagtggatcacaaggtcaggagtacaagaccagcctgcttaatattgtgaaaccctgtctctactaaaaaaagaaaaatacgaaaagcagccagccatggtgactggtgcctgtagtcccagctactcaagaggctgaggcaggagaattggttgaattcgggaggtggaggttgcagtgagccaaaatcgtgccactgcactccagcctgggtgatagagtgagattccatctcaaaaaacaaaaacaaaacaaaaaaaagaatgaatgaatgtctttgcaccaatcccaaaggtgatgtgactctcttgtgttacctggtctctgctcacaggaagaatcgtgacctttcacagcatatggttgatttttttcttttatttcttactttttcctgcaggaaagatggtgaaatattaatgaactaagtaccaaagcgatattacttttttttcttggacctgcctacataatacgttgtgacatattgctgcgccctgcccatagatgatatgagttttctgcccatcaactattttatgtgactctcctcttttatcttcgttttgtccgtaggttagattgcaatatatctttgggcctgggtcatgctaacagaagcgacagtgatttattactgggcacagcccacagggttgtgatattcctgcttgactcctgcccaagtggtcattttgacatatctcttggccagtcgcctaaatgataggtctctccttatctttctgtacctgtccacagtaggaaatgtgacatatctctgggcccagcacctatgtgatgtgaccttcctgtcatgccaaggccttgcctactgtagtgattgtgccatatagctgggcccagctcctatgtatctgactctcattttcttcctgagccctatgaaaagatagcattataacatctttctgagcattttaccaaggtgatgtgacttttcttcctgggttgtcctctcagggcattgtgacatgttgctggatgcagcatttaggtgatgtgacttcctctactgcttggactctgaccaaaaagggattgtgatgtatcacttggcccagcacctatgtgatgggactcttttctcttgtctgggccctacaaacattttgcattgtgacatatagctgggtctgccacccagatgatgtgtcttctacgtaagccctgaccacaagagtattatgaaataccttttcattcatcacctaggtagtgatgtgactcttcgtcagcctctaccctgccataagggaattgtgatgtatcactggacccagcacctagatgatgtaactcgtattttgactggaccttgcatattttgcatattgttacatattattgggtctgacattacgggatgggaagctcctccctgggccctgcccacaggtggccttgtgacatgttttggatccatatcctatgaaatatgactgtcctcgcctacatgcttcatgcacaaagaaaagattgtaacatatcactgggatcagccaccaggtgtgtgtctcacctctcagggtgttgctcactgagagctttgtaacatatcactgggcccagcacccagaagatgtgacttgtggcctgtgctcatcttttcttttttttctttctttctttttttttttttgacagccaggttggagtgcagtgatgtgatcttggcttactgcaacctccgcctcttgggttctagtggttctcctgccttagcctcccaagtagctgggattacaggcatgcatcaccacactgggcttatttttgtatttttagtagaggtggggcttcaccatgctggccagtgtggtctcgaactcctgacctcagttgatccacttgccttggtctcccaaagggctgagataactggcatgagccactgcatccagtctgcctgccaccagcagacatcttacagaaatagattttaatgcatccctgaccaggtacctaggtgatgtgatatgactctcctgtctggttctttccttcaaaaaagattgtaacatctttagacaagccccaggtgatgtgactcttctgcttactctctactcactgatgtaattgtgacatatatcttgccccagcttgtagttgctatgatgattctcacaccttgaaccaggcaataaaagagttactctctctcctagctaggcttaggaaaacaagcacaatccttagtctcctctttttgccaaggtcctagagaattaccactctctcacatattgtataaagctctcgggtggcacagacagtgtcatcaaggaacaaaatcacagatgatattgtgttacttttttttttttttggagacagagtctcgctctgtcacccaggctggactgcagtggcacactctcggctaactgcagtctcagtctcctgagtagctgggactacaggcatgtaccaggaagccaaactattttttgtatttttagtacagatagggtttcactatgttgtccaggctggtctagaactcctgacctcaggtgatctgctggcctcaggcttggaaagtgctggtattacaggcatgagccactgcgcctgccccccagcttcttttttgtatgtatatatttatttattttttgagatgaagtattgctctgttgcccaggctggagtgcagtggcatgatctgggcccactgcaacctctacctcccgggttgaagcaattctctgtctcagtctcctgagtagctgggattacaggcgcccgccactgtgcccggctactttttgtatttttagtacagacggtgtttcaccacctttgtcaggctggcttggcacttctgacctcgtgatccacccgcctaggcttcccaaagtggtgggattacagacgtgagccgctggacccggcctgattttctcttgaacaataattttatgtattgttaatatacataaaatattttggttcacattttgaatacattgaaaaagaaagaaaaaagagaattttcccatgttctggggtgggcctggctcagttcagggaggaagtcctccctgaaaaggctgcaacttaggctgtctctcttgtgttaggctgatcacatcttctgtcactcagggccttgagaaggtggggtcttgaacgatatccagtcagcgacattggactggaaactgtccaatcacacacacaactggagcagacagagcgacttccaggttgtagttggggggactgtgtctctagctgcagatggagctccaggtgtcgtcttcactgctctgtgtcctctgacttagagtcccagcctgtgtggccctgtgacctgcaggtactggagatccacagcaaagacgccaggacccgctgaaagcctagaaatggtgagattgccagttccgacatctggagaggggcaagggctggttggaactggtgggaagcagctgtggtgggactcaggcctccccgcagtcagctccacaatctgcaccctgagttctccttgcccaggttggcatccgtcccctgcagccataagatggcagctaggctgacagccgggcccccgggcgtcctgtcttcccagtgcattggctgtgccatgtcctggagccctctctgggcagctctgcaccagtagcgccacatctctcccagattgtgcagggaccacgggagaatcatcagggcagaatcctgactcagggttattaaaaatgtatgggtgtcacaatgaaagtattaaataatttaatcaaagggtgattcaaaaattgtagagcacccagctatggttttaatttatggtctgtggaaggggcttctcgaactcctgacctcaggtgatccacccatctcggccccgtaagtgctgggattacaggcatgagtcactgcgccagccctagtttcttaatttttacacatcagggtggaaatatcttggttatgtaatcagagtttaattggcagtttatagttggttaagcctgaagcttgtttccggcaatgtagtaatttaccaaaaaatgctcttgagtttagattattttttagaagtacaaatccggggactagagccacctcagtctaattgcctgccacttaattattttcacactccaatggtgactgatttttccctgaatttttcacacgtgtgccaagcaggacctcaagtccacccctcatcccatattcctccagcctaactctggcttacagcaaaatactaaatttccagtttcgtctgatattcccaaatgccaatttcccctccctaattcactttatcaactatttgtccttgagtgtacatttttatattattttaatcttttcttttttttttttcttattgagatgaagggagacttgctctatctctgagactggagtgcagtggcatgatcttggctcactgcaacctccaccttctgggttcaagcaattatcctgcctcagtctcctgagtagctgagattataggtgcctgccaccacacctggctaatttttgggtttcaccatgtttgtcaggctggtctcgagctcctggcctcaggtgatccacccaccttggccttccaaaatgctgggattacaggcatgagccactgcgccctgccgactgattgtttactacatgatttttcatacaaataataaaataattgtctgaaaggaataaatgattttgcttttcttactgagatataaaatgtaagcaccttaaaagtttcttcccttatgtgaacactgtgtttgagtaatattgctgaatttttctaacacttagtttcacaaaccaagttaataactctgacatggaaattaaagcttaagcccagtgactccaagctgaggctaatattgagcctgcaaaaggaggttattaaggcccagttccttttggggaacctcccctgcaaatttcccaacctgattatccaagacatggaagaagcctctatactgagagaaactacagagccttggaatgctggggatccacaggcagatgcagataaggttaatataaaggagattgggagggtcttactgaagatggagttgttattgttttgaggcagtttctagacttttaaaaataaaacagatgtatataaaaaattgaatttcgaaggagtattgcaacaggagaaagtagcaactaagtttttttgtttttgtttttgtttttttttttgtgacagagtctagctctgtcacccaggcagcctcctgagtagctggaattacaggcgcgcaccaccaagcccggctaatttttgtatttttagtagagacgggctttcaccatgttgatcaggctagtctcagactcctgacctcgtgatctgcccgcctcggcctcccaaagtgctggaattacaggtgtgagccaccgcgccaggccaagagttttaaagattgcaaagattaggcagaaaagggctttgccttccagagaaaagcaaacaagattagaaaggaggttggaggggaatgtttaaattgagtgtaataaaatcagattttagattagagaatgttttacccggacgtcagtatgttcttaggagggacataaaatggggttgtatggtggctcagactgagggtaagctcaaagttcatatcctgtgggaagagaataaacctaagcttgattaagaagtattttatgttgactactgaagacaaagtcagcttgtttttcagtgagtaaaaagaaaaagtacaaagcgtttttctggctgtgtgataggtaagaaaacagcaccatttcagtcataatggaaagaggtggctttcttttttttttttttttttttcccttaaagtcttcctggagaacacaaaggatgagaattttattgatcacagctgtttctcacctttgtgcttcatcttttcccaccttttttcttggttcaatacatttatttcacttttttggggttatatctttttttttttttgagactgagttttgctcttgttttatttgtattttattgtattgtatttgtattttattttctttgtattttatattatgttatgtattttgtttggagacagggtctcagtctgttgcctaggctgaagtgcagtggcatgatcttggctcactgcagcctcaaccttccaggctcaagcaatcttctttttttttttcttttgagacagtctcacttttgttgcccagactggagtgcaatggcgtgattttggttcagtgcaacttcctcctccggagctcaggtgattcttctgtctcagcttcctgaatagctgctattacaggtgcccaccaccatcatgcccagctaatttttgtatttttagtagggacaggatttcaccatgttggccaggatggtcttgaattcctgacgtggtgatctgcctgcctcggcctcccaaagtgctggggttacaggtgtgagccatcccgccaggccaagcaatcctcttgtacctcagacttccaagtagctgggactacaggcatgcaccactaaacctagctaatttttcttttcgtatttttttagagatgggatttttccatattgctcagggtggtcttaaactcctgagctcaggcaatccacctgccttggcctctcaaagtgctgggattacaggcatgagccattgtgcctgatcataccgtattttctttattcagtctaccattgataggcattcaagttgattccatgtctttgttattgtgactagtgctgcagtgaacacgcttgtgcatgcatctttatgatagaataatttgtatttctttgggtatatacccaattatgaggttgcttggtgaaatggtaattctgtttttagttctgtgaggaattaccacactgctttttacaatggttgaattaatgtacactctttaacagcagtgtataagtattcccttttctctgcaaccctgacagcatctattttttaactttttaatagcccttctcactgatgtgagatggcatcctgtggtttttctttgcatttctctaatgattattgatgagcattttattacatgcttgttagccacgtttgtcttcttttgaaaagcatctttttcatgttttttgtctacttgttagtgaggtcttttttttcttgtaaacttgtttaagtttgttatagattctggatattacacctttgtcagaagcatagtttgcaaatatttcctattattctgtggttgtctgtttactgtgttgatagtttcctttgctgtgaagaagctctttagtttaattaggtccaatttgtcaatttttgcttttgttgcaatggcttttggtatcttcatcatgaaatctctgccagtttctatgtctagaatggtatttcctaaattatcttccagggtcttttataattttcaaataaatatttcagcctttaattaatgttgagttgatttttgtatatggtgtaataaagtttcagtcttctacatactgctagctagttattccaccaccatttattaaatagggaattctttccacatttctattgtcatctttgttgaagatcagatggtagtaggtatgtggcattatttctgggctccctattctgttgcattggtctatgagtttgtttctgtaccagttccatgttgctttgtttactgtagctctgtagtataatttgaagttaggtaatctaatgccttcagctttgttgtttttgcttatgattaccttggctattcggactcttttggttttatatgaattttacaatagttttttttttttttttagttaaagatattttggtcatctgattagaatagcattaaatctgtaaatattggggttagtatgaccatttttaggatattgatattttctacttatgagtgtaaagttgttttccatttgtttgtgccatttcttacttctttaagcgttgttttgtaattcttatcatagagatctttcaccttcctgattagctgtattcctagatattttgttctttttgcagcaattgttaatggtattgtgtttataatttgtatttggcatggatgttgctgatttacagggatgatactaatttttgtacatttattttgtatccttaatgatactgaagttgtctgtaagtttaaagagtttttccaccaagactatacagttttccagacatagagttatgttgtctgcaaaaagggatagcttgacttcctctctgtttaagttcctttttttgttgtcttttgcctgattgctctgaccaggacttcctattttatgttgaatagaagtgttgagagaaggcatctttgccttgtgccaatttttgaggatgaatgcttcaagcttgtttttttcctttatttttgagatagagtctccctttgtctcccaggctggattgcagtggcacaatcttggctcactgcagactctgccttctggtttatgcaattctctttccgcagcctgtaaagtaattgggattacaggcacccctggctaatttttgcatttttagtagagatgggattttgccatgtcagccaggttgatctcaaactcctgacctcgggtgatccgcctgccttggcctcccaaagtgctggaattacaggcatgagccactgcacccatctgcttccaggttttgtccattcagtatgttggctgagagtttgtcataaataacttattattgtaaagtatgtacttttaatgcctaggtttttgagtttttaacataaaagatgttatattttatcaaaagccttttcagcatctattgaggtaatcttgtggtttctgtctttagttctgtttatgtgatgaatcacatttattgatttgatttgtgtatgttgaaccaaccttgcattcccaaaataaattctacttgatcatcgtgggttagcttttttgatatgctgctaaatttggtttgtcagtattttgttgaggatttttgcatgaatgttgaaagatattggcctgatttttttttttttaatctcagccaggtttcagtatcagaataatgctgttcttatataataagttggagaaaagttactttttcttaatttcttaaaatagtttcagtagaaataataccagcacttttttgtacacagctgtgaatctgtctggtccttggctttatttggttggttggctctttattactaattcaatttttgagcttcttactcatctatttagggctttgatttcttttttgttcattcttggaaggatgtatttgttcaataatattttcattttttttagattttcttgtttgtgtgcacagaggtattaatagtagacttaaatatatttttgtggggtcaatagtaatgtctcctgttatttctaattgtgtttatttggatcatcccttcttccttcattaatctagctagtggtttatttatcttattttttttttcatagacttaattcctggatttcttgatactgattttggttatttcttgtctgctgctagcttagggattgatttgctcttgcttctttcattcttttatttatgatgtcaggttgtcaaatgaagatctttcaaacttttttagcattaaatgctataaatttcccttttaacactactttagcagtattgcagatattctgatgtgttggttttttatttttatttatatttatttatttatttattttgagatggattttcgctcttgctgcccaggccaagtgcaatggcacgatctcaactcactgcaaccactgccttccaggttcaagcgactctctggcctcagcctcccaagtagctaggattataggcatgtgccaccatgatgggctaatttttgtatttttagtagagatggggtttcaccatcttggccaggctggtctcaaactcctgacctcatgatctgcctgcctcggcctcccaaagtgctgggattacaggcatgagccaccatgcccagccctggcctgtttttttgttcttatttgtttaaaagaacttcttggtttttgccttaatttcattatttatcaagaagttattcaagtgccggttgtttaatttttatgtaattgtatggtttcaagttgttttctttttgttgaattatatttttgtcaagctgaagagttctgtagatgtctattaggactatttggtcaagtgttgagtttaggttctaatgttttgttaattttcttcttcagttatctgtctattagtgcctgtgggatgttgtagtctcccactattgttgtgtcagaatctaaatctcttcataggtctctaagaacttgctttattcatatgaacccatgaattttatatagcacctttctcttttctgctttttcttccgtaaacattctttcctgtgtgcacaatgtgcaaaatgtagatgtccatgagttcaagaacatgtttagagacctagctgttgtaaaagaaaatataaattagaaataagaggcttaattagtccacataaaaataagagaaaatatcttactaaaatctcttttcttaaaacacttagattatgtgtagatttttatctcctttttttgaaatatatgtaaatcattaacagctaaataaatctttgttatgtatttattttttttttactcacgattgtctttatctgggacctgagattaattgctttgtttctgctttggcaaaaggttattcttattatttttagtcttttaaagttgacacagatttgttcacagtaaaactcattccaagagcacacaaaagtttagcataaaaataggattaaatttagcaaaacagaattataaggactaaaagatattggtaatttgattgacagaaacctgtttatccaacatgattatttacaggctgaagtacttacactacaaaagcaaaaatagtacagtttataaactgaacagtggagtatattgtcataccttggtttctatttattacttcagtacaattagcatagttatgtgtggtgttgttagacaacctgcattcatatacatttaatagtattttctacaatagtatgaatataaagccacaatgtctactttgaatgaattccttaattcttttattattgtgattcatacttttgaaatgtaaagtttttcaattgaaatatagttacagaaattttttaaaaaatcctacatacattatgactagtatgttaaaattattcctacttacatatttatatctaatatccaaagaaattttactaccacattgttacagtagatattagtctgctatgcttattaatttaaccaatagagataattataagtaagcataatttcaatgtctttcatttcacaaattggaatgctgctattgtaggacaaataaagacagatgatgtggccacccaaaaactgtagtagctctccagttagctaccttgcaggttcatgtatattccactatattaacacagtcagattttaattttttatcaaagtgctggtggaagttgtcagatatatttgaatatagattctgcattcaaaggctagaaaattagagagcagcagagatagaaaaaatattttatgattctgctgataatatacctcttttcttcataatactcatgtttctcatgctgagagtagctatgcactttgggtatttagagagaaattgtttttgcaggaatattttctggctgacttgatcaatcttatatctaatttcagttttttcttaagatgcttttaacttcttttttttctctcaatataatctttctcagagtgagagctgtttttctgtagaatgctttgtgtatctgttttagaagccctattagtatcccataatgtctgtgaaagacgtggctgtcacagtgagaactcttggagctatctctatctggatgcatgctggaaatctagcagtatattttccatgtcaccattataaatagaaactgtggcttaaataatgctctcatttccgttattgtgaaggtgcagttctacccagggaggctctcttcctgcagctcaggcttcactctttgatgtgacactaaagtgctgctatggcaattggcgttcacctatgatgtgagctgccagctgtgagccctgtgctgtggtccataccgcagtggcagatggtaggaaacaaaagaggacactggccaccagaagaggggaagccggagtactgtaaccccgtcctcagggaggagagaggtactgctttaaaatgcaagtagccaaaaagatagcaccctattcaaccacttttgtagaagagtgaaagtctgccttcagcaggcagctggcttcaagttgcagaactatcttgtcaggaagatgtgaaaaggttattttgtcattgaatataaccaattagcatatatggatgacctccccaatgtccaggtgaatttaggatgaactatgtatgacatggtgctgtgaattcttctacttgtgaactatttatggtaaccatctttatgtcttttcgatctcttaagcagactgactgtaatacatttgacattcagatttaattgtgtaatgaaagagttttctttttctttttttttttttttttttgagacagagtctcgctgtatttcccaggctggagtgcagtggtgtgatctcagctctttgcaacctctgcctgtcaggttcaagtgattctcctgcctcagcctcccaagtagctgggattacaggcacatgccactatgcccgtcttttttattttattttatttttttttattttagtagagatggggtttcaccgtgttagccaggatggtctctatctcctgatttcatgatcgacccgccttggcctcccaaagctgggattactggtgtaaaccagcatgcccaacctctttcttttctattattgtggtttctctggggctgaagagaatttttttaaaattatatttcctagaattaccggacataatataaacaaataaggtgccaaccaagctttactctagaggggactttccctctcaggcttctagccaactcacagttatgctgtaaagtgcatactgtcacctaaatatgcaggcagaattgtgtctctgcctatttggtatctatagtcctccacagtcacttctagaggggctagagcagatttctacaaactttttttttttttcttagatggaatttcactcttgttgcccaggctggagtacagtggcacaatctcagctcactgcagcctccacctcctgggtttaagtgattctcctgcctcagtgtcccgagtagctgggattacaggcatgcaccaccaagcctggctaattttgtattttcagtagagacagggtttttccatattggtcaggctggtcttgaactcctgacctcaggtgatccacccaccttagcccccaaagtgctgggattacaggtgtgaggcacctcacctggcctagatttctacaaacttaatagggcagatattaaccattttacttctttcaatgactcttgtatcttcagacctgaaactgattcagagaccatggagcccagaaacccaatcagtgtaacaagtgtgcattgagtagacatggagacatgagaatctccacttctctttttctcctcttgctaaaatgctcacaattgcaggtaacacctgctgctactccacccatccaggacctaaatctgcagctccaaattctaaatctaggtctagaaattaaaaaacaaaacaaaacaaaagtttcatttgagaaatgcaagtctttttttttttaggggagggttgggggggatggagtcttgctctgtcaccaggctggagtgcagtggcgtgatctcggctcactgcaacctcttcctcccaggtcaagctattctcctgcctcagcctcccgagtagcttggattacaggcatgtgccatcacacctggctaattttgtattacttttttcagcagacatgggcttcaccatgttggccagtatggtctcgatctcttgacttcgtgatccacttgcgtcggcctcccaaaatgttgggattacaggcgtgagccactgtggctgtctgccagtctttttacttataaaactcagacattaaaataagagcacaattatgtctttctccctactttcaactatatattgatctcttgaagctgttcactattgacaaaagtaggtataagttaaaccaataataagttatttatttaaacaaataagaatttctcacaaactagtttgtatcaccccactctctatctctcttctttttttcccttcacaaatccacttgtaattgctgctaatcagtatagattccaggcatcttgaatatttcttctcaagttacaatgcttaagcttggccccaataaactgtgtacttatattcatgttgtgtcagcttttttttaggtaaaatattatttagaattttctagagcagtctctgtgagtagatttctcctttgattgtactcgctgtaacagccaaaaatgcaaagtgatgttgattttatctagaatctgcacataaggtctggtctctgcctggaatttacaagacagggccagactttagattgagaatgtacagaaaaccaacaggaggcattttctgcattgtgagatgtccacatagacacttcagatccctcctttgagagtgtgactctttgaccttttcacattgctacctttctgtgagaggctacaggtttaaatagaatctgatggcagaatctctaagtgtaaacaagcatcttaggagtgagagatcaaggccacaaagtagccagagccctgagcacaactatagctacctggaaaatgtgatactagagtgttattgtccaaaagctagctaatcaggacaggagatccaggttctggagctccaccaggatagtttcattttctttttagaatcagcctgagtctctcctgctggcttattattggtccatcagcccagggtcactggaaatgctctcacaatcacccaggcatctgagacatttgagaatctccagaacaattgtgtcaggctgacaagagtggttaattttgcttctgtcttactgtaaaagaaatgaatcatctggtgtgtgttcctcccatcatacaagagatgtctttggttggtacccagatgagagtttctctggttccctggtacttgagtgaaaaacaaggaggaggtctggagactcaaacagataaattgattccatttcatatagtcattagaaaaatagatgaagcagtcatggtccctaccatgcaagaacttttagtcttgactatcaactggataaatgatttaattatgcatcatatggtgggtacaataaatagacatgtgcaaaaatatgggatatatttgcaccattttctttatattgttgagacttctgatgtctacacctgaacatatatttataaacaagagttattatttgcattttttagcttgctaagaacacttatttatcttctaaaaaactattttagaaaaccttaagagatttgttaaattgcttattagtatgtgatataaccttgagaggggagtggggtttaaaaagattaaaaattatacaaactctgagatttaattttttttttttttggtacacttaaaaaatgaaacagaactgaaaatactccccagtggcacaaaaaacagaattttacattagctctacaccctgtcccaaccctgatcagattcaccctttttgaagaccttatttaggtgtggccatactctggagtcttgtctcacagaactaactagaagagatcagagttttgggtgatgcatcctgttgcttttttagggttggtgctcatgattttctgaaacccaaaagcagataaatggaaaatataaaatatgatttatagggtcttaattaaaaaaattttttttaaaaccattgtttgcagagacattacatttagcaacttgttttctctccctgcagatatagttgttgattcacaaatcacaaaatagtaaatataaacacaacaaaaattcatctaaattatatgaaactctatctgtatccctctcatctgtctatatttatattctatacattttttaaaaaaaatcagtgacagccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaatcagtgacagataaacagaagaagaaataaaaatgctgggttcttattctaaatccttggaattattgaacacagtataaactcacagggttttatcagaattaaataatgggtcatcacagtgctctgtaacgtcttattgagaacacagtacctgcttaataaacattgcattagtacatgtgtacatgttgttttctaaatgcagacttactcagaaattgctgctttctgttttctctgtaaactttaaagagccaggaaataatatgatactttaagataaagaatggttgtcttcatttgtatcaaaagtatttgtgttgtgacaagactgctgaatataagggactctgtcctgtgcctcatttttctttttcttttttttctttttggagacgagtcttgctctgtcgcccaggctggagtgcggtggcgccatttcggctcactgcaagctccgcctcctgggttcacggcattctcctgcctcagcctcctgagtagctgggactacaggcaaccgccaccacacccggctaatttttgtatttttagtagagatggggtttcaccgtgttagccaggatggtctcgatctcctgacctcgtgatccacctgtctcggcctcccaaagtgctgtgattacaggcgtgagccaccgcgtccggcctgtgcctcatttttctaaacagtgctaataatgagcccagagagagcgacatcagcactgacaggggacttctttaaaacacccatttatggaccctttccaaacccacagaatcgtattacatagagtggggccaaatttacgaagtgatttataagctcattaaagcttgagtagcaatgcttaggtaagtggttataagcccagacttctaattagaatcacatggccaatttgcagaactctcttgtgcccttttcacagtttgcttaatgttctgggtgaaagcatctatttgttttaattaagtgtctcatgtgactctaatttgccagaatcaagtatgacgagttcaagatacatttatgagagttaagtgccgcctttgcactaaagaggggtccaggaacctgttctgtttgggtttgttaaggacaggacagtgtggccaatatttctattactgtagcagaaattgctagtgtctgtagcagaggagagaacctgaggaccaaaaaaataaaaagcacacacacacacacacacacacacacacacacacacacacactttttttctttttttttaagatggagtttcactcttgttgcccaggctggagtgcaatggtgcaatctcggctcactgcaacctccacctcccgcgttcaagcgattctcctcccccagcctcctgagtagctgggattacaggcatgtgccaccacgccctgctaattttctatttttagtagagatggggtttcttcatgttggtcaggctggtctcgaactccctacctcaagtgatccacccacctcagcctcccaaagtgcaggattacaggcatgagccaccttgcccagctgcagagaaacttatagttcctaaatcatttctgttataaaggacagaaatgggtagagtttttctgtcttgggctttctgcctttaggtgtggtggtaagagatgaacatgtggtgctcaaagtttttaaggcatattctcaagatgcaggtataattagtccagaaaatgtcatctgagaaataattctagaggaggaggagaaagagaaaaaatgactttttttcagctaaacatttctgacatcaagagctgtgtccgctgtgcctcctggattgccatgtgcttagtatgtgcaaatctttacttctaaacttgtgttttttctccctaatgagtttttcttaactacttttataaatgcttgtgatagtcaagggtctctgaaaaatatttcgtttctatatatcacagacttctctacatcacgacttcttatatgccgtgcagaattctcaccatgaattcgtgatctgcaatattaaaaatgttgtctttggctgttgaacatggataggtgtggattatctatctgtctgtctatctatctatctatctatctatctatctatccttctttctttctttttttttttttttgagacggaacctcactctgtcgtccccgctggagtgaagtggcatgatctcggctcactgcagcctccacatcccgggttcaagcaattctcctgcctcagcttcctgagtagctgggattacaagcatgcatcatcacactcagctaatttttgtatttttagtagagacggggttttaccatgttggtcaggctggtctcaaactcctgaccacatgatccacccgcctcagcctcccaaagtgctgggattataggcatgagccacagcatccagcaatgatactctagatttctatggggaaaacctgggattcttagtaaagatggagaacatgtaatgttgaggttccttctgtgttcttaatggcattacaccattaagaaaatgctcatttaaacagaatggcatttattacccaaaaagttctgaaaaaagtggctgggtgatgtggcttatgcctgtaatcccaaaactttgggagactgaggtggatggatcatgaagacaggagattgagaccatcctggctaccacggtgaaaccccatccctacaaaaaatacaaaaaattagccaggcatggtggcacgtgctagtagtcccagctactagggaagctgaggcaggaaaatcacttgaaccttgaaggcagaggttgcagtgagccaagatcgcaccattgcactccaacctgggtgacagagcgagactgagtctcaaaaaaaaaaaaaaaaaaaaaaaattaccaggagatacctgcttatttgggtgctaaagagagactacttaaagtcactattaaaaattgtagaacatggaaaatatctctatcttggactttccatataaccgatgttttcttatggttaaattgagactgtaatttactttagtggggggccatatctcagtagtgatgctgtgtccttctgggtgcatcagcacactatgaaaacttgttcgagtgcatttgatgttaataactcacttgcttaataaactctcttacagatttttgcactatagaggttttttttcctcttcatcattaagtatctttatgcagctgatgtccatacaccatcacatttaatctggcagctgccctgtttttgaggttttctttgtatttatctttctttggtaaatgaaagctctcatctttgtttacaggccagaaaaactgaaaaagacacaggctcttccacttactggatgtttgacaaaatgatattttggggccaaaacattggcattactggtaaacttggtagagattcagtaactcagactttatttcagatctcctgaaaaaataatctgcattaacatgatgtccagtttattgtacacattaaaatttgagtggtaccttctaagtcaacatgtctattttgtctgaaaaatgtaaagaactatgtctttttcatctgaaaaacatatataactcattctgtattatgtaaatatagtactcaaaaatgtgcatgttagtgtctatgccctcaattttatactttatcatccagacaagtatcatatatacactgatgttgtggatattatgccactctcttttctcagagttagagaatacattagaaaaggtttgtgtgttgacaattattttattggataatttcagtcactcttataagtcagaaccagttttttttactctctcattttgccttgagtcaaatggaaaattctgccaatggccactttgtacatatgtgtgtttgtgtgtcttttccagggactcttgacgtttaggtatgtggccatagaattctctctggaggagtagcagtgcctggacactgcacagcagaatttatagaggaatgttatgaaaacctggccttcctgggtgaggataactttaatacaaaattccttatataaactaaaggtttcatttctcttttgtagaatgttttctggtaatttatgctttcaaatttctgttttcaagaaaatcctggggatttgtctgtttagaaaagaatttcttcaagatatttcatcttgacctgaactttccacattcctgagcggatctgtgtccttcactttagattattggtaatttcagaagtttagttgcataaaatattgttactcacaccttaaaatctaattatcatcaccagtttttgattcagtagtaccaggcagtgaaattaagaacctacaaaattaattttttttttttttggagatggagtcttgctctgtcacccaggctagagtacagtggcatgatctcggctcactgcaacttccgcctcccaggttcaagcgattctgcctcagcctactaagtagctgggattacaggcacccgccaccatgcccagctaatttttgtatttttagtagagacagggtttcaccatcttgggcaggctggtctcaaactcccgacctcgtgatcccagcctcccaaattgctgagattacaggcgtgagccactgcgcctgaccaataaaagtattttctaaatagttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcgagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagatatctccataattttgagatactctatgttaaactattttttaagttctctttttacatcacgtctgaaatgcacgagagtgacggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatctatgttttagggttgtgtttttcattactgtgaaaaaaaaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggcccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactgtgggaggccgaggcgggtggatcacgaggtcaggagatcaagaccatcctggctaactcggtgaaaccccgtctctactaaaaatacaaaaaaattagccgggcgtggtggcaggcgcctgtagtcccagctactcgggaggctgaggcaggagaatggcgtgaacctgggaggcagagcttgcagtgaaccgagatcgtgccactgcactccagcctgggtgacagagcgagactccctctccaaaaaaaaaaaaaaaaaaaaaaaaaagggaaaagggcttggatagttgtagttttcattttcatttaatttttggacagagtgaatatctttcaggactttgctgtgtattgcagacccaggggcaggtttctgcagtcgggtctgcatatggtgttctttatatcaggatgtgatgagagtggctttcactgagtacaagagagaattttcccaggtcactttgggtttctacataggcagaaccggccatgaactgtggctcagggagctggaaatgagtcatggaactgcctcagggaccacagtaaaggccaaggtctgcaggcctctcagcatagctataaatgggtgtcttcctctaggcctctggaagagcaggacctcccccagactgtgactgggaagagtttgggatggttacagagtaagttcagaattctcactggaaccaagttaggtggaacgttttcttgtctgtagccaacaacagtagtcctgtagtttgccacctgaatgagggcctgccttctaaacagaattatcttcaatattgggctttagcagagtttcacaactcccttcctggatctcagaactctcttaaaggcacttttttttttttttttttgagacggagtcttgctctgtcacacagactggagtgcagtggcgaatgcagtggcacgatcttgactcactgcaacctccggctcccaggttcaagtgattctcctgcctcagcctcccgagtagctgggattacaggtgcccgccaccacccagctaaattttgtgtttttagtagagattgggtttcaccaggttggctaggctggtcttgaacttttgacctcaggtgatccacccacctcagactcccaaattgttgggattacaggtgtaagccaatgtgcctggccaaaggcacttatttttgagatggggtcttgttacataacccaggcaagttttagtattttgactgtaagcaattctttaatgtatcatgtagctgtcattactggtgtaaaccatgatgcgtgattctcttaaaaaggcattttcatcaggaatgactgacaaattttcttgctgtcaggggataagcaaataggatgccttttttttttttatcttgttaatgtcactctccatataaatttttactttattttctactttaaatttgtctgcaattttagattcagacatttagggcaatatactagaatttacgtgttgtgcctgaattaaattaggtaattagtatgcaggcaggcaaaaaggaattataaaattttcaaccacttttgtcagcctatatctaaataataacatagtttatttcccaaatatttgttttatatatgaggctctaaccatattctgctaaatatatgtataatttagcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaa

SEQ ID NO: 1382 - DNA, 236911 bp, Homo sapiens
tttatttgaaaaacttttattttgcataaaacagacccattccctttgtgggtcagatgttaccacctttaaaaaaatgttttttaactctcctttctgtcccactgaaaaatttattttgaaagggttaagaagagtctatcattgctggtcaaaatcggcctgaggatggccgccagggacagaggcctgaaggcatcatctgggcaggcctggaagcccacggggtgcagcatcctcaagcccaggggcgggagcgcctccggcctgccctccagggaagctgcatgtggacctccacggtattcagcctccagtttagtcagccttgagtctgggctgctcccgcacctggtgttttatgcgtgtgatatatgtgtatccatcctgcttccctgccttcaagggaagacttaactctccgagagaaaacctgcctggagctgcgcacattctcacagcttgagaacgcttgacgcaggaagtcaccagagtactcaagtcaaccgcaaactagtggttacaaaatgggagctttaaaaaaagtgctctactagaactgggtgtcctcacagtcgggagcagaaggctggggcgcaggcctgcggctctgcggcgcctctctgcaaaggctcgggtccaccttccagactgcaggctgccgtgtgtgctgtggaggatgccacagtgttaaggctgaccaggaccagaaggtgacactgggctctcctgctacgtctggccacttacagcagatccctaggccacactccttccaagccactttgcaaactgtttccctgttgtggggccagcaggagctacaagggccgaaggcggctctgccggggctggaccggttttgtggcattcgaggagaggtctgggaaaggccacgcaggcagtgaaggtcttttcccacgtccaattttatgggacgactggggtttgaagatggaatctagaaaccctcctctccccttttttaagtaaagagaaaagaaaaggagacctttgcctcacgtgagaacaggtggagaatcagcgctgtggcggccactagcggcgttatctcccggatgtgcatgggagagagatggcagcttctggacagacaaggatgacacaggttctttgctcctttgcagctgggatgaatgttcaagttgaagcacagtgtggttcccatggaaagcccaaggtcagcacagccactcagcctgctccactgcgggacgccttggaggggccaggcctctgctcccagctggccccagcccacggaggcggcaggcggctggagcgcccctggcaggcgggtctggtccggatggctcctcgctgggctatgtgctgactgctttgatggacaagcaccccaccccgattagctcagtggcttgatgagctgtacacagccaggctggtgcggaaccgtgagaaaggaacagtttggctataggagctagtgattcggggctcgccctttatgtccccatgaagatccggcacaaggcaggtgcccgtcgccttcggaaggaagggcgggagtcgctgatctgcttgagaggcaccagcctgcatcccagcatccactgcagcactcgcgtttccgtctgggtgaatcttaggctgggaggagggaattctcaccagccacatgattccagggtcccaccttgcaccctcttggcctgtgtggatgagggcccatcctgaaaccttctttaacatatgtgcggaggaaggtgatgccctggcccccaaactgagacaagggcgagttctgcagagccggaattctcactgggagggtgagagtggcagctctgctgttggcctggcccaaaacagaacggaaatgcaccctcatcacatgagtggtccagatggtctagcgccagggtgaggcaggcaccgggtggaggaggggacagaaagctgtgaggaggacccacacaggggttctgggcagctccctgatgccagccaggccagtgatacgaagagaaaggctaataaatagatgcacgtgaggagcaccgggcagccccggaccaggtcgcgtaggacgcaccagatgccgctgtggctcccgcacccgggcgcaggtgatcagttcctctagtaaagatacacaaacgaagttacttcttttcaagtattaaaaaataagttaattgacaaaaagggtttgaagcggctgagcgtcttgccaggttgtcagcttcatttcaacgtgcaaacacaggaaaaacacggaggaaaaggtcatctcctgtcccgacataaatgtggaacagggacaatgcctgtctgccaactgggggcttagaatgtagggcctcatcctgtcccccaaagtcagcattttccagtgtcaaaatggttgtgaactacaagcaaaatgcagcaacccacaagcctcaggccacagccagcaagcggcccaggcatttggccacttagggtccagtgtgtggtgttcggctggagggcagacccctcctgcgtcctcctaatttgcataataattcaggagcctgcccgcacctccatgtctcctgtgatgctggggtgggcatgactggacgcccccatcctgggtctcgatcgcaccctgacccctgaccctgctttcgtggggtattgtttacgtttctttggtggtgctccagggagcatgaagaagacagtgcccctcgcacggcgcactgtggttctgacggggagcagcttccctctcttaccaaatgtgccagtggaaaaaaggggcacagccagcacatcctcagggagcgcgcggggtggtcccctgcgtcatgccatacacgccgtgctgctcctctgagtgggaggtccaggtgggcctcctcccaggaggtggagccgtctcagataaccactgtcacctggggctccccactgcacgcgggactcgaccactttccaagcagcacacgggcatctgagcgtaaactccaaggaggtgccaggcctcctcagatcgcggctccgggtggtttggatgccactgcctggccaggcggatgccaacagaaaatggagcgttgggtgggagctcaggaccagttaaggctgaagcccttggacagcatggcagcctccaggtccttgtcctcctctctctcccggagccgctgctcctccagcagcgccaccagtgagtctctctgctccaccacctccagcatctcattgagaatctgcttctcttctgacagctcctcctcagtcttaaggtgatcttgaaggagaagaaggcatgaggtgaggggcctggaggtggcacccaccctggcctccatgggtgccttaccccactcaccttccactgccatgcgttcccggagctcctgctgcagtcgactctgccggtcttccagctccagctcccgggcactgaggaggcagggcaggagggagacaagccacagtgactggggaccacccctcacccccaaatctggaaggacctccatgccggctgtgacaagcatagcgctgacgccccctacccaaggccactcacaagatcatcagctccgactcgtagcgcaccatggcgttcttctcctgcactagcttgaaccactcctgcatcagcttggggtcgtccttcttgcccatgcctgccgagagaacgcttgtgtcgggtgcagggagtgccgcgcccaccctggcccgcaggaatcacacggggcaaatgtgcaaagagggccgagcaagatgctgccggaacttccactcccaagccaggcccaaggtttgcctgcagccatggggccctggcgtcccccttcctggggcctgcgctttcccgtgtcctgccatccctgttcaccccgtcagcgacctcgccagcagggaccttgccctccccggggctggtttctacccctcctgctctgtgtgctctcttaggatgacttacattgctttccctcttttttgccactcaatgtttatttggcacttgctatgtactaggtctccttggaggaaacccgtcttgttaaacgagacaaatgtgaatttgtaaactgcaccctgccctcaggtcatgctcatttaactcagctctttcttgggctactgcccctctccaggggccaccagaatagatgccttgtccatttgtttacctcctgaccaggaagagaagataccaccccttaacttgtggcctatcaagcttccggatgctctcccgctggatcccgcatggtcgatgcagggcatctcaggatggccgcagggtttctcaccaagagcagagaaacactagcagcccctggggatggaaggaggtggccacgccctgccctggtccaatccaacagaatgcctgtgtctggtggctgcctgctagctcaggctgcctgaaccaacaggtgccgataccaaacctcccccagggacggcctgaccactgggcttcactgtggcaggaggacagaaggaagaagtctccaagggaccaagccacccaacgagagaacaaggtccttttccttggagcacagaagttcatggcaaaagtgtggtcctgcctaaaatacatgctgtgtcagtggctcttcaatatttttggattacaaaccactttgagaatctcataaaagctagggactctcttcctagaaaaatgcttatgtgtgcagagcaaaccatttgatgcagagttccaagctgctcctgggcttcctggggtccatccatgggcctcaggttaaggggcactagacggggacatctttcagaggcccttgcactctctgcgtcccttggcagggggcgttctaggccagttaagacaagcccaggagtgtgaggaacacagcctcagaagggccagccacagcccgagtcctccctcactgctagctgcctttctccacctgcctttctggcacacggtacacagacacacctcttatctgcagtggtgtctgctagacagttagtctctacccagtggccacaccaaggaggcagaaatgcaccatgttcaacaagcaggggttagtgtctgtactgtgccctagtgcacatgcggttctgctcccaagggggttcctgcccctgagcctcctctgaaggacggaaaccccccagcctgtccagcctgcaactgtggagtgtgtgcctgagggtcaggggaccagcgctctcctcacccaatccaataggcttgggttttggcctttaagccagcccccactcagttccatgcattgctttcggagcgtctctgcacaatgtgcccacatggccgtggaggaggggcccgaggcatgcaagctgtccagtgcgcccggccacggcggcaccagggagtctctcccgctgcccacctccccacgaagatacagaaaatgccaccggagacgtgcggacagcgctcactagctatggagagctcgcccacggccgccaggcaggggctgtggtgtgtgagcgagagtcgggtgagcgctgtggacggcaggtaagagttagcagggttagtcacggccacaccccccacatgcctttcaacgacaatcttatcaccacaacagacttcaaatcagacaaacttaaaacacgcacactcagcaagacacgaggtagagaggtttgctttcagtggttgtttggaaaggggcccgagggcactggtgtagatcagtctttgtaaggacagtattccttgactctcccatccaaatcgctgcacgcaggcgggaggctcctcacctgcatgcctgcccctctatctgatggatctgagacttaaagccccagccacgaagggccagccaatgctgcagccctgaaggacccagacctggaggctctctggctttactctgcaccctggtcctccccatagacagtcaaagggatactgtacctttagaaactgccacagactcatgacattttgtaacaggactattgagggtcagagagaaagaaagagagagaggtaggtgggttctggctctgtgtttgactagtgttgctacaccccctccgaggcagtggggatggggttggcgaggttacgttaccttcctggacacagcaagggcagaaggagagaggtctacgtcgtggagtcccgccactgggctcaacttcaaaagggaccaagcaaggaagaggaggagacggagaaagacaaaaaaggaagaggaggagaggagcaggaatttggaagtggagagggacagggagaaggtggaataaaaacaagcagaggacaaaaagcataaaaagtgagaaaggaacaacaggaggaaaagaaaataatacaagaaatggagaagcagaaacaagggaaacaaagtctacaaatgaattaagtccttttttcagcacggaactgaacgagagcagatccagctctggcagcatcacagagggggcggggggccagagccacagtgtggattcctccaagagggatgatgtgttccctacacaatgatggcagcactcgggccacagggccctcctgcctctactccttatcaggagggcagtggcatctgggttgtcataccggggcctttggggccttgggccccctcctcaaagcccctggataggtctgcctggctctgagacagactgcattcaataagtggccaacatggcttccaggcttgcaggtgacaacctggggtcacctcccagacccacgtggaatcctctaagatgtcaccacaggtatgtgcctgaggcaaagctggccttgacaagtgcagggcaaggaggggcctctgagtctgtgggggcagcacgccatccggtgacgggcctccaggacgctcacacctgcgctccttcaaattctgagccaggacaattttggggaaatgtacaaacacagaggtgacttccacccgtccgtgtcactgtcccctctctcccccaggaacagggagagccaaccaccccctttccttctggcccttctatggctgtgcagggaccccatgctgcagctgggggctgtcacactctggattgtgagaccaaaggggtgagctgacaggacacgccaaaacttacaggaacgatgctgggaggagtgctgacggggcatcgagagacagtgtgcagagagacatctctagatctggggtctgatggctactcaaggacgagggagaggagtttggcaagggaccatcacagaaccacagagcacacacagggacaacagagcccaggaagacacggggcctcggcccgcggggagggcagtgtgtggtttacagagagaacagggttgaagaaatggccttgttttactcaacagaaggccaacaagacaaagagctggctgagaggccgctcagcggtgcagctgcatgaatacaggtgttttctgtctttgaacccttccagcgtggcgtaccttgggcacactgaatctgctattgggtacaacttcaaaaccaaagccagggacagtgtgcatgcgtgtgaaatgctgagtgtacccaatgtgctaagcacacacggcacagccggccgaatgcatgggtacgagggaggatttctttcctcaacaatacactctgccttacagccgacctacagtcaacctcggcttcaaagtgtagtctgtcttcaggcttggaacacctggatgaatcccatcaaatacgtcagtgaacagtccctgccacctcctgggactggtgtcacaggtgaataggccatgctgtggagcggaacagcgcccatgtgatacacaaccaaacacatccaaaaggaagaggcaggcgcctgcacgggtaataattacaacacgtgtttctgctttctggacagcacaaaatacagctttcagctgtttttatgtaggccacatcctcatacgcccttcccaacacagagaacaatataacagaatactgggaacagaattaggaaatgaaattagaaaaagggagcatcaggtaaagcaagcatttaaagaagccaaaaaggctttctcctagcaagaggcagaagcgcgtgtgagcggccggcgagtccgagctgcgctgcggggccgctaccttcggacttccctgtacgctccacacttccacaacgggcgaggctacttttataatcagaaaaaatgcccaatcaatacaattttcaaaagaagaagtggaagggaaaaaccaatccaacaaggggagttccacctgactggaacctgactgagcatgcatggggcgggggtggggggtttatagtaaatgctttgccttttagggggatgtaagaaatagaagacttggttcactggttctaagaacaaagatgctgtcaagcttctggcaaatggaagttttttggtttttctcaacatcagggtaacgggtttccatctgttgctaacaggtgctataatttaccacttctcaaagcactcctgcgtgccctgggcgctggccacccctcctgagctcccgagcagtgagcgggtcctggtcagaggacccctcctccctggagcactctgctgcgtctccaacactcgggggcacatctgctccatctttccctctgaagcagcacttcctttggacgtgtgacccaggggtggctctttagtgccactcgcttgacacctggcgggcaggcagtgcctgtcaccaaatttcaaaaagcaacagtacaccaccagggagtgaggcctgtccagagcagcgcatgagatgggcacggatggcactctccggcttcagggcgccctcgcatgcaccacccacgtgatcctcacaccggccaggtgtggctgccaggatgggcaaattcaaatgagggttctgaggctcaacggagttaagtgtggcagagcctggaaaagaagccaaatcttcttgcccactctgaactcagagctttccctcttcaacacaggctccaggcaaatgtaacaaatgctggcgtctcaggcagctcaaggaagagcagtcccacagaccctgatcagaatgtcacacctggaagggaggcccgatgtcccttcctgcctcgtcttctgaagaggccctgagagggtaagtagagtctgttttgtctgtgcctggggagacagtgaaggcaggacctgaatccaggcctggccttcctaagtcggggtaccccctacactaccacctggcccttggcgcacccgagcacctcactccaggccctgcctctcatgggcccaagacccagtgtggggtagaatggccaacagtgtgggggaaagagtggccagctgtagggcaggtccccttctctgtacttgtacttctatattcccaccttctctccaaccaagactcttcaccttggcacactgcatcaagaagacacccgggcagctggaaaaacaagcaagcagatgagcccacacactgaacctagatggtcatctggaaggcaggcagggcctaccttagtccttctggtactcgaaatccaagagccatagccctgagactggggagcagaggcttgagtgccttgctcacaaggattagtgaggatgcggtcagaaagctcggaggtacgggggctcacacctgtgatcccagcactttgggaggtgagggtgagatgactgctgaacccaggagttcgagaccagcctgggcaatgcagtgagaccccgtctctacaacaattagctgggtgtggtagtgtgagtatctatagtcccagctactcaggaggctacggtgggagggctgcttgagcccgggaggtcaaggctgcagagagccgtgactgcaccactgcactccagcctgggtgagtgagaccctatctctaaaaaataaataaataagtaataatagcccagaggggccaagacaaaggcccaactctgttcatagcccgacaaccaccagtgacaatctgtgtggcggtgggtgctggcttgatgctctgcatttccgactcaatcattcaattctgcctggttctatttgacccactggcttctacatggatgctgatatcaaaaacagcaatatcatacatgaatcatggcctgtggtaaggatgatgcgggagactactaatttatgccagaaatgtttactgagcaccccaaacgcaccggccaccaacgctaaccacgtggcagccagcagaggacgcagaggtgggcacagccacagcgggcaggcacgtcggcgggccgtcctccaggcctgctggacaactggccccggggacctgcctcatcttggtatccacctctgcccactagacaggctcccagctccccctggttggacaaaggcaccatcaccacagagctggggaggtccctaaagcagtgtccagcagaccaaaagagggccaatgagggagacttctagagcccagaggccccagcctggaatgctgcatttccccagggaacacgggttaggtcctggagtgtcaccagactagtaccacacacagaggtgtaatgaggaaaatgggctttttatgagccgagccaccatttacaactctatttccacgtgaaaatacagaatcccaaataatcagcttgcaagcgttttagaataccagactttcaagaggtggaggctggccccacaccctcccttctgatatgctgttgtgtgtttcacgcacacagaaactctgtagagccccaaggttaacgtcttcccctttcagccacacttttggaacatcctgcgtagatagagatcatttttggttttcagttccctttggtctctgaggatcacgctccaaggcgtcagggacaggaaagaggctcgcttattctcaggcatattttgaggctccactttcctgcctctctgggcagccacgtgcagcccttagcttaccagggtggactctctggactctcatttctcacacttgttttggcggtgatgccactatatttactgctaactatagtaccactataaataataacataaatattataatgataaatagtgttggagcaatgccttttttttttttttttttgagacagagtctccctctgtcacccaggctggagtgcagtggcgcgatctcggctcactgcaagctccgcctcccgggttcacgtcattctcctgcctcagcctcctgagtagctgggactacaggcgcccgccaccacacccggctaattttttgtatttttagtagagatggggtttcaccatgttagccaggatggtctcgatctcctgaccttgtgatctgcccgcctcggcctcccaaagtgctgggattacaggtgggagccaccgtgcccggccagagcaatgcctttttattgaactcctgtcggagacaccaaagagcttttgtcaccttttcctgggaaacacaaggggaattacctgtcatggctatgcccaactgactggattaaactttcagaaagcagccaagtgcggtggctcacacctgtaatcctagcatttgggatgccgagacaggtggatcacttgaggtctggagttcaagaccaggctggccaacatggtgaaaccccgtctctactaaaaacacaaaattagctgggtgtggtggcgcacgcctgtagtcccagctactcaggaggctgaggcaggagaattgcttgaacccgggaggtgggggttgcagtgagtggagatggcgccactgggtgggttccagcccgggtgacagagccagaccctgtctcaaaaactttcacaaagcaaagtgctcagggctggaattccttggcggctcaggtttacggagtggggccaccgtagattttccactctgccttgctcaggttatgcagcctgggaagtgtgagggaagactgaccaaatgtgttgctgactaagaaggcactcggctattctgagtccccaacccaggaagcctatttggtgggcaccaccaatgccatgctcctggcctggggcagccttggcactgcaaggctgaggtccagtctaaaacctcgggcgatgacaaacaccatggccctgacaggggtcccagctggctggtgtgcaatactgcagacatgcaagcagctgtcatgacagggtgaggctggtccggcaggcccagtctagcatacacatagtggggctgggagacacctggtgctacacagacttaatgcagagataaagctccaggttgggaggaaaagtgaaggcaaaaaaccaaacaaatgcatgtaagaattacaatctaaaacacacaaacacacacacacacgcgcgctgggaaacctcactctaaaacacacacacacacacacacacacacacacacacgcgttgggaaacctcgcaggttccaaagttcctaagcaaagcagaaccaagctgatggtggactggtcaggcaaaccaagaacctatcaacatgaaactcagagaagcagagagaacaggaagacggctgctcagaagggcaggggctggcgtccctgcacctccatctcacaacagcaagaggccacctccagtccttcatgttacatttctaaaccttttgtgttctttaaatttcctttgagacatataaatcaagagatgaggtccccgaaaactagaaattatgtgtgtgtattttcaatcagttttagaagaaatgtggttttcttctagatttccagtcatctgtctgttctagtgcaataaagcaggctgggccggcctgttcagggtcccagggcagaagaaagaaggggagtggccacctggggacccttcctctctggtccaagggttgttttgagtctttttaatgatttctttggaaatcacaaagtccagctatgtgaggaagggaaatcttcattctttatactctgtggctgaaaaaaggaactttcagagcctttaggtagttcactgagagccactgaaagagcctggagcgtgacacacagagcacagggcaggggtaggagtcggcccctctggacaggaggtggcattcccaatgctccgagggctgcttggagctttgctctgcccatgggagaaatgagacgggtgctatggcacagaaatggggcttcggggtggccttttggggatgcaggcacagaggggcaagggcaaccaggttttacatatgaggctccagatctcaaaagggtgattttccctccaattaacgaatattactaagtgctctaagaatgacacaagagcagaaacagaaaagaaacctaattctggcattgccgtcgtcctcacgggcgtggcgagaacagggcctaaagtccacaagagactccctgcagtggggaacgtccccttcaagcagcagcccccacgtggtgggcagaacccgagaagtcttgaatttacgcagcataatggtctgggaaaggggaagtgatgagctgatgagcccaccttcaaagggttatgagtgtcagtggtggggcactgtgtgattcacaaggcatcctgagtttcctttttcttttttttttttttttttttttgagacggagtctcgctctgtcgcccaggctggagtgcagtggcgggatctcggctcactgcaagctccgcctcccgggttcacgccattctcctgcctcagcctcccaagtagccgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcctgagtttcctttttctatttatttcatttccccctggaacttgctggaattctaaatccaaaaagctagtagctgcagtccgggaacccagaggagaaagcagctcactacctcttctcactcgagcaagggcgggtaaagaaagcaggagatgcgggctgggcgcggtggctcaggcctgtaatcccagcactttgggaggctgaggcgggcggatcacctgaagtcaggagttggagaccagcctggccaacatggtgaaaccccgtctctactaaaaacacaaaaattagctgggtggggtggtgggtacccgtaatcccagctactcgggaggctgaggcaggagaatcgcttgaacccgggaggcggagcttgcagtgagccaaaatcgcgccactgcattccagcctgggcgacagagcgagactccatctcaaaaaaaacaaacaaacaacaacaacaacaacaaaaaacccaaaaaacaaagaaagcaggagatgcgatggtgtgttaccggcatcttgaactgggagggaagtgtggatacaatcctaaagaaacgcgttctgacggccccttccaggagattctgaatgtaaacaatttttttttttttttttaagagacagggttttgctttgttgcccagactggagtgcagtgctgcgatcacagctcactgcagcctcaaactcctgggctcatgtgatcctcccaccttagcctccctagtagatggaactacaggcacgtgccactatgcccagctaatttttaaaatttctttatagagacggggtttcaccatcttgcccaggctagtttcaaactcctgggctcaaatgatacacctgccttggcctcccaaattgctgggataacaggtgtgaattttttcacacagtgaaattcacttagaatagacataaacactcccgaggtggtgttaggagaaggcaagaggcattagatgggaaaagcgtctgttaattggaatgtaagcaccggcccttctgcagcaccagtggtcgttgagtgtggaggtctctgaacacaccagaagccctgggacactgagggagtctccaagggcgtgggtccgtgggagcgtgggactggagaacacaggaagcacagacagcaacagtctctcttcccagggaggtgagagccccgccttggacgtggcactgtctgataggtggaatcacagaactatgacattggtttttaaatgaatgggccaagaagtgaccctcttaaaggaatggggtcagggtaaaacacgagacaattatctttgccattcttctgtttgaagaccacctctaggcatggagcctccacggggagatgaagggggtagactgccagatcaaggacacacggacagggaggaggagccacagtccccaggattcccctcaacagaatgacagctgcccaggagaaaagctgcctgaagcttagaaatgagacatgggggtcagccattcctctgaactaacacaaatggcaagatgccaaacatactgcaacctctaagctagtggttctcctgctctagagggcatcagaacccactggaaggtctgttacagcagataaccaggcctcaccccagagtttctgattctgcaggtctggggcagggcctgaggctgtgccttcctaacaggctcctaggtgatgttgctgctggtccagggaccacactttgagaaccacggcctggagcttttcctgtcttcactgaaaagaagtacaaagtgagccccaggacagagcaaggagggagggacgttgttatgggcacccgtcaacctggctttgagtttggtgactccgggcagaaatcactacagagaagcctttccctcgcactcagctcttctgggagaaacgagaccacgacccagtgaaaatggtcgggctgagatcttggcatgtttgcttctttgcgtaagtgtggcaggcagtgagctccctagcagatatgattcctacaagcagtgagggatgagattcagggcaaaagctgtgttggagtgtgtgtatttaggggaccaggacgcagatgcaaggctggtggagtcgggtgggcaaagttttattataaaaaattaaaaacgaccccaggcagcaaaagcaagctcagatcttcctctggagcacatgtgggcagcggggagatcagcacgctgctctgttttgagctggaaaagggtctgtgcttttgccatttggttattgggttgatttctccttgtttttgtgagcagggactgggaagcgtgggtggagaaagggcgtcagcggggttagtgtcagcacaggcgctgccatacataccacccagatgcaagtcgatgaggtcactgtaataagactctccccaatagtctacaacaaggaatcggtgaagagagagttattccatcaggtagtcctcctgtccccccatacccaatcaatgatatgatatggagcaatcaatgatatggagcgcaagaaacacagacacagcgaggcggcagaggaacggctggaaggcatgcgtgcctaagtgcatcacatactgcatgtccacacatgccgtatctgcatactgcgtggctgcgggaggagggcggtaactaaaactcactgtggggagtcaatggtcactatcaacatgatcccacgtacaccagggatcagccaggacagaggctttggctttgctgggaactcctgcccctgggactgaaccttctctaactaagagttaatagagcggggctgcctgcgtgtcagttgctgatactggaagccccaggctgagggcctggaggcaggaggcaaacgtcctacagaagctctgaaatccttaggtttcgtgcagtcagtgctctcccaggaattcccacgaccccactgctgactctatcaaatgccttgcagacccacttttgccgaatgggtttgagagaaaggggatcctgtttcgaggcttaggcctccaaattcagtcggccttcttaacaacaggaaacgagcagagactcatgcagagttcttcccccaggcactcggccgaaggctcctggaggtgtgctggcctggggcactcctagcctggtagttccacagctgtctggccaagagcgctatgtaatttccacgcctgagatgcagactgggcactgccgagaggctgggcttgagcaggcggtcctcatctccccagaatcataaagacacacagagcacagcactcggccgccatggtgttgccctctctccaaaccccgcattctgaatgcagatcctcacagcctccggtcccacctgagggcctccccttgagagtgacacagcagacacagtggtagaatgcggtcctgccccagtttttcaatgcatgctcaaggctgagtcagtgtttttgtaacaaaaaggcttcccaggtgccccaggactggaaattacctaagttgtggcctggccctaggatcaaaggtgctgaagctaatccttgcagcctggccatacgtcgtcataccttagacaaacggagaacgggatggcaggtccatgctagagcgcttctctggaaaggcagcttggctaacaaagtctgacgccctcagacggtgatggaagctggagacccccaagtgagatgatggcaggttccagccagtttactacagtccccagggaagggcagactgccatgatgagaagactccagattattatcatgcccagctgccactgccttcttcagggctcagccaggtgccacaagactaagaagaggaacgggacgcagaagcaggagagaaagcagcagcagcacgcacacctgggcttcagagacggcatcggccaaggaggggcagggccacggggaactgtgatgggagaccagcttggaagggatgtattcacgtaagagaaggaacatatttggaaattcttatattcttatggtaggaaccataattcctgaaaattccagagagtttctcaaatgcatcacaacgaaatatcccaacagagctactaaggcccatcttgaaaaacagaacagaaacatctttggatagagatatctgctgaagactcatctaaaggaaggagtttgcactacgacagtggttttcaagcctctgtggaaccctaaggttcttccaaaggcattccaaggggtctcccaaatacctgatgtacaaatacttgtagctctttcaagagcccttattaaaataagacacaccaccttcaaatgtttttgtttttgagacagagtttcgctcttgttgcccaggttggactgcaatggcgtgatctcggctcaccgcaacctccacctcccaggttcaagcgattctcctgcctcagcctcccgagtagctgggattacaggcatgtaccaccatgccaggctaattttttgtatttttagtagagacagggtttctccatgttggtcaggctggtctcaaactcccggcctcaggtgatccgcccacctcggcctcccaaagtgttgggattacaggcgtgagccaccgcgcccggcccaaatgttttatatgccaacttttcacccactggagaccatcaacccaataatttgtgctgccaggtgagcttgattttgtggagccctcaggatcaagtttccgcctctctctgtgtgtaagtggctgaactccctgtaaatgtgttagtgaagaggacattttattcatttgtttatttaaattctggcctgcagcatagtgctcacctgccaccgttcagggtctgtccgggagagctacagctcactgacagcacgcacgcctgtcagcgagtccctttatgtaggtgggtaacacgttttgctgcggtattacagcatggctgggtttttgtttactttgtttgggagcctcttgtttgagacttgcttgtcatgaggaataggaactgctgttagatttgctgtgatccaactgtggaaaaaaaaaaaaaaaagctcttgcctcattttaaacttctagtgtctacatcatttaaactgcagaaatcctgagatttccaagtaagctgttaaaaaaaccaaaaaccaaccaaataaaaaaaaccatgttgtcacttatagcaactacagttcttgtgtgtactggctggatgccggggcttggtcatgtccaccactctctgctataacctgtgttttcaaatctgtgttaattattaacatttgagagtaattctttttgattttaaacttgaacttatcatcttgtgaaaagaggtctgctgctagttttttgaaaaccactgacttagacggcatttgggttgtgtatgtttgaggaaatgtgattatctaatgactagaagaaataattctggcaaaaccctaacgccaatcttcagtggtatattattttccggccctttggcagaagcttgaataacagggcccgtgacaggggcgtcgaagcactgttttacactcagacttcacggaggccacaggcgctcaagtgctttacggaaaccaccaaccttgatggcaccaccacctcaacctcatgagtaaggagggcagggagctgtcttcttcctgaagggcttaaaccatgaaatgcggttattctgtctgtgtgttgagatctaatccactgctttccatcttggcagaagtgatttgtggagaagggcaagaaggaatgaagatgagcctaggctctctcctgatatcttctgcaagaagagaaatggcacgagggcagggccccataggcccggacgcagtcgggcacaggtgggctggggccaactccatctgggctcaggcttaactgaggaggccaaatcagagtgcgcagagcagggcaggggggcaggggcaccgcaggttcgctgggaaacctcagaccttcttaggtgaacccaaatctccttgctgtgcttgtctcacagtaacacatcccagtcgtctcagcctatcggatgctaagtgcttcaagtttttgcatttcctttggtagcctggacttcatgcattaacagcatcaggtgagcccaaaccaagaacatccacatcctcacctttctccccatcccatctctttgactgaaggtcatcactgagtagccctataagctgcaatttccaggccttaaagggcctgggaaaggagacctacttccattctggactccctcactccccaccacacaaacttcagtcctacaggccacaggaattcatcttgacaccaggcacttcccatgagcccatgggtcagtctttgagcaagatcagatggcagcagctggccctgctcctggccgcctcctcccagttcgtccatttcacagagagcctgcctgtcagcagaggcaccctgctcccctctgccacactagagtgaggaagtaagaggatactccttttcttcatccccagctcacaatttaaacgctgaacctgcaggctataaagagacggaagttcccccatccagagactagacgaagatttgtggatgtttgagaaggcagagtggccactgcacccccggggctggtcctgcagcttcaaggtcctgaaccaataggacttcctgggccgtggggccagagatgcctcaggcactcccttgcattctctgtgcccaactatgctgagcgcagccgcgcaggttccctggatggaatggcaggaatgagcgcaccacattctccagggcttccctgccaggagcagcagtcacgagcacagggccctgccagccactccccggagtctgctccacgtcggctggtcacataccctgagcctctccagccctgccctaagtgaccagccttcagcagacacagggcctgggtgccctctggaaatctgtgtgtgccgagggtggccacatgctccccgaccagcggtgttgagggctctgtgggcaggagggtcccagggaactaacgacatgagggggtctgggggtgcaggctggggacctgctcagtgcaattctgtgatggttccttgcggttcaatctccctcactcccagttattccctcctagagtaaatggtggggtgggaaggagggggaagagccagcgctcgccatcagcatgccggggactgagtttcactctatgggaaatggcagcccagaggggctgtggagcaggatgggcctggggctgtctcagacaggtattttcttttgcttaacaggaagccccaaatctcagagatgaagggccccagaaaatcctgctggaaaaggagctgaattccaggtgaggtgaagcaaaactagcctaccacggcgggagggagggcttcctccaggagcagagcttaggagggagcccggcagtacctgcttcgccccggagcgccttctccacagccacgcccctttcctccagccgccgctgcctctcctccacctgctgcagctgccgctggatgatctatgacagacagcacagactgagcacccggctctccagccctgcttcaggaggacacacaactccacacccacacgaggggaaacacaggagttgccgctctggaaagggctctagtctgtgggcggtgcgctcagggtgtggcgtggagaccacctgcaccagaaccacctagcttgtgtagacgccaggctccgggccttgctagttagcatcaaagcgcgtggacgtgactcaagtagtgaccaccctcccaggagtgttgcagagacaggaagtggatgtaatctgtggcaggaggggcctgagtaccagaacctcagactgttctcacggcaagactgctagagtgctggagggggttcctgaagagtgcagtggaaatcccatctttacgataaaaatttaaaacagaaggccaggcacggtggctcatccgtgtaatcccaacactttgggaggctgaggtgggcggatcacaaggtcaagagatcaagaccctcctcgctagcatggtgaaaccctgtctctactaaaaatacaaaaattagctggatgtggtggcacaggcctgtaatcccagctactcgggaggctgaggcaggagaatcgcttgaaccagggaggcagaggttgcagtgagctcagcgccactgcgcgtccagcctggccacggagtgagactccgtctcaaacaaaacaaaacaaaacaaaacaatagaaatctacagtggtctagattcagggtctgtgcagcctgaaaacaagctggagaatgggaggagagctctgacctctgacctcttcccacaaaaatcccaggcctatcagaggctgaggggccacaaatggactcctggtgacagtcctcacaattgaatgaggtgacttacaatgattattctacaacaagggattcgggaaactcaatgcagggttcttcctttttttttttatttttatttttatgagatggaggctcgccctctcacccaggctggagtgcaatggtgcaatctaggctcactgaaatctccacctcctgggttcaagcgattctcgtgcctcagcctcccaaatagctgggattacaggggcccgccactatgcctggctattttttttttttttttttttttttttgagacagagtctctctgtgtcgcctaggctggggtgcagtggcacaatctcggctcactgcaagctccacttgctgggttcatgccattctcctgcctcagccacccgagtagctgggactacaggcacttgccaccacgcctggctaattttttgtatttttagtagagacgggggtttcaccgtgttagccaggatggtctcaatctcctgaccttgtgatccgcccgccttggcctcccaaagtgctgagattataggcatgagccaccgcacccagccaatttttgtttttttagtagagacggggttttgccatgttggccaggctggtctcgaactcctgacctgaagtgatccgcctgcctcagcctcccaaagtgctgggattacaggcattgagccaccacgcccagcctgctcttcccttttgactgacagctccaccaaggcagggcctctgtggctgcaccagccaaaggtgacctgggtggcagggaggcccgtctacctctgctctgctctgcactgtgcttgtgtggcagggagcagctgggtggatagggagatgctgcccaaccctcccatgcatgtgccctggtcccatcctccatggttttacctgggctcgatgcagccgcttaagctcctcctgcttggcctgtctccgagctgccttttgcacacgccgggtcagcttggcattcagttcctcctccgtgtaggttcttggctggagagaacaagagaaacttcctcagtcaggtgcacggaggcctgggacaggggtgggcagcaggccaacaggggcctggagaggtctgtcccccatgtcggagctggtacccgggcagataggacaagctgtcctctgtagagtagagtgctagcaggacgggggtgctgataggcagaaggcatgaggtctgcagagtccccagcctgcagcagccctcagtgccacgggcacacctaagatccacagagtgagacatttccccacctctgcacagggacaggaggctgagtggggaccgactgttaggcagttaaaacaataaagggacacacgctcctttatcactgagatcacctgcttcccaaataaggatgtctggtcattttaaaactttgtgggagtaaaaacattggtaggctgtttcaccaagcctcctgcttctaggaggcttacaggggaagcaaagagaaatcgggatccttttattttcctgtttggtatcaaaggtcactttcttcagaagagcagtatccatgagagtcttccaagaaatgacacccaagtagagagaacaaggatgtttctcttttaagtcaagtacagtctgaagaaggaattgtggaggtgaacctggactgactctggggtctgcagaggcagccgctggccgctaggaagaagagaggttgtggcctggccagggctgttgcgcctagcgccatcgagaacagaagaggcaatggcccaatccagtgcaagtccacggactggacagccacagccccctgcctacgtgggtgccaagggctcaagggagcatcagatgctttgaacaaaccatgggcaacaagaggggcaaagattggggatttgcctttattcataagaccctctttattgcctctaagaaaatgaaacaaggagactatataaaagttcttttttgagagagggtctcattgtcacccaggctggggggcagtgatacgatcatggctcactgcagcttcaaactcctggactcacgtgatcctcccgcctcagcctcccgagtagtcaggactataggcgtgtgccacctcgcccggacaattaaaacaatttttttttgcagagacgggatctcgttatattgcccaagctggtcttaatctcctgggcttaagtgattctcccacttcagcctcccaaaatgctgggattacaggtgtgagccaccatacctggccaacaagaaaacttttatagacttcaaagaagacaaacatgacttggggtctatactcataatcttcactcgaagagctcaaatgacagagggtcccctgaacagtcagtccctaagggtcatcagtggtgtttcagcgctgcaccttgctgatcagagctgagggctgctgaactgcccctctctggggtgcccagccccacagcggcagctgtgtcccgacccgaggaacctggaacaaaatgaccacatgcactccagccggtgaggagcaggtgtctcatcctccttcccactcatgacgtggctaacggaagtactgctgccagtgtgtgccacagccccatgcacgcacaaacacagttagtgaggatgtggctggagggccggggccggcgccgggtggttaatcacagacatgcatgcaacggtgaccagctgacaggaacgagacactacctttgatgcacatgatctcctgaatgccaaggcgtgtggtacataaattgacttttaagcggatggcatcagaaaacaaaacagaatagtaataataataatgattaacaaattaaaaattaagaacacagaaatggagcaaaataagttagaagttgaaaacaaacacacaagacttaaaacacgagattatttttcacgaagtcacacaggactgcctaggtaggaatctgggtgtgaagatcctagcggcggcgtctgagtggacctggttttgaatacggccggggttcactcttttattgggaagaaacagcttcttcctcaccacccccaaaactcgcctcatctcactgtcccttgtgtaaagttaaagccgttaaaatatgtgattctagatgcttttctccttgagtgaccatgtgcttgtggaaattcagcccacttcttcctgctgaatgctccgggggagtagaagtggggtgcgggaggaaagggggtcctgctctcagagacagacgcagcaaaactgggagggaaaccacccatctctcccaaaaggccctccgctggcagtgttcctgtgtgccacccagctgccatttcttgattgtgcccagtaaagggaattgaactaccatcagtaagtgctgttcaccaaaagcacgtcaggcagcagcaggagcctcttctcattccatcacaccttgtgcagagccgctctgagggtcaaggtgagtcacatctgctcttgtggtctcaccagccatattaaacggctgaaaggcattagggaaaccagggtgtgtggtggcgcacaagacagggaagtcctgagaattccaggcaggctgcaaccacagccgcgctccctgttgctccatccatcccatctgtggggcggccttgtgcggagctgtgcttcccaagcctacaggcgagggaagaataaatttgcctccttcaactttgagcacttgtgtcccgcctgcctcaggtggacccacctctcccacaaatcagagcaagagaatgttgttatgagaacaagccggttcagaaaaagagacagatgatttcccgaagcggctgcaaaaagcccacaggaactatggaccacaccctaaggaacagcactaacatcttcacctatggctgatgtcaatagcaatggggggcagtggctgccttcccacaatctacccattttctgggctgggaggggtgaagtcaccacccgtccctgtgtgcctgaggtggtggtcagccacaggagctgacattctgctgtgaatctggatgcggggtggcagggtacccaggccacaccctggtgggctgcagggctcaagaggcagctgcgttgcttgtatttaaagtcaaatgggagcaattagaaaagaggtaaacgcaagttctctcttgtaggtcgggctacaggtgactttttaaaagtctgaattatcctaaattttctataataaacattttaaataaaaaataagtattttgactggtttaaaagtttataacaaaacaaaacccaggctcttgtttcacagatgctgtgaggcgggaggaggcgtctgctgctggagtggccccaggatcctggcctggcagaaggggcttccttcttccgaggcaggtcaaaccccatcctcactttagagcccctgttccccacacttactttgaaagatttaaacccacaggaaagttgaaagaggaagacaatgaacacccacatgcctctcacctgtgtctgccaaaggttaccattttgccacacgcttcatctatatgtcatcttttatatgaccttttgtaatgaatcattggtagataccacgacccttcgtccctaaacgttttaggatggactttctaacaactcagacattttcctatataactttcctacataaaagtacattaacagtgcctttatcacttgcaaggaacttaacaatttgataatattacacatttatactatcatccagtcctcagttgaatttaattgttcccaaaatgtcctttatggctgtttttgtttggtttgttttcctctttagcatccatgtcttgaataggcacagcacccagccctcgctcaggctgactccataccatgcggaagtcaggtcagctgcccgtggctcggttgtctcccatgtcatctgtctcctaggttggccttcccctaggtcattcatcccctagcctggccgtcccgtaggtcatccatcccctagcttggccatcccataggtcatccatcccctagctcgactgtcccgtaggtcatccatcccctagccgggccgtcccgtaggtcatccatcccctagctcgactgtcccctaggtcatccatcccctagcttggccgtcccgtaggtcatccatcccctagctcgactgtcccctaggtcatccatcccctagcctggccgtcccgtaggtcatccatcccctagctcgaccgtctcctcgatcctcagccgtcctctaggtcggccatccgctagcctgtctgtcccccaggcttggctttggctttagtattccgtatgtgacgtctagcaaacggctttgcctctgtgggtgcccctagagcgtgaggccttagaggccgccctctggctctagggttccatgactggtgtccatggcttgttcctggggtcctgttcctgtttctcccttgctccttgtatctgctgggccctggggaggctcaccaagtaccagccttggcacagccaacccaggcagtaggtgcttcatggatggagaagcagtgggcatactacccaccacagcaacgtgagggaggtgggtggccaagctgacacaataggttgaatgtccacactgtcaccactgaggcagtgagcttgggaccacattctccattctttgctgaccccctaaagcagcacccatcaccagtattgggatgtgtttagggacccacatagaaacccaggggaattctcagctcagccccagtgcaactgggaaagctcgactggaagccttgatgaaggcacactctccctgtccctgagaaggcgcagatcccaaccctaactcagttgctggcctggctggggcaccaggaagcctggctctgtagagggtggagcaggaggagaggcctggctctctagagtcttctaggagaggggccaaagagccggaaaggccaagggagacgaatgcaccaaggaggggatgcgaaataaagcgtctggtttgctgagttatttaaagaggaactggatcaggctgcaggagccatcttcaccaaatgggcacgtgacgggctcaggcgcaccaaggcccgccctgactgggctattggacggcaggagagggcagactcaagtccaagccctagaagccttgcaatgaaggcatgctacattctcgggaagcttttgacgcaaaagggaggcaggaagcaggagacagccgggttgcccccagccaggaggaggagcacaggccccagggctggacagtggaggtggggtgacatgatactccgcagagctccgcccaccctgtatgctgacaggtgcctgttagagtgtgctctgattcctctccctccaccttcactggatccacccaaagtcctgggctctggaaagtgaggggctgagtcagacctagcagccctgcaggtcagttcctggaccagtcctttaagacgacaaaccctccctaactatcaaacccaccaaacgggcaggaccaggcacaatgctctgtgcctaaggtcccagctccgccagcagccctggactgcgcagtgttctccaggccctggggctggtgggctgctccccgcgggatcacctatgaagaaagacaatgccaggctgcctcctccagagaaggggagtgtgacacaggaatggctccagtcttttcttcttcacaagaaatcagaagcccttgctgtggatgccaacggccctagctcccatgtagaaagcccagcgtgaccgcctcagtgcatagggctgggtcagcagtcagctggctatgcgccactagctgtccatccctggcttgcggtttgctctccctctcctctaccccaccaaagcccaacaatgaacagacagggccccaggccctgtgaagccccctgcctgactacccacctctcgccgggacttctgtgaggacttctcaaggacatcgtcgctggagaggtctgagtcctcggagaagctcagctggcgccggagctgcagctctgtggagagagggaggccacgtgaggacagcgccagacagcaggcgcagccctctcctgctcctatgctcccatgtgcagccaaggaggccgggtggggggctggattcattttagtttaagggatccatcccccatcctggggagccaggagctgggacaccaacctttgcctgggcagggcagagctgacgccaagcgggtggcacctaggcctgcccagcccctcctggtagcactgccctctgccctgtgcacgagtgggcccctctggggtcgtctgactttaggaagggcacaaacctccacagtcttcctggtccggtttcaagctggctttgagaattctgttactaagctggctatgccctgtgaacccatggttcagtcccttctccaggtcagcacggctcctgagaaccctcggcggggagcgtgtgagtgtggatcctgagagccccagtgaccccagcccctcccgcacccctcccgctctgcctgcacgcggacccggctgctgacgcacctgcccttacgacgggaagcaccctgtgctttccagagtccaccgtggccccgctggagggggtgctggggcaggacttgtcgtcggccttcttcttcttgtccttcttgtacccggagaagacggacttccacagggacttgggtttggcggcggcttcttctaggaggttggagctgggcttctccgggggccggccctcgcctttggacttcttctccttcttgtttctgcggggggagaagagtgacgacctcttcttgctcttcccactggagccctcggatgaagtgaaagagccatctgggccccctgagtccgacggcggggagaggacctcctcgctggtggcttcatgcttcagggtgggctcctcggagcccctgagagtggggcgtgtgggggagtcaggccggcgctccttgccctgggagggtgctgaggacgccttgcggggcctgggggcgcctgaggccagctccatctgctgcatcctgctcagctgcctggccatggcgtcccgcagcgcctggctcttcacggacttctccctggctcgcatgcgctcctcggccaactccttggcttccgcggacaccaagggcagccccctcttctgtggctgcagcgtcccctccagagcaggcagcctcccgttctccttggccaggggcgggtggcgaggcttctcggggcgcggccagcaggacgggggcgtgaagaatttctcctgcaggcttgagtcctcagtcttgtcgtcataggtgtcctccacatcatcagcaaagggaatctcctccacgctctccacaaacgacttccgcacctcctctctggggggctgagcaggctcccgggggggccgcatccaggtggcgggcaagggcggcgggaccaccgaggcattgggctcggcctccctgagcttcctccgcaaggtggcgggctcctcgcccgggggtggcggtgggggcgggctggaggggggcgtgagcatggcggagtccgaggtgttgaagctctggctgcccagtgtcttcatgttggaggagctcccgtgcaggcccaggccagagctgctggacagctccctgcgctcctcctgggcgctgcgtagctctctgtcggacggggaccggggggttggcagggacaacggctcgccttccggctttggcaggcccagccttttggggatggacagaggcttgagaaggtggagtccctcatcctggggggacttttcaacggaataggatttgagggacactggcctgaaggcaggcgtggggaagctgggctcgggccccttgctgcggtccacaggtgtgagcccgaggctgcggcggatctccgcactcttcatccagaactcctccaccaggtcgctccgtctgagggcctcatccacagcaagggggctgcccagtctgtccttggtgtcactttggctttggacagggagaggggccagtggggtggatgttttggccggggcaggctggaagcgtatgggggactgggtaggggatgggacagtggcctcggtggaaggctggggctgggagcagatggggagtgggctgggtgggggcgtggaggccgccacgggtggctggggctgcgggctccctggtgagacaggagtcctagcttctggcagggtcactggctgtgatcggatgggagagtgcacagctttcagatccgagggggcatcagctttgggcttctctttggggagcaaaggctcagggaaaaggcgctcctcaggtgatttctcctgggtggcggcagggacaggtgggagttggggcccctacagggaaggaagacagaagccgctgagaaggtgtgggctttcacgaccagcagcatcctcggggagccttctcactcaaagtgcctgcacctgtgcctgctgcaggacttccccgtccttccagctgttattagaacagctccaggaaaaccctttccactttctgctccaggtgttcagtgtttagaaccttagaaccactctgcttagtttagacaaactgggttttcaggatttggttcatctcaaatacatcctatattctttgtccactcacaggaacactggccaaaaggacatagaggaatgcagttctcaccctccaggaggccccagagcgccaagatccctgacgtacgtacagaggggccaggactgtaagaagacttaccacagctatttatcacggtgcattatgatcaaattgtcctccctaggaagctcaaagatgtgcagagattcctgcaccagcccttatatcaccccatccaagagcctcaaacaaagcctccccatttcacagacggctgagcgcagtggctcacacctgtaatcccagcactttgggaggacgaagtgggcagatcacgaggtcaggagatcgagaccatcctggctaacatggtgaaatcccgtctctactaaaaatacaaaaacaaaattaggcaggtgtggtggtgggtgcctacagtcccagctactcgggaggctgaggcagaagaatggcgtgaacccgggaggtggagcttgcagtgagccaagatcgcgccactgcatcctagcctgggtgacagtgagagactccatctcaaaaaaaaaaaaaaaaaaaaaaaaaaaatccaatcagtgaacaggctaggtacagtggctcatgctgtaatcccagcactttgggaggctgaggcaggaggattgcttgagccgaggagttgggaggctgcagtgagccatgatcatgccactgcactattgcccatgccagtctgggcaagagactgagaccctgtctcaaaaaaaaaaaaaaaaatcactgaatagttccatgcttcctagaatcccaaagactaaatcaagcagatgcaggccttatattccagctttctccctgatctgacctgcagacagtatttcccaaaccatgttccacaggacctgctgtcacagttggctttgcagcattctccatgtggttcacacaccacaggctgtctgcatggacgctgtaaatttctttttttttgagacggagtctcgctctgtcgcccaggctggagtgcagtggtgccatctcggctcactgcaagctccgccttccgggttcatgccattctcctgcctcagcctcctgagtagctgggactacaggcgcccgccaccacgcccggctaattttttgtattgttagtagagacaggctatcactgtgttaaccaggatggtctcgatctcctgacctcgtgatctgcctgccttggcctcccaaagtgctgggattacaggcgtgagccaccgcgcctggccagatgttgtaaatttcaatggttatacatttattttaacataatgttaaaaatgcatttgtcatatcaaaccaaccatcccatcgatattattgctttaatttaaacaaatttatttttaataaaatatcaaatgttttataccatttatcataaaaattatattatttttaatatattataaatttataaaaaataaatttgttctaataaattttaataaatttatatttataaacataaattttaataaatttatatttataaacataaattttaataaatttatgtttataaacataaattttaataaatttatatttataaacataaattttaataaatttatatttataaacaattttaatacacctatgtttattatacatttattaaatataataaattatttatttttaataaatttgtttaaattaaacatatggtgtgtggtatgtggacctaacacagtgacacggggtagaggactcaggtttgggatcagagtggggcagaggtagtaggtgccacccagacggcctcatccccaagagtactgagctggaactccaaggccactcctgtcatcaacagctccacttagtacaaggaggatgatagttttcagtcttcctcagaatgaggaggccagcaggctatgttagccccagtcttggtgggacccacaccatgggccctgaaacagagaagttaatatgtgtccttggggtcccattagttctctgtaccccacagcgagccccaaacccttacctctgttgaggggctgtggactggaatgaacagaagagctgattcctggggagaccggatggggctggtggcttgggagggacctgaaaagaatgaacacagggacttacaagaggaagcccccccatgtgccaggaaggcacccctatcagccagccccagagggtggaggggagggtagagggcgagtcgctgagtcggctcccagttctcctggaaagcacaggttctctcagaggccagggtcctggaaccgtcttcccggggctgcccggcactctctgcaggtgctcctgtcaacaccaggtcaggccgtgggcttcctccatgtgcagactctgcacacagagcttcaggacaaaccttctaccttctcccagacccaaactatgcaaggaaagggcctttggccaaagcaactgcagcagcctgtggcacagggagggtggacagaggaggaaaaggcaaggagctgcccacacctcggaggctggtgtgcaccatggctctgctctgaagcgcctggcccctgagccactcttgtgtgcatatggccctcgtaggaattctgaaagttgtttctcccatcaaagacaggctcacctctctcttggtgcttcggtgaggcgggcagcttctcctcatcttccgacaccctcagctccagctctgcttccccctcagctgggcacggcaaacgcagctctctgtcagcatccgacgggctgtcagaccagtgctgatctggcagagggaaggggcagaagtgggtgcacaccctaagtgaggccaactccttttccacctgagagcagccgcgccacttgctcatttgcaacacagctgctcaggtgcaggcctggaggcccttcttacgcagggacagacctgcctaccagaccacccccgctcctgaggggcccggccaagagcaccctcctgcctttgcaacgcggggccgcatcaaagcctgtggggctctgtttcttttaaaatacagcaacagtcacacatgatgggctgcgacagacaaagacagggtgtgcctgtggagggcaggcctggcctcacgggcccacttctatgcacctcctcctctcagtagccctgactgccaccccaactccacagctgaggcctgcgccccctcgcaagcttgggttcttctcattcttcccagcctcgtccctgaccccctcagccccccacaaccagactgcgatgcagaacccatctccaggtatgtagctttgggagccagtcagcagaattaaaggccttgtataaagccacaggttggctcaggcacccagctgcagctggatgactgcaggccaagtcgcctggtgctcgtgggtaggtggtggttgggtggaatgagatgcattccagccatggtggagccaagaaggaaccaggaggcccaacggcggcctcactgagcttgattttgctggaaagcatattgccttcatcttccctgagctcccaccacaggggcggggagggcggacccctaccatcatccagctcagcaccagtgtcccctgggtccccatcctctgctgcctccccttctatctcggctggttctgagtccacatcttcctctaggtcattctcatccaatggggctgcaaagcagaaaggttcaaaggaaggaagaaaaggaggacagacagacaggctgcatcttcacgggggcgagaggtactgcctttctcagggcgctgccatgcaggccccaggagaggggagatgctgccaggcccagggggctctccacacgtagcatgggtgctggggggggcccggggcccccaaacacaggaggtgggcatttctcaatgctaggggccaagtgggaagagaagagcggctgaaggtgggggcattgttcctcttcccccaaaggttgctgtaggaacctcagttggaggagggtggaaagggaaatgctgtttctctgggccttggcccagcagcatctgccaaagcctggctgtgtgctgaccgcctcacacaccatgggtcattcagccctcataatgcaggctgagcatcctgaatctgaaaatccaagatccaaaatgctccaaaatctgaaattttctgagcactgacaagaggccaagtggaaaattccacagcagacctcgtggtgacagtcacacctaaaattgtttcatgcataaaattattaaaaatattatataaaattatctttaggctacgtgtacaaggtatatatgacacataaatacatttcgtgtttagacttgtgtcccatccccaagatctctccttatgtatatgcagagattacaacatccgaaaaaaattcgaaatccaaaacacttctggtctcaaacatttcaggtaagaaacactcagcctgcaacataattagagggaccgtttctttagcgagaagtctgaggtccagccagctgagggggttgtccacagcgctgtgtgcaggggcaccagatgagcttcccttgcaataatttagagaaatactaatactttgggagagcattgggggctgaaggtacgtaaagttcatcctctggactccaagtggcccttcagggctgcaaaatgaggcaaaaccctcgacaacttcccctccccaggagccggcccctaagcacgcacacaccgtccccacctcccacactccgaacttgcaccagcaggaagagggcggcacgctctgctctgaggacactgtgagacccgcaccacctgagacccacaggaccactggccgggggcctgcgggctctcctagggttcaagcccagccaccctcaaattacccctaagggttttaatttcaggagaaaggagttatgctctgatgtccatatacaagagtccgcacggatcaaagccccaggctggggagcagggaactgatggcgcccggttaggtggatttcttaaaaagccatgtggaaatgggagggcgcagcctcggaagtagcatcttctctccacaggccaggcacttagaagatgctggcaacgttttatcccttgaacagggtggcagttatatgattttctgtttctttaataattccttaagcttatttttatcttttatgcacagtttgtaagatgacggttcaaatctagtgtttgaagaactgtatgaaacaggtttggaagggaacagacggcccacgtcacagggagagataggcgggttcccagactagctgacagttagggccatgtgcctccctgagataccagagtggcccacgttgctggccgtgccaaatgctatcctacagcatcggcacctgctgggggaagcaggggggaaatgcctcaagtatttctattggttaaaacctcggtgtgagaacactgcttttggccactcaaggaagacagttcatcaaacaccagggagtgggacttctggagcaaagataaaagaattcatggctgcactacaccgattctgaaaaggaggaacaaacgccccgtttggaacagaatctggcccatcccatggagagggccactgtgcctgacagatttgttggggtgaatctgggtgcccagggatcaatatggcaactctacactcttgctggcgagggaactggaggccagcaccaaggagacccaaacaggcctcccagccaggcacagcccagggcaccctgggttagcctgatcccgccctggtgcctgggtccttcacgcggctctcctgtagactttctattaagaaatgcctgtggtagagtcaggcgggtgagaagtctacactccttggcagtaccttgaaaggaaaaatcgtcacagataaaaaaaaataaacaggtgagaaatatcaacgcagcagcagcagtgttgaaagggacacagcttgaggggtggatctgggggtgaaattcaggttaagacggagtgcagggtgctagaagctgccacgcaggttgatgagccacgtgctatgaaagccaggagccactgacccgctcagctcttggtttccttcagccgccagctgggaggctcttgccccaccgccctagggacccaagctatctagaagaggagccagccgtctctgcgcaaagagcagtggcccttccctgcggctgtgtgtgcctgtttctcccactgccgggaggacacagggacaggctgctgaagccccacgagctcccatgtccgcatcccagaagtgaccgctaggacagtggtgctgttggcgataacactgcccttcctccagcagtgtctgacaactcgtggagggatttttggtgtcttcataggtggtggaggctgcacggacactccaagggccgaggccaagaatgttaaaccttctgcaagggaaagagctgtcctgccccaaatgccagtagcccctcggtgagaaacacacacttccagaaacatgtaggaaggacaactcaggctgctcaacgatctcttgtacttgaagagacgcctgcagctcgggctggatttgactggtgtcacccctggtcacacccagcctgtccccactttctgctgaatagcacccgcccatcctctgctcttccctctccaccatcatcctcccataaaccccctggttttgacagcctccttctctgatagcttggtaggcttgtggaatatcttctgattcctcccctttcacactcaatcggtaaccacctcattctcaacacattttaaaactctcagtgccaaaaacgttcctttggctttggcctttttatccgactcttatcaataaaaacctgcctgtgtctgtcctgcctgccctcacgtttccctctgagctgccctgaagggggggtgtgcgtctgatccatgcaagggcgggctgtctggcaaggcatgcaggtacccccacccgcctctgccgccctggcatgcacttgcaacaggcccaggagtctagtgttaaggtaccagcagagccgcctagagagaggttacggtgagtggggagagagtgaacatcaccagactacctccggagaccgtctccagccaggcctgcaccgccgcgtggcgtatggagggaaggtcgggcactgaatttaaaacagacgacaaatacaaagttacacagcaatatgcgttcccaacgaggagagccaaggtcatccttaaaatcccaaagagaaagaaagtgagaaggcattcaggacagacgcctgtctggcaccaacaaggggtgcgagccctgatgttagcctgtgtgatggagaatcaggatgagaagagaagagggaaaacccaaggtagggccaccgccggcccagggctgcagagcgctccccagctcacaggccagcccagtgatgcgggtgctcatggtgccaccacaagccggaaacggaggttggtcttgcctacaagtgaagatttggggccagggaggaacaaacgtcttattaatgctgttttatgatggcaggaaatgccccttttgtatgctcagagcctggcagggggtgtggcccgtgaccggcgctgaatgaaaatgtgcacgcacagaagtgacagcagaggtgactccgagggtgggtatttggaagacagcatgccaggaaagatggcacagcggccaccacgtccctcagcagtctccacggtccttctcttattgctattcctttatttaaaaaagccagaataaggttcatcttcatcctactgtgtgacacagaccgtcacacctaaagcctggggctggagacgatgctactgtggaggcctcctggacagaaatctcttcccaagacttcatttcacttccaaacatgcccctcccgcccccttcctgccaacacacattcacgtccagacacactctaagaaaagtaccagaacgttttacgaagtgaggaaagagcagcggtgaccagaaacatgagagaaagacagaaaattcttggtttacccaagatcaggttcattttaccattttgcatcaatggagaaagagtccacaacctcttaatccacagagaacttcacatatcctcagatgaaaagtacaggtgtcacaactgacagcagcaaagcgggatgcgcctggctcccgtgtgtgacctcatgggtggctctgccctgacagaaaggccccctgtggcgacagaggcagcaggcgggtggtgctcggggcacactgcggcctggggctgggagtgtttacctccggaagcagaggactcagaggccggcgccatcctctcttcctcctctctctcacggatatgagtccagtgcacgtcagcctggatctccagaggatccgccgcgtgcatgacctgctggagcctctggttcccggctagtgtcccagggtcaaggggtggagaaatgaggtggggaaggaggggatgaaatagcatgggaaaggaaacagaaagagaagttacagcattggccagggtcagtatgaatcagaaagaagtaaaaattaagaacatgtatgcacatgtatacacacacacacacacacagacgcatggacacacagacacacacgcacagtccttctgctcattcagtgtgacctggtcatttccagccgtatatgtaccattcaattcagtgaagagaatcacacattcctttctgaggctcctttcatcctgagctgcattcagggggcccatgcaccaagatggaaaaagagcagattccagcctgcttctgcaggcccagccccaaggggtcacaaggacctgctttgtccctagcacagtgtgagaccccaggatgcactatcctgcccctctgctggtcacacagcaaggtgcccaccaccactcgcccagctgatggccaggtgacgagagaggtgggaagagattgtgtcattctgccgccagccggccagctcacacaggacagagatagactttgctggcacttcggtttgcatcttctgcagctggagctgctgctggagagaaaaagtccccgtcccttagtgggcctcatgctgcatgctgggtctgaggcaaggacacggatcccagtggagggtagagtcaggggaggtgatggctgggagggaagcagagctctttcatgtacgtttccaaacccttggaatttcacaggcgagaatgagaccaacagctctctgaggtcaaagccctcacctgagaactccatgtggtgccctgcttatcacctctggaaacaaggcctggtttctcagctacatggaaactcaccagtggcccctctggatccctgccctgtgggatccctgtacttagtgcttggaccgtgccacacagttgggttaagataaagggacagctagcaactgggaagggaaggtggctgttcagcaggtgccacctgatctgaaggattcgtgttcctgccaggagccagcttccatctgggaatgggtgacatgcctcctctgagtctaaccagacaatctggccttggcttcagtcactatgacagcctcttcaagcaacagggaatgtgaaatgggcagaaaggaccagcaagaccacccagtgtgatgctggccctgtgctctgccgtatgtggggtatcagcccattgttggagctgctagtctctatagatttgttgctggccctgcaagccgtatgtggagtattagccccttgttggagttgctggtctctatagatgttgctggtctctatagatttgtggactttttctgaggtgaatttgccttttttttttttttttttgagacgaagtgtcgctcttgttgcccaggctagagtgcaatggcacgatctcagctcaccgcaacctccgcctcccaggttcaagcaattctcctgcctcagcctcccaagtagctgggattacaggcatgtgccaccatgcccgactaattttttatattttttagtagagacagggtttctccatgttggtcagactggtctcaaactcccgatctcaggtgatccacacgcctcggcctcccaaagtgctgggattacaggcatgagccactgcacccggccgtcaatttgcctttctttatggtgctgggtgggactaagtcacagcagagtcacctaacagcctggatgcacaggactgaggaaggtaagtcaaagagtgcagggcctttctctaccttctcagcaacaaagagaagagacacattcttctctcagagtcctgctgtgcttcctgctaatacatgcagccttggggacttatcgacagcacaagccagcatttcctcctttctcagagaaacattaaaggcacctgcactggcgataggtttcctgcatcagagaaggagccaagtcttggctggagatgagcttgcagtaaaacatatgcggcatagatggggccgcattccatgaggccacttctggagccttctccaacttcctccagaacctcttctgactcacatgttactttgcgcctgactgtctgggcaggctgggaccagggagagtagcccagtgagatgtgtgcagagcccgtcagcacagttccataaaacacagacctttgtctgtgagacatgctcttggaggcaaattttggatggctgccagggagctggggtagaaggtgggcacggggtaaagtgggtacctttaaatgtcctcaaatcttcttcctgtgggaggtacctggcgccactggccttgcagttctgtgtcccaggggcagtactccccttctacagcagggggagccagagacccacacagcatcaggaatcccacagcgcgatcaagcagggagggaagagaagggagtagtggtgtccagccactgcctgcacaggcaccgtcggctgcccgacagacacacctgcgctagggacacaggctccggtctgggactctcggagtttggctgaatctgtcagtatgtgtttgtgtagttaaagctcttttcctacaggtttggtcttgacgttagcactaagtccaggaaattaagtctgcgtgaaggaaagctcggctcaactctcctgaaaagggaacgtgcttcgacccgaagctgtgccagggctcaaagctgccgagtgatcatcatcagatggagatgacgatgtctggaacagtgcaaacaaaacaccgtgccctggaccagctgtgcatgctcactctgctggctagcagaggccacgccggcacctggctccgcagacacggcagcatggagggagagcccagattcacagaccccatttctcctaaggcagacagggtgtggagtgcgggtcactaagggctgcctgtgggtcctgcccagcctctgcctcagagggaagagtagagaactgggagagcaggtccttagggagcccgaggaagtccctgacgccagctgttctcgcggacgcccaacggtgcggttccttctgctaacccacctcactggggccaacatcctggagctgcacagctcccaggggactggatcaggaacatgagccctgtcaggcaagggctcagccctgtgtgccagagaaaacagacccccggatgggactgggcagcaagcacacaggtgccaggagaagcagagatgagcacagtgccagctctgcagggcctggggtcactgagaactcaaccgatcctctgaccgctgcagggagtcactggtgctcagaaattaaaggtcatgtccttcctgctcactccacatctatcttttggggactcagatctccacctgccctggctccgtcttcaccaccccccagacttctgcgctgctggagcagagaaagaatggccttctctcctgcacaggcccagcaagtccctcctcatcacttgaggccacacacacccagagatggggcagaattgaaaaatctcaagtccaaggcaagagactatttcagaaccagccagagtggctggcccctgggcctgagtatcccttcaggacactgtccccaaaacgctgccctgcgtgccatcaactgagccccatccagtgggcactaagctcatagccacctccgaaaccctagactaggatcagggaatcctctagaaagctaaattccctttccttattaattttttcaactgaaactacagggcaaaaagagaaaacgaggtggagacaagtaggagtggcctaacttggatgagtacttggactggctctctgccttccacttccagtttctaaaccaatgtgcacaagggacattacttccactgccaaccgcctgctcaacgctacggtgtcctcccctctgccccccatgtcttatgtcaggaggggtggtccctgggctgtgcaggaggcacgtccgtgtgacgtcagccccagaaacctcttacactcacgcatgaaacagatcactttggggggcagggcagagttcggagcagagattttgttctgaccttcactggactcttcctcctcctcgtcatagtcctcctcctcctcctcttcatattcttcctcctcctcctcctcctcttcattcccaggcccaaagctctttgaggcctctagctcctcttcacttttccctttcagaagggcatggatccgcacggcctccttccacggaacaccacccaggtcagatgggggcaggcgaggctcctcctcctcctcctctccctcctcctccatctcagactcggaactactgtgaggaaataaccacatagccagagtgagggaatgaagaaaaactgagaaggggaaggggaagggccaccatcagaaacaatgcatgtcaggcaaagcagctgctgagcaggcggagagagacaggagggaggagagagcggcatcagcaggacagggtacctgggcatgagaagccacctacccaagcccgactaaggggacaaagggaagaatgcctcctgctcacagacctcacgcacttctcctcaggtggatggggtagggaggggaccaccgaaggctgcctgtgggtctggcccagcctctgcctgtggaggggagtgtgcagaactgggagagcagctcctcacggagcccatggaagttcctgactgcagccgctcaaactcaagccacagccccatccctcagggtgcttcaagcagcaaacactgagatcgctggtttacgtttcatagacggcctcgagggcacaagcagggcagtggactcattctgatataaacccatgaccctgggaattgagaatggaaagtcttctctcatcctggcccactgtctagttagaggaactcaattctgtgtgactgcggcctgtcagaagcctctcaggagagctgtgggtgtggtggggggaggggggacccagaaaggcctggacttaactggctgatgatcaaggtctgtgtgctggggtggggcgacagattccatttcctggcactccttagaaccctaccacgtgccaatccctgagcaggacactgtggggacacacagggaaatgacggcaaaggcaccgctcactgcaaagccacaggacagagacgatggggaaagggtggagacaaacctccaaccccagggccatcgctcctgccagctgctgcactgccaagcactcccctcacagctgcaggcaagcgtggccgacataggaagccgcacacctgtaagaatgcacatgccacaacggacactacccaaaccgtagctcctcgctctggccaccctcctgctgcagtgtaccccactcctgccctgtggagggaggcaggacaggaacaaaaccgggttccttgcaacctgtggggctccaatacacgcaaaaccccaacattgctgcacaaatggagatgtttctgagtgtttcgtggtctgataattcccaaagcatctttttcaggagaggccttgcctgcagtgagaggccgggggaaatcagctttcacgttaaagccatggcccgacctctggcccaacaaaatccaagaagcatcaggcacgagagggcatctgccctgacctcctgcgagggtgtgtcctctctctgcccaggcaggctctcccctagcctgcttgtgtgtgagagggcgaaccagtaaatacaccacgatgagcactgaggggcactgccagggcgatcactgccaggtgaagaatctcgccttgtccaaagagaggactccagcccttgtccttggctccacgaaagtaacctagacacgcctggggtgccctgcctatggggctgtcactgtttgccggagaccccggttcatgttgcatagtctagtaatgtgattagggtgaggctttgggtagcacggtatccagtgacccggagactgagatcaaccatgtggataatcaatcaatcattgcctatgtaataaaaactccaaacacagggtcttagtattgctcaggtgagcaatactcctggcgtatcgtcacacatcgagaccaagagagtacagctgtcctggccccacagtgagcacaatggaagctgagtctggttccttcctggactcaccctatgtacttcttcccttggctcactgacatctgtaccctttccctgtaacgaaccataaccatgagtacaacagctttcagtgagttctgcgagctctagcaaactatcaaacctgtgggtgattctgggagactccggaattcgccactggggtcagaagtggggcagtcttgtgggctgtattccctcttttcagctggccatttcctcactgtgccacaccagctctgctactggctggctgtgtgactgtgagttgattatttgtgctctctgagtttgctcaatgacacattcattcattcactcggtgaacatttctgagcacctacagctcagccagtggacaaaagaatatactgcaaggagctcagggtagtgaatcagcttcacttgttcatttacctggataaaatttattcaattatcttcccctcacaacgcacttgctagacactgtagggaacacaaaggtgacacagaaaagactcttatgctcagctgggcccagtagctcacatctgtgatcccagcactgtgggaggctgaggtgggtggatcatttgagcccaggagtttgagaccatcctgggcaaccatggggagacccagtctctacaaaaaataaagataaaaataaattaaaaataacaaaagctccttattctcaaggggaggaaaggtgtacgcacatcatgctaaagcgcagcagaacacaagcacggtgggcggagggccaggaggagaggtcgaaagtgggcaaacctaagaatctgggccacggaaaacttggcatctggattttggttatttttcagcattacctttattggtattctttctgccttacgcttgtgttttcattaatttactttcttattaatgaacaacaatacataacctagtgcatgtcatttaacactgtttgaacataaaataaggctaaggatgcatctatgctcatcttaaatcttcgctgggccaagggaaggccccctggttcctctttcccagctgagcagccggggcctgtgcaaggctgcccagcagttggcagcagggcagggccgcactgcagttcactgggagggggcctcagcacaggcctgtcctcaccctgcgccatgtcgtgaggatagctgcacaggcacaatgtgggcactgaatagatgccccgagatgaggccagcgaggccagcccacagccgtgtcgcaccagctggtttcacaacagctcaaggaccacgggagcacagaagacagcagaaagcaaccctcacctccgtgcatcagctggtttcacaacagctcaaggaccacgggagcacagaagacagcagaaagcaaccctcacctccgtgcatcagctgcaaacccagcccacctcccagacaccttggcgcttgcttctgcagctcccagacaggccaccctctcttcatgaaggacacagaggaacccggcaggagtttccaactcctttccagtccatgattttcaaaggactagggcagtctctgggttggcccaggtcctgtgcgtcacacacaagattcacagtgtgaattcagtacctcgaggctcccagcacctgcatctctggaggaaaggtgcagaggagggaggaagctgcagtgtggccgaccctttggaccttagcctggaaacttcttaagcacagaggatcactataccagaaacagatgcaacacagacaacttctccctccctctggggaggctgacttttcagaactgcctcccaggagggacggggtcagatctagtcatcaggatcaccttgccctcctcacaggatctgttttggcactggtgacaacgcactgtcctgtgagattgcttgattggggtctgcctcccccagggtcacactctctccaagggcaggtgccgggtcaccactgtgctcctcacagggccaagtgtggccaggacagcaggaatgtgccaggggctgcggtgaaagccagggcaggcttacgctactttcagagatgtcagaggttgcaccccgactgtcccccggtaaagcctccatcagaaggtgctggctattccagttagaagagcgtccagcaaaatccctccttgtctcagtttatacccagctactcaactcaaagcacctgctctgaatttccccccagctgtcttctcactgagacactggcagacctagcatgggaaagaaatccaacaggcacatgcacttgattctaaacagacaaggtttgctccacttcacgtgctctgcagtcctctgctgtgtcaagaggggcggatccgaggatgacagtgattgacggagggcagccctgaccgcgtgcccgcagcacaaagtgcttcccatgggtagctcatttaatcgcacaaatgctctaggtcacggggctgcgctgcttttataaatgacaagaccgaagcctaaggaagttgggtcatttgcataaggagaagtcgggattcccaccagggtccacacggagtcatgctgtgccttcctgggtgcttctcccagaacccaagagttcccagccagtagcctctgtcagggtggctactgtcaggaagaaggtcttgatcaagctcctgcctgcctggatgcaacctgagaagtgcagaccaggaattcaagcagaccctaccatgaaagagcaggctgctgccaggaaccacttgaagttcctgggtggtttttttttttttttgagatggagtcttgctctgtcacccaggctggagtgcagtggcgcgatctaggctcactgcaagctccgcctcccaggttcacgccattctcctgcctcagcctctcgagcagctgggactactcggcccgccaccacgcctggctaattttttgtacttttttagtagagacggggtttcaccatgttagccaggatggtctccatctcctgaccttgtgatctgcctgcctcggcctccaaaagtgctgggaattacaggcatgagccactgtgcccggcccctgggtggtttttaaagggcaatgggtaaccatggttttcacttttaaattaacctgctcataatcagagggactcaaatcctctgtcccgttgggccatgcccctaggttcccttccctgacaactgtgcaaaccctctcctgctgaggaggcggctggagaagatgcacatcatgcagcaggctttacacggtggaaatgtaatccatgctaaaactagcatcctgctcggcaatggctcaggagctgcctctgcaggaaaagggagtgaggcgggagggagagaacaggcagaaatccccatttattcatggccagccctgagggagcggccttctcccactcgtggtgttattctgaaagagcggccttctctcactttcgtgttattctgacagacagcaacgcctgccatccacttttctgtgacctcgcctgtgccatcagaaaacatacctgtgtgtgctagccctcctgacttctctctagagccaagaatgtggaaatgctaaagaacttcagcacgtgggcactgcaccagctgcctttgctgcccggggcacattcttccagaaaggaaggcagtcagggaaaacaacacaaacatcacaaagccagccctcccttggttttggcccactggcctttccagtgaaaacaaagctgctatttccagggtctcctccaggagacaggccccaccttgcctgcaaggtagaggcatgaagctgattaggcctgggccaagggtctgtgacaaggcttgggatttataggcgcttgtgtgactaaaccatgaattgattatgagactcacctggggggtctgttggacactgacattcctggcctccaccccaaacccactgaattagatactccagggtgcgcctagaagttacatttgttttgttttgtttttgagccagggtctcactctgtcacccaggcagtgaactcctgggcacaagcgatcctcttgcttcagcctcctgaggagctgggaccacaggagcgtaccaccacgctggctaatttgtagagactggatcttgctctgttgcagagtctgatcttgaactcctagacacaagcaatcctcctgccttggcctcccacagtgctgggattacgggtgtgagccaccatgcctggctgcaattatatttttagccaagcatcccaggtgatgtttattatcagagaaatttagaaacattaaagtggtgtttctcaaattgtggtctttggaccacagcatcacctgggaacttttgagaactaaaaattctggggctttaccccagaggcgctgaatcagaaactcagcccaacgtgttgtgctttcatcacaagccctgggtgactctggcatgggaaagcttggttaccaacattctcggacagggtgagcttgagccaaacccaagtcccggcatcaaccccgtttaaggaaaccaatacaaggctgcctggccctgcccctggccctgtggtgagggagacctgtgctgtaccaggagagtaacaggagcagtaactccgggcatcaaggcttcgtccgtgctttatacgacttaatcctcaaaacaaacctatgaagtgcagcacctttgcagatgaggaaactgaagcagggagaggttaagtaaattgccaacagctagcaggtggcagaactgggcttcaaatccaggctttgtttgactccaaagtcaggttctgaaacatcacgctgctgtcccctgcagcagaggccaaagttaagagttcactgaacttgtgaaatgagagttccttggctggaacggttaatgccttaaaatgatgccatttctcatcttccagtctaacatctcagcaaggaaggaccgacggctggaaaggcacccaattctgtgcttggtgctgtagggaagacagagaaaaacaccacgcacttcccgtcctgtgtcctacggccacccagggaagtaagacaacatttatagctccttcccctagatgcttttttttttttttttttttttttgagacagggtcttgctctgtctcacaggctggattgcaatggcatgatcctggctcactgtaacttctgcctccctggttcaagtggttctcctgcctcagcctcctgagtagttgggattacaggcaggtccggataattttcatattttttgtagagacggggtttcatcatgttactgctgctctcaaactcctgggctcaggtgatctgcctgctttggcctcccggagtactgggattacaggcatgagctaccgcaccaggccgggctcttcatttttttttttttttttgagacgaagtctccctctgttgcccaggctggagtgcagtggcacaatctggctgacggcaacctctgcctcctgggttcaagcgattctcctgcctcagcctcctgagtagctgggattacaggtgcgtgccaccacacctggcaagtttttgtatttttagtagagacagggtttcaccatgttggccaggctggtcttgaactcctgacttcaagtgatctgcctaccccagcctcccaaagtgctgggattacaggcatgagccaccacacctagctgggctcttcccttttttttttttttttaagatgcagtttcgctcttgttgcctaggctggagtttgatggcacgatcttggctcactgcaacctctgccttctgggttccagtgattctcctgcctcagcctcccgagtaactgggattacaggcgaccgccaccatgcccggctaattttttgtatttttagtaaagatggggtttcaccatgttggccaggctggtctcgaacttttggcctcaagtgatccgcccacctcagcctcccaaagcgttgggattacaggcgtgagccaccgcacccggctcttcacttttaagagactgtttttcattctgtatagcactgaatgctacttttaattatctttttttttttttttttttttttgagacggagtctcaccatctcccaggctggagtgtactggtgtgatctcagatcactgcaacctccgcctcccaggttcaagtgattctcctgtgtgagccaccgtgcctggcctttattttattttttgattttaattttaattttttttgagatggagtctcattctgtcacacaggctggagtgcagtggtgcagtggcatgatctcggctcgctgcaacctccgcctcccaggttcaagcaattctcatgccttaccctcccaagtagctgggattacaggtgtgcaccaccatgcccagctaatttttgtatttttagtagagacagggtttcattatgttggccaggctggtcttgaactcctgaccttaagtgatgtgcccaccttggcctcccaaagtgctgggattacaggcatgagccactgcgcccagcatgaatgctagttttaaaatctttttttaacttcaatctgagtaagatgaggcatgtattgcattgcatagatgctgactgatttcatgttttctgtgctgccctcctgtcatacctgccataaatgccaggggttagccttcctggaatgtccttgctacattacatgaacttgctgccccactgcctctcacaatttataaattacagtggagaaaatggtgctgacccacactcagcccaaggtcaagccagtagctctgctcaagggtttataaatgtgttttgacacacagcatctctcaccctcactgcagggtcagtggagagagagagtgggctccccctcatctgggcacagtggggagagtggggcctccatgggtgctctggatagggaagcagagttctggatgaggatgcaccatcagtgacagctttggaactgcagacaccaaggcagaggctgcccccggcatgcacggaggagcggtctgtgaggcagcccaagaatgaatctaggcagagggtgtctgacatgagggctgaggtggcgggtgcagctgaaagcagctcggcccagcaaacaccttctggaaagcgttcttggaccttaaaaaaactgctctgctctccttatccccacatgttcccttcatcatggctaaatcaaggtgtgtgattcaaatgctctccaaggccacttgaggcctctgcccctcgggtttgcagcctgtgtttctgtcctgaagccccacaggacaccggacccccttttgattcttggctctcttgatcatctgtaatcggctgaacactttgaagccttcgctgatactggaagccctggggtgcagggcagtggatatagggagtcctagggttatagcatgcacatccccaaaggtgtcacccagctggatgtgattacagctctggaactgcctaagcatgcatccactggtgctgcatgcggcccctggggcacacattttcagtccctttctttacctacaggagaaaaaaagatgcctgggggacggactaggcctccctcaagacggcccggtgcactggtggctgaatcacccagagtccctccccgtgtgcccgtccttccctctgctgaatctgtgaataacccgggggcagagcctgccactttccttcccaatgacagacttggagctggggacatgtcaggtcctcaaggaataaatacttcctgaatctctgaattgagtctgatggaggagtcctcactgactagaagatgaggctaagaacctaaaagggactggggagaatggactgcgggcagcaggaaagacaggaggcctcccttcactgagaagaaaccgagacacacagaggtgaggaggctcttagggccgtgtggcgggtgggcgccctgcagccctgcgtgctgacctgctggcgacgtcctcctcggcgcccgtgtccagcacgctgctcaggttgtgctcggcctgagtctcctccggtacctcctgcagtgcctcagcctgcctcagggacaggcggtagttctccagctcgatccgctctggggtgcccctcagtcgcttggcgatgctgggctcctccaggccgttcacgcctgaacctgcgggacaagcacagaagcactgcactgaggtccaaccacagacggggcgtgggggtgggggctgacacccaggctgcaggccctcctgccagaatgtggggcaggacaaaggtcagagcatttgcagagttgccagaggccagagaaggaccctggcatgtgagagggaatttcactctgcaggagaaaggaaggtggccctgtctgccctccaggtcagagcgttctctctccttcatcaccctgaacccggcccccagaggggagacgcagtctccccacaagagtgactggtggtgaggggtgtgggccagaccgcaggcagccaggagccaggtgcccctgaagcagccttgcctgagaagggcatccccggtgcagtctgccccagggatccaggcccccaccaggtgcctcccccaatgcctgccccgggatccaagtccccaccaggcacgtgccccaccactgagggggcctggccagctgcctgaagaacgtctcatgctgcggatctgtctcctcacagttagataaggcactttcggtttcataaggccacgtgggcgatgctgcccctaccgcagcaccgctgctcagaggaaggacaccaggcccgaccgctcacagaggtggcacccaggcctctctgcgatgcacaggcacacttccccatcagtcctccgtgggcttctgaagccacggggtgccctgcctgcgtcctttcaccctgtggtttcagcatcgtcggcgatcttggccggagtcctttgtgtgcacagggcgtcacaccaggtgattttaaaatcccatcactctggctgggtgcggtggctcacgcctgtaatcccagcacttggggaggccgatgcaggtggatcacgaggtcagcagatcaaggccatcctggctaacacagtgagaccccatctctactaaaaatacaaaaaattaaccaggcacggtggcgggcgcctgtagtcccagctactcgggaggctgaagcaggagaatggtgtgaacctgggaggcggagcttgcagtgaaccgagattgcgccactgcactccagcctgggtgacaaagcgagacttcatctcaaaaaaaaaaaaaaaaaaaaaaatcccatcactcctcctccactaccattctttggtaaagaagcacttttcccatttttaactttatactttcaagtactgctatggactcggatttttgaaaatgtgttttacaactgtgctttggtctcctttaacatggaacagttctgctgcctcccttatcatcaccactattctctgttgacgtcccttgtcctcctgatcctggtcagaggaggctgtcatgagtcctctggtgtgtcccctgtaatgtgagtagcaccgggtccaggtggaggcgggcaaccccaggtcagatttcctcatcttccagatgcctggctccaccagtagttggctgaagggtcttagaaaatttacagaactcctcagagctcgtttcctgatagataaatgatggcaccacccacctcccagagccgtcatggacaccgagtgacacgatgcacacatactcatgtgggggtgcgtgttgaccctgcaccccacacacacggtcaccttcctcttccacttaacgcctgccacctggggagtgcccaggaaacatgagtgaagcagcaagtctggtgtccagtaatatttccccaccactgtgtgcatactcctggaaagctgcatccacaggctctggagagcgaacagtcgttactgagaaacagggctgaggcacagtgccatgtggtagcagcctggtgttaccagacattttttttttttgagacggagtctcgctctgtcgcccaggctggagtgcagtggcacgatctctgctcactgcaacctccgcctcccaggttcacgccattctcctgcctcagcctcccgagtagctgggactacgggcgcctgccacagcacccggctagtttttttgtatttttagtagagacgggtttcaccatgttagccaggatggtctcaatctcctgacctcgtgatccgcccgcctcggcctcccaaagtgctgggattacaagcgggagccaccatgcccggctgtgttaccagaccttcaaggaggcagagaaggggcagaggtgctggagggagcaggtcatgactgggctggcatcctggctgggcaggtcaccgattcctgcaacattctaagctctaggagacaacgctgggttttggcatgccacatcatacaagccagtgttgagagacaggtggtccatcaggcaaaacctggctaaaggaaagcggcaggtgattcagcaatttttgtagcacgacaggttgtgcacaaagtgttttctgaaggcctgcacttctgttgtgtgcagtgtttgaacgtctttgtggcagcctcagacagagcttttaatgaaccctggtagtcacaggataaggtcttggcacatctgttggaattactggcatcctccaccaaatagcatctttcgaattcactagagaatctttactaacaaagcaagatccagtggcgtattcacatacaaattcaggtaatggtgtgatgaaggggcaaaacacgaatacttgagttcacttgtgccctgtacacgtgcccacttgttttagcctttgcatccttgctgggggacctttttaaacatcatgctccattcttcaacaccgagctcagggcacaaaaagaatatgctatgatgctgggctagggcatcttgaagatgaggaaatgtggactagaggtaatggcagaaaagaggcagagggcaatcctgatagatccggcctcaagtttctccaaacctgccctcccaggcctgggacagcaaaggccctaactgcactagctcatcattcccaaataccagtcttcccatcccttccttctcctcatcaaaatccatggcggccaccccataatgaacaggggagggctgaggatacactgtctgtggcgccatttgattctttccatcatttatttttgacaactgccattcaatggaaagcagatgagaaagggagataaagtcaagcaactacccaagaatcagctttctgggaattccataaatacggaacaaaaagtggtatttcttttagatgggagaagaaaaacaggataagaactatcacttcagggaaacaaacaactaacagccatcaattcagagggaagtgattttacagtagagtgaacgaaacttgggaaggaaaacatccaagaggcgtctgtttgacgtgggtaacgtggggaacgcatactgtctggcaagaattctactaggaccacgggaaacaaagcagattaaaacactctctactctaaaagagcttcagtagcacctgggagagggccctgcaggaatcctttcggtacgacgtgtcaagtaccatgagccacgtatgcactcatgggagaacatagagagagtgagtcagcacacctggcagagtcaagaaaggtgttctggaggcatatggagttagccggctgcaaaaaaaaaacattctgtgaggtaggcactatcatttgcaaatgaagtaactgaagttcaggtcacacagctagtgagccctggagccaagatctgaacatgaggaggaaaggcatcactcaggagatcaccatgctgtcccaagacttacaacaagaagaaaaaccaggcacatgttcgcaacagccctatctgccttcccctttgggcatcttcaccattgtctcctccccactgtaattttctaggtgagggacacagcacttcatgaaagcttcttggagcagagaatctggcatctggaatgacagacactcagtcttcccactgttattgccctggagattctgcaaatcccgcagactaatgggttgtcaggcaacagaacttggcagtccaagcccagggccagagctctggaaggggaaatgctgatttaattttgggcttggctacaaccaacaaaaaagaaaccagaagcactgggaactgttcagatccttcacacgccagtccctggagaaagcctgcagaaatgctgtgctggggacggtggaaaaggggagctgggaggcagcagttgcctctcctgtgccagacccaccaggccattgagccaggtccacacagagctccagctcaccctgtggagagacaaggacacggaagcacactggcaggccattgccgggggttcagtgtttccaaagggaaggtggtactcagaggacactgggcaaggaccccaaactcaccaactgccaaaatatgctccacattcccagcccttcacctcaaaataccatgggaaattaaaaaaaaaaccacacgcacaaacacatcggaacaatcagcatccttgattctctgtcctgagcaaggggctttctgtcagatgaatcaggcggtgatgagaaaccaagatagtgagagcggtaacagcaggggcctgggcagcgaagacagccctgtgacctcctccctcatcaactaatggcagaacccaggaggagagagcaggagtgcagatgtaaacaagcgctttgcaaggtgctggattgccaagccgaagtgcaccccgcctgtcgggctagctggccctacctcccgccctctactccacatgccttagtgcaacaacagcccaacagggactttccagcttaaagcgggatgaaagatctgcaataatttccaaggccaagtcttcactaagtcagggcaggcagctctcaggtcacagggaggccaattacagccccacacataccacaaggaaacagctcccaggatctgggccatatcctaaataggaaagaggctctgggccgcacctcaggttctgctttggaagagtcactgcctgcatgagctccacacatcattctggaagaaacgtttctcctaacaggacaacctgctctcggctgctgggcaagagctggcagggggctttatttgcttccacctgactcctggagaggcatcggcgggtgcagaggatactaagaggcagggtcttcccagggcctcagcaggcagctcctcttcctcctccctgcagtggtggcaaagcccccctgtactcggcacagcagctgctgaagacacttcagggctccgcgccgctgagaagggtgtcgcgtaggaaatcaggatgtcaagggcctcttctgcctctttctggcctgtcctcccacttctttttcctttccttctttatgagcttgggaaagtttgaatggaatccgagtctgacaaggactgaaagaaaggtgctgtgtacacagactgattcccatcctgtttcccatgtctgtaagtaggatggctgcaggggttcattcatccaatcactgattcaacaaatgtttcttcaccacctgcttccagccagacaccctgcaggcgctcaggcacaccagtgacacagcagacaagatctgtgccctggggcagcccacattctgatagcctatgggtgtcacccatctgctaagagaggctgatgacctcagggagataaaaggggccgaccgtgaccaccttccggcgtcaccttcccgcaagaatggcgctgattgaaatgactcatccatttgagaagtgtgctcctgccattttggaattcagagattctccttaagtagtccctctcattcctactgtttttaccaggcggtactgggtattttcgctgtgactctgaagaaagatcaactaacatcattttagcttggttatttctcttatttacgtttttgtaggaatagggtctcgctatgttgcccaggctggtcttgaactcctgggctcaaacgatcctcccagctcggcctcccaagtagctgagattataggcgtgagccaccacacccagcccagctaacgtcatttcagctaccttccccatatgtcctcccaaagccttccctgccccgatcttcttgaactaaaggaagcaccaagccatgaacccattctgaaccgcaacgtctcaggggagatgtaaggaagagaaatgtgaagaaacggccaggttggcagcatgagcctaagtttccagatctgcagcaaaatcggtcacagtgacgttcgtgctgcctgatccacagttctcagaaactcacaaaatcaccctgggaaactggggtgccctctttgcacagagtccagatcatggacagggctgtaagcgggatccatgcctccatctgtttgatcccgttcaagttggaaacagtacagtccctatgttctcccacacgtcctcacatactgggaaacggggatgacaccacgtgaagtgtggctgttccgaaacattcggaaccatgtctggcccagacattttccagtttagggccaggcctatggaatgtatgaagctgcagagggaccccactgccttgatctgggctggtcaaaatacagtgaagaatcagcttggatactggttcactcctatcttgctttgagctaaagttcccacaggagatcccattggcaacatggctaccatcctgacttagaaacctaaagtagtgggatgggtcactacctgcctcggggacttcaccactcctctggtcaagctgcacatcaactggtatctgcgggagaagggctctagcctatttttaggagaagtcacccctgggtaggaaagattcagagggcttattaaagggccctacagtgtacaaaaggtcttcctgcacttattctcaggcacctggtgccatcaacttgggcttttctcctctgctgccccattcactagccttagaggctgcttgatggggctcacatttttataccgttgacagctatgttctcattccaggagggcaagccccagagccatgtgtggaaaggaagtttctaagccactgctatgtcagggtggtttctatccccacacgctgccctccaacaaacttcttctgtggcttcctactggcagggagagtgtgttcacaagagttttccaagatcacatgatatgaggtatttcttgcttgtgaagcaggcgatgagggataagcagcagtgtttgttgagcgactacctgtgccgggcacgacgacaggcaggctctacacacggccttaaacatcacaaatcccacaagtccctgtgattacattgagggctctgagtcagtgatgttgaataacatgtccaaagactcacatgagccagagctaaggataaccctagtctctaagagtccttccaatcaatcatgcaggaaagaatttgtttttgacacagggtctcactctattgtcccagctacagtgcaccggtgcaatcatggctcaatgcagactcaaaatcttgggctcaggtggtcctcccgtctcagcctcctgagtagctgagactacaggtgtgcgccatcacgcctggctaatttttgaattttttttagaaacggggtcttgctatgttgcccaggctggtctcaaactcctggcctcaagtgatcctcctgccctgacttcccaaagtgttgggattataggcatcagccactgtgcctggcccagaatggaatgtgtgtgtgtgtgtgtgtgtgtgtgtgtgtgtgtgtgtgtgtattttttttttttttttttttttttgagatggagtctcaccctgtcacccaagctggagtgcagtggtgcaacctcggctcactgcaacctccatctaccaggtacaagcaattctccttcctcagccacccaagtagctgggattacaggtgtgcgccatcaggctggataatttttatatttttagtacagacgggtttcactatgttggccaggctggtctcgaactcctgacctcgtgatccgcccgccttagcctcccaaagtgctgggattacagatgtgagccaccgcgcccagtcccaggatggaatttttaactgcctgctacacatgaactattcttcatttggggtaactttacttgtatgtcggggcactgagaatagtgggaaagcaggtgacatgggctcactgggaaattcagttgctttgaagatacttatcagaagaattgggaaattctgagttaaatacaatatgctagagaggccaaagaggaaaaaacccaatagggaacaaaccagttctgtaccagggaaaaccacccaaatgggaggggggccacccctcagacccaaacactgtttcccaagcatgccgaggacacccctgcagtgaggacaccgctaggggggacaagagctccccatcaccgcagtcctttgctctcactctgtgtgaccctgtggaacttttgcttttgaattagttttttttttttttttttttttttttttgagatggagtctcactctgttacccaggctggagtgcagtggtgcgatcttggctcactgcaaacctctgcctcctggattcaagtgattctcctgcctcagcctcctgagtagctgggattacaggcgcctgccatcatgcccggctaatttttgtatttttagtagagatgaggttttaccatgttggtcaggatggtctcgatctcctgacctcaggtgatctatctgccttggcctctcaaagtgcagggattacaggtatgagccaccgtgcctggccgagttagttttttactgtcaggttatttttactgttatgattacatcatctcccaaggtgcctttttggcaaatggaaatcctggtacacatcaatgtatctggtcaaggcaaagaggtttcttttaagctacaagcccgactctccagtaacatacaactcaccagtgtgtcatgcggctctcctgaaaacgtatttttcacgtgttataccatctcacaggtaaaccttgacttgatttgtatcaactggccaggccatccttcctgatggctgcttcttggcgttgggaggctgtggacatgtctaaagcactggaattcagctgggtctcctcttaaattgcacgagtgctgcgctctagctgtctaccttcattacctgcccacctggatgtagctgggtaagatctcagaaagggtagcggttatgcgctgggatttgaaatattttaactctttggttcaaatacgtggctcgtgaaccgggaggttccatacagttacataacaagtaatctgtcaagtcaatagttgcagggctgatctctcaaatcctaaggggcaggtgaagacaggaaggatggcttcccccctacttctgccgtcgttacccgatcctgcttccggctccacttgacacccttgaagggcttttatacacgtctttattagggcatctctccccttctgttcaggtctgaatggactttaaaaccagaggctctgctggggagagggattattctcatcatctttgtgttcctgaagccatcagtgcatcagggtaggcagtcaataaagtgttttgaataaatgatcaggataaagagttctaatcctctgtctgagcttcgctccactataatgttgagcatattctggccttggtttcctgatcttaacacagagacttcatgaccaccatgcctgtcaggtagcttggtgctacgcagttccccaagaacaaatgggaacggccgcctcatgaaaagggcaagtctaccaagacggcaagagttctcacagcactcaggagagaaattctgacgaagacgccaatggcacagaggacatcaaagttctgaaaagagactacctcgaatggctcgatgtcctgacacaagcacttcacttcacggtagagaggagtttggttccgggaagcagcttgctcaccagaaaggggcccagtgttgacacgtggcgggtgaagggcagaggaggacatgggtcagcacgagcaagtccaggctgacgtgctttccccaagactccaggctctattccaaccctcctgtcctccagagcagagtgcccctgacactctcagtccggaatgcatccaaagccagctctgatgtgaccctcctgtgagcagccacacagcctcaggcaggctcggtctacatcgcaggatccacagagacaaacccacgttccaacaaaaggcttctcttaaataggttcagatgcctttcttttaaagacacaaaatcacatatacatactcccttggctagctgcagatgtgtttttggaaagaaactaaagttgcctgccgcagtgcccatgactaccctgtaaaacgtcaatcacagtcacacttctgttttcacctgtcagagggccactgaggctggcctggaagagaaacatcgatcacagtcacacttctgttttcacctgtcagagggccactgaggctggcctggaagagaatcattagtgtctcggaatggagaggctctaaacaagcagacagacactaagaacaaaggctgatggtgcaggagcgcacagcccaggctcggggcaccctttctacagcatcagcagcagctgagcagctgcgggtctatcatcacccataaaacacccattggtgcactgattccaagaggaaatcaggtaccctcctttcctccaaaggggccacctgaggctcctgggtctaaccagcaaccccagacaggccctgggaccacgcataaacccttgctctgcctaagagaaagctacctggctcctactcacatttccgactttcaggttaggagttgaaaatttagcttaatgaaggccggggcttggtggctcatgcctgtcatcccagcactttgggaggctgaggcgggaggatcacctgaggtcaggagttcaagaccagcctagctgacatggtgaaacccagtttctactaaaaatataaaaattagccgggcgtggtggtatgtgactgtaatcccagctactcaggagactggggcaggagaatcgcttgaacctgggagatggaggctgcagtgagccaagatcgcactgctgcactccaccctaggtgacagagcgagactccatctcaaaaaaaaaaaaaaaggaatatttagcttaatgtaaatcctgtgtaggactgtttgtgcttttgttactatagtgaagagcccctagggtgtcatagaatcagtaggtgacttcacatcccattcacgcaggctgagggaaaaagcaatgccaaatttagccaagcagccatggagatttaaccgtgcttcacaacagctggcacgcaacgaaggtccactcccccagcccactctgctgcagcctggagacagccaagctctcacctcttctgcttcccccagcttctgttggctgaagatatatctcaacgggccaccttgtcctaaccccacagcaggcacaggccagagagggaggcccgtacacagccagtagaaatgattctaattcaccctcactctaattcttccagaatttcctggaatccttgccaatgacaatcacatttgatattcttgtaatgcttttaaataaacaagtttcatacatcttaacttatgcgctcttcacaacaactttagcagacagaggagcaggtagcatttttcttcatttaaaaattttacacatggtgaaactgaggctcacagaggttatgacagcaagcatgacaggtggcagaactgaaactcaaattcacatcttctgtttcaagatctgtgctggttccattgagacccagctccactctctgaggctggggccaccaccaaagggtgtgcacatccactggggtacagaaacaacacaggatctctgcttttattttgcaggtctgccttctaaaatgatctgcacccgcccgtcctatggcatgcagtcttcgtacagggtcccgacgtgtgagaaagcacagccactaggaagtgtgttcacggttttgtgggggctgacaggtctggaggcctgggctgggagctggcaacactgttcaggatcacttttctgattctcaccatcctctatcctgatggcctcctctaccccacgcccacttctcccacaatataactgaggctgacagcatgtcaatgtcatgtcctttcttctaaccttagtctagatccgtgattctcaactggggtgatttttcccctgggtcacttggcaatgtctggagacattttctgttgacacagcttggggaggggggtgctactgatgtctgatggggagaggccagggacacacccgacacaccacaaggcacaggaagccctcacagcaaagcaggatccagcccaaaacgtccacagtgctgggctggagaagccctggcttagaagttatatcaagttatttctaatctcttaccaaacaggccgaccaaccaactctccacaaggtctgacgtggtaagctcacgacccttcaccgtggctgccaaggtgcaatgcctgaccagcaggagtgcagtacatggaggaccaaccgagaactgcctggtgaacaggtagctctgggcttgccgtccacagacaggaaatccatgagagaggtgcatgctgtgacaaacttggtcactgccactcgctgagcacctgcaccccaagtagctgcatgagccgcctgaactttcccttgtctcatgacgcgactctactgatggaaggtgattctgctcctcctggcaatgcccctggagggcacctgcacatcccctacccctccgtccatgtttgtcatgtgcatgaggccgcaggaattaaaggagaccaccagagatgaatctgatgggcttctcgcctttcactcactttctcctggctggatgctagaagcctctgacagacgggacgttccacttggatattacagcaggacgtctcactaaacccaggaagaaaactgacgggagaacatggcatggaaaaacacacctacctttgtgctgtgttctcaactcctctttttccccattttccagaaacctccaacctgagagctctgagtgcccctgccacagtgtgccttgccgaggtcaggccaggccgtgccacacatgcccaggaggcttcctgaaaacctctctatgccgaaccatgttgcagctggcaggcacaaccaggacttcccatgcacacttagcccaaagacttacgagtcaatcactttacgtgtgagttcagtacagagtggcccaagcctgagtagatcagaatgtccatattcagcacaaaaagaggtacaaaatcatcccttccttcccctatccctaaccctacagaggcccagggcaggcaatgtcttaagaggactgtgaatggcagctgtgaagctgtaacacaatggaagtgtcagctccaccttcactcaggcctttgaaacgtatcagaaaatgaggtggtagaggaaaagccaacagatttataagctagaagcagttacaccagaactcaaagaaaaaacatcccccaagcatgttccccaatcctccacatcactggcagggcggacggatggaggaagggcttactcttcataacaaaacctcaggctggattcgagaggaccaaaacgaaggatgatatagagaaaatgaagagaaagtccatttcatattatttacagtcaattcggatggttgtcattctcttcctccatttctttaatgacttcccccattgcacctcagtgatgaaatcctttgcctttatttaatgtgctgtctttccagaggcacattcccaactctgggatggttgtcaaattgggagacctgtattttccaggaataatgaaatggaaactcactggcttctccagggcatctacacatagggttcttgcctctcgcccacgctgccgagcccaggctgcagagaatgatgaagggcagctcctgtgtcctctgcacagcctctgcccaactctgagtttattggttacgtggccttggccaagcctgcctaactcctatgtgcctgtttccccatgtgcaacatggggcctgcctcccttatggctgctgtgaggatccaaggtcagctacacaaagcatctgctcagggcctgtgcacagtgcgtgctacatgttagcgaccgctgctgccgctactgtgtgtctcccagcatcgtcttctgtgagtgagtatggcaagggcccccagggctaactgatcaacatcagtcacatgtggggaaaacagcaggagtgacggcactgcaagctttactgtcaatttttatttggggaaagtattttggcagagaagagggctttcttggttgcaaacacagacaagccctaagcatggtcttttgagcagcatgaaggattgctgctggctctcggcaacacagcaagccagtgcggactcttacctccctggcccttcattctcctctctaagcacccagtgcttcctgtttctctgagatcgcagagccctcttccctgcaccctccaccccagcgttcccgtgcctctaccaacgccaatgccccaagaaggctgaactggccaaaaggaaggcagcagctggttcagagtaattcacgttagatgaaactctagaagaaaatgtttacttttttttttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcccgccaccgcgcccagctaattttttgtatttttagtagagacggggtttcaccttgttagccaggatggtctcgatctcctgaactcatgatccacccgcctcggcctcccaaagtgctgggattacaggcgtgagccaccgcgcccggccgaaaatgtttacttttaaaagaacctactgacctagtctctcggtagtaaaatgataggaaagaaattttatagctggtctcactgtaacctggtctttttagagtcttagttctggggaacagggcaacaataaataaattgctgccataatcctgttaatcgataccagctcttccttggtcaccaggttgtactttgtccatgaaaactactctggcaggagtccccaccccctgcgctgtggcccgggctgggtcatagacccaccgcctgtcaggaaccaggccgcatagcaggaggggagtggctggctagtgagtgtcacagcctgagctccgcctcctgtcagatcagcggtggcggcacgagattctcccaggagcgggaacctattgtgaagtgagcatgtgagggacccacgccgcatgctccttatgagaatccaactaaggcctgatgatctgaggtggaagagtttcatcccaaaaccactgcccaccccagtctgtgaaaaaactgtcttccacgaaaccagaccctggtgccagcaaggttggggaacacggcctgcggcgtggctcttctcccgcaggtgcaggagagttgatcacagaacacagaataaggaaatcagtcacttaacagtcacacctgggcagtctcatgtgattaatgtagaagcacaaagagctgggtaagtacagaaagaaatagagataaagaaaacacaagaggccaagagaagttctgtaaggatttttctagtagctgtcccagcatggccccaagagtctgcagcaaggcggagctggggccctagattccctgtctgtggaagggtgttccaaaacttcctttcatgccagcaagggccttctgaggggcgtgtgccttcttcccgttttaggcacattctgcctatgcacggcatacttcttattgctgggaggaaaagcacatcagtgacaaggttgggcttagctagcctgagttagggtgaagatgctggcagtgattcaacctcttgcccactgtccttcttggagacccattaaagggcccccaaaatattcagaaagtgttcataaactgcttttgcaaagtgatgtggaagttggcccacaggaagtaaaatggagctggtgttcacgtggctggtagaacccggaagtaattgatggagagtcccatccacctggaggcccgcatcccctcccgggcaatgaaacgtgtttctgcgtacaagcctaccaccccctcccgccaaggtaagcggtgaggagacaaggagcaattataaagaaagaggtgttggcagccaacagggtgctgagaattccgggcggtggtgagaggagcccacagtgccatgacctgacctgggcaggagtgccaatgggcctcaccaccccttgtttcattatgactaatctacttgctggcacttgtgaggcgcttggctgggtgagctgcaaggtaagggctggtttttgagtctaaaggaggtttcagggcttcgtgaaaggggctggaattcggaaagacttctcctgaaatctctgcctggctgctgccgttcagagctccacatgggtgtttttatctcggggagcacttgtgggaccgggtcctatacggcatcatcctgccctattttttagcatgaaaataagagtggcccattttcacagccgctctccttccatgtgtgtgccacggcctccctcttaggcagtgtgttaattagggaaactgacagggaatttatgagaaaaaagaacagatttcaagaagtttcagaaggaaactgagatccaaaagggattttctggggtgttcccaatgggcagcacagaatcacgttgggtgtccccaccttcctgctggaagcctcaggcatcgctgtgaacagcagtggtcccctcccctttattactgggggatgggcaggcaacagcagccaggggctgagatttgaaaattatgcacacgtatgtatccatccttattactgacgcttagttaatttgtcacttattgcgccccccacatcccaattccttctctcccttctgcaggcactaggatactgactgacttatttcagagaaaggggagccagaggctacagacctggggggctgaggggaggaaggacatgagcaggccaggagacaccgcccagactctcagaaccatcgaggctctgaggaaaatgacggtgtcacagcagagctgtgagctactggggggtgaggccctccctaacctggactgtggttgtcgagaatgccaagcagaccccagggacctgctgctctgatctatggggaagccaagacctcttcacgttccaagagagctgcttcagggggacggaggccagagagggctctttcatgtgagaacacccaagtgcctagggcccggcaggtgcagactcggggctgagtgctttgcccactacagcacagtgccctctcttgggccaattcagcatgaggctaggcctgtgcccactgcagctgacaaaatgcgggaacagtgccacggctgctaatgccagcagcggtgtgtgtgagaagggaatagtctgtttttaatgc[450 bp omitted]ctatgtcaggtataaaaacctatttcccccactttgcacctctgctgtcttgctgaccccccggagtgggagtcctgagccacagtggcctcaagctcactcccaagacctgcctgagcctccccctttcccaccctctggtcaagagaaagggaaggaaaagaaaaactcagaaatccgaagattgtttggaatttattctcttaaataagaatgtaacatttgttaaaaaaaaaattaaaagcacgacaacttggtttcacagtcaacggcaaaaacaaagttacacaattaaataaaaactcacaaagaaacacaccaagaactcacaagagcacaagttaaaaacaaaggcaaaaatggaagtggagagaaggcgggcagtagacaggcagcagtggcgtgttccttggcacagctaatcctctcctgttgggctctcgtaccgccgccgggaagccggctggctgtccgcccctcccgcaggcaccccaagctgaatggctcgggagaaaagtgaaccccttggtgccctgctcggaccttaaaggctatggtggaactccttttgggacagcctaggaatgttccagtgtcttgcagaaaagagctgaagatgcactaaccaccaaaagataggagtgggctcaaacggctaactcagtggagccagacaggagacatgtgaggcgggtgcccggctctccgtggtgtcctggcagcagcagccccctgcgttcctagtctgctcttggggccctttcttgggggtgtgctgcccattttctgagacacccacccactcacctccttacaggcgtgctgcccgtacgctgctgtgcatccccaaagccctgacctggagtacggctccccagtgtgaggctcccgtggttctcagaaccaggaacaagcagctttagaaacagcttcacaattattataattactataatttagggtgcaacatataaataaatatctacccatatatgtgcaattagatctatatacatacaaacgtgtacctatatataaacattcacacatcaccgtcagctatggctcttggggtaaggtgggaggtaagctggattgtagaattctcttgctccactaaaaagctttccataaatgcctagaagggaaggggacgtgggaagcagtaagacttccgaacttccctctgtcaggtgggaaccctagggttgaatgaaattctactgcctggctacccttctagctggtgtgggaaaggcctgcatttcctaaaggcccattcaggatccgaactatggaacctcatggttatcgggcaaggaatgtctggggacaggggtcaggcaactgccacttgtgaccttcattttttaacttcagatcatcttttccataagatgacaggaaactaacgtgcttctccccgtccatctctggccggtaatgaacccggtgatgagcactcggggaaaaagctcttctgttcctttccggctatgccttcggcttccctacttcatttttggtcatcaaccgtatcagataaaaagaggattcctctggacaaaaacgaattcaagaaacctgtaactaaacttctcatgtccaaggggaaaataatcccttttggggatttcctttctctgcctattgttcaagctttttctaaagtcatggtggacagtacaaggccagggtaagaaaatctgtgccaggaccactaacacgcagtagtaagtataagcttggaaacacagcattcatagatttaagaacaaaaaagaggatttctatattaaaagcacattacaaacagaaatactgtaaacaatgcccccaaacactaaattaggcagcaggtacagatttggttaccagagaaagacaatactttaaagccgacctagagtggttctttgaactgcaggttgtaattgggtgtgggtgtgtttttttgtttttgttttggcaacagcaagaattttggcataaaaagaaaaagaacataaaggagaagagagaaatgccacaatataaagaggaggcacagagtaaaagcacagctgggtcaaacactgcccagtcatagctttaccagccctgcctcctgggacgtgggtctagggaggatggctgagttacacacaagagaatcaagtgccgtcatcatcgcctctactggtcgagtgcacagtagaggcggttaccatgggcctgagctaatgactgttctctacaacatacattctgggaccctgaaacacctgagctttcccttttcttcttttttttttttagatggagtcttgctctgtcatcaggctggagtgcagtggtgtgatctcgacttactgcaacctctgcctcctgggttcacgccattctcctgcctcagcctcccgagtagctgggactacaggcatccgccaccacaccacacccggctaatttttttgtatttttagtagagacggggtttcactgtgttagccaggatggtctcgatctcctgacctcgtgatctgcccgcctcggcctcccaaagtgctgggattacaggcatgagccatcgtgcctggccacacctgagcttttctgaaacttttcaaaaggaagtctagttaagtcctcaaagcttcagtttcatatttaaagaaggaaatctctatcaaaggagaaaagggtatctatttcatgccagccataaaatactgcccataatcctgttccttttctaccaaggctagcagcagagtgagctcaccgggaggcaaggtgccctgattctgagctgccggactaagatgttctggactctgagctgccggagggtaagcccctcagccctgagctcactggcctttgccacccaagctgggggacagtgcctgtcattaactgtaaaggtccacactgtgattcctttgggacaccacattttgaactcccgtgctataccaagtcaccttctggctcagaatcaagaaccacgcggacagagacgtcctcagggctctgactctttcttggtggttttgctctttaaccacactgccaaccctcatcctctctccccactatgtagaacattcttcctcttattctctatggaaagcgtaattctttagaactcctaaaaacctgaaacccattatactttcaattagatggcaagaatggcaacctcgaccagatgggaaagtcagcaaacctggcgtcattcaggaataacctaaacttcactgtgtttaattctttttaaaaaatgttctgtactccaaaccgaaatggaaagtttagtttcttttgagttgttctactgagtagtcaggttcctcacaaaatccatctctgatgaaatagggcccagactaataaggtggtgctctctccaactgaatgtacattctatagcataaagccaaagtctctgtctagacccctttggttatttttctctaccagtgattctgcccatgctctgagagtgtcagctgcaaaggcctgtgggtacttcacgagaaagatggattataaagatcttcaagattgtagaaggtttaaaagtcattaatggttgaaacatggctataaaatgttggtcccacctgcagggtacttaaaaaacttgctcagatgataataagggcacgtgcagtagcagaagctgcgttcacctggcttggctgggttctcatggctcccagggcacaccgcctagcctctgggcgcatcttccctctcccagaatgagcaccacaaggcctacatgaaccagctgttagggaagggaaaggatgcaactctgggaacctctcgttgaaggccaaatgggtaattctcttgtcccaccatggaaattctatgaccaactcctcctccacatttcctggcactggctgaccatctttaatttttatgagttttgtatatagctgcttgagatacatgtgttttgaacaagaggaaagtgtgacagacagaaacacagccctgctggccccctcttgccacagtgaccctgggccgtgaaccacctggagctgtatgtgggacattcagaacacccagcagtttgtggagctctggacgcatctcacaggcaagttttacaagttgctgagagaggccattttaaggaaaatctacataattcttcccaacaggcctggtacccacaaaccctgcgagtcctgtcatgctatgacaagaataaatgtgtttgtagaggtagagatggtactgttcacctcccaacacaaggaagtggtcatgaaagtgggacaggtgagggcttggacctcatgacaagcccagtggccaaggggtcaggacagggcatgtcccatcacggtgcagggcagacaggagagcagccacagctcatccacacacagtgacagggaacaggacgcagaatcttaagtgaaggtgaacccaaaacaagaccacggggcttaatcaacacagctccaggccgtcagaggagcttggaagcaaactgcatgaaggccgagtggccttggcctcaccagggcgggtgatgggagcagtgtctgagcgcctgcgagctcctgtctacctacacaggacctgggccgccctcaggtgtgatggtgcgggacggggctgagggacagcacttcacggctctgccgcccaccggacggccccatcactgggccacagcctgccagtggaactcccctctgatttgcaccagcacctccgacaggccatagagaaaggggactccgaacgcaagcagctggcacatgaaaaaggagtccagagggttttgggccacttgttgcccgaatgaagaaatgttgctttggaggtgctggctcatgcccttggccttgtcacagaggccgagggagtgacgcgccacccagccaaacaaggaagtgaggctacctggggttctctcagtggagctggccacggcgttggcccgtccgtttgcatctgtggtggcgccatcctgcaggggtcctttggcctcctaggaaagttcatgagaaaaagaagagtgactctgactgatgcactcaaatcctcaaatccctagaggcactgacaatctgacacgctggttttaaattttatttatttatttatttatttatttatttatttatttatttaagagacagggccttgctggcacccaggctggagtgcagcggcatcatcatagctcactgcagccccgacctcctgggctcaagcaatcctcccacctcagcctcctgagtcacccggagtcaaagtctagatccacctaggtgcacctcttcctgccagtccctctgcaggcaacagaagccctcaagggggactgacaggcaggcgtgctgacaaggtggcaaccatgctgaagagactgctgggttcaccgcgacaaagacaggtggagaagccaccctcattaaaaagaggataaggaaggaaaaaattcacagacaaataactcacagaactagtgaaaggccccgcaggcagggcgccctttgggtgtggggagtgagggtggggccaccgagggatcctcccaacagtctcctctcccaccctgcccttctggaggaggctctaatcatgtggaacatgaggcggcatcaccccagtggcagggtgtcctctcagaaagatgtgtgttgacgaaggcagatgtctacgcagctgagatggagagctgcatcatctcctgggtccgactcagggggcaggtggagcctttaccttagcgaggcaacctcagatcatccatgaaaagatggttccctctccaccccggactgccactgcatttcgggccctccccgttcccaggagaggcaaggacgcaggggcatttgcaggttggccgcccccggcccatagccacactgctgcaacacccactgcttctcccccacttacaggagagtcaccattacctttccagacaggggagccactgccggtctcttcctttgtgcgtagccagagagtcgatagcagtagtgtggcttacagtagaatttacctgcagacagcaagaggcagggacagaggcgatgagccaggcacggatcctgaacgtgcctccctggtctcagccactcctttccatctcctccagcctcacaaggccatcaagccacccagccttccctgggcccagctttcttgtccagagaagccagttcctccgggtaaactttgattctagctctcctctcccttggcctgaagggggtcttttcctttgggaatgtgaaggccattgagccatcacccaatcagtgcccagagcaaagatgtgaggcctgtgtggcagggccagcaaacaaagtggcagtgtgtgaggaacaaagatgtggtcacatgaaacgctgggagtagcattgctggggaaaccaagaatgaatacaagtgcagggtggaggcgtggaggctgcaggggtggggcatcgcctggcattggctctgacaggcccatctctgctgctccccctcccgcaccctatctctcaccccctcccagtcccctcagagggtcaggatcagcaggaaaggacattagaagacaaaaaatactgcaatggactatgagtaggatggaagggaacagcatagaacagaacagaatagaatagaatagaatagaatagaatagaatagaatagaatagaatagaatatagaatagaatagaatagaatccagagtgtactgtggcatgatgagaataaaacgttatttcttggaacttgcagctgtgtctgggtctcaatgtaacgtgcatccccgtggggggtgtcgtcagaaaaatctgaacaccactgaacttggcttttcccatgactctggtaatggaattaacccacgcagtcatttttttctgactcttttttactctcacttaaagagcgactgacgacttttgaatctcaagtgataaaccctactatagaaactgttgaaacagaagtaatcccatttcattttcctcatttgtagagagtgcttcttagacaaatgagctttcctgatctcaaagctacaataagaggacctaaaagtcaaagaaaataaaggtaagatggcattcttccctttccctttccctgatgatctgattatatctttcttcttttccttcagagaaactgacttgttttacctgcactccctatccaatgctgaataaatctattagaaagacacagattttaaataattttcataatgcctagtatactttctcagacagaatgtttcactggccactggcacttggccaggatgcagagactctacagtggcaacacctgacagccaaaagtccgccagtcttaccgcctgtttctccaccaggggagtggagccacgggttgttgcctggagcctggccacaacttccttttcccatctgaataagccactcagcttttgtaaatgttggccaccaataattaggataaggtaagatgtatgagtgcttggatcatgcgctacttgttttggtctgttttgtatctcattctttaagaaatacccctccttcctccatgagactgacaggggctggcaaccacgtggcctgaccttccaccaccagtaacacatgacccaggccgctcggcaactcactccctccaccccacccaggacagggtgctctggggactggcatgtggccaaaggcaggctcgctggagacgttatggggatggtgagggaggtgagggaaggggcagcccttccctggggactgctctctggatggaagctataaagttaaggcttcaactgtcatctgcattgggtttctattacttgtaaccaagagccttgcttattacagtaacagaaaactaaaatgttatcatggctttcatttcttccttctatttttttcctacattaatttgcttgtttttgcaaaagtggaaacccagatcttaaagtataactcaattgaactcaactgaatcctccttgaactctgctttggtatcctaaactaataaagaaaagaggtttacatttcagaaacaagtcctccaagcctaatcaaaaagttccagaaaactgttttctctaggaaggcagtatagatgatgcgagcaatgtgagcgctaagtgtgatctccgttccaacactgtctcaactgctcagtagccgtgtgaactcatctgtcttttggaaaatatctcctcccatggagaagaacacagtacccacctcataggtggagatattcaatgaggtggcacaagtcacgtgtacgcatctccccatatcctttcccaaactcaacacgatggcactttttgctttttaaattaaaaaaaaaaaaagctaattttaatgttaacatttaccaagtgccagacactattttaactgctttccatctatcaactcatttaatccccaaacaagctggtgaggcaggtgccattagtacccacctctttctcagcgaggaacaggaggccgagtgacctgcccagcgtgtcccacagtcagtgaaccgcagaggcggatgtggtccaggatgctggtgccagagcctgcactaccatgacactactatgcttgcctcagtggtaaacccagccttgctatgtttttaattagctatgaattgtgggtgattcagtcaagtgactgattctcaatggtccaaattaaggaatcctgataactgaatatgggagtaactggaaaagggaaatggagaaaacaggtggccacagggcaaacccaaggtcaagtgggccgttcattcattcattcacccaggcccgagtgccactgtatgacagctaccaatctgaacaccgagagcccccaggcaagcagacagactggttctccactgagtgcccccaggcaagcagacagaatggttctccacagacgcatggatgagacagtgcgagccctgcatggagaaccacacaggcgcaccggtgcctgggcagctgccttctatcaaaagagccagacccctctctgaggagcgccacatggagatgtgaaacacaggcgtctcaccctgtggagaccagggggtgtgctccaggagaggacacagcagagccacgtcctaagggagcagtggcttcatcatgcttatgggatggaaagacactggagcaaagagtgcagcatgctgggggcagctgacggcagaggctggggtggacacgcaatgctctctccacctgggacaaggttgtgggctctgtctgcacggcagcggctaggacactggtgagatccaagtcacaccttttaaaatccctccggttgctctgtggaaacagactggggtgtaacagaggcaaggagaccagtggtccaagtggaagatgcatggctggcttggaggctgctgcagggatggagacagtctcaggctcatcactgacgagggccaccctgcacacaccacctgtggaggtagcgtatgtctcttctcaagatgacagggaagggcctgacactaattttgagtccttgtcttaagagctggcagcgatcacaaatgagctaatgctttgcaaaaaaagaaacagcagctctgtgtttgagcagacggcatcctccagaaagagctgaagacagaacaaatagcaccacaagtaaaatatggggacatcttcaaatatgattcttaatttactagtatggagttggcagcaggcctggagtcacaatccctgaatctctgacctggaatgaatctcaggtgtcatctggtgcaagtgagctattactagttgtgtcaatttggacaaacaacatacaagttctctgaactcagcttcctgacttctaattacagtaataaaaagttacttaatggggttgttgtgaggacaaagggcgtgatgtgttggggcgcagcacaaggcctcggttacttcctcctgccacaacctccccagcttattctttgttctctgagcctcttcagttagacttctgagacacttggcaacttggataaaaaacaggctaaaacttcggtgcccctaaagttccttcctggctctagtccatctgtcctctgacagatgaggggaaggactgtggaggggctaagctgatgaaaattttatctgggttaaaatttggggagctggtttagaacggctgtcttctctgctccagtgttaacaatactgcactcaaccaggctggcctcatcctgtctcggcctctcactgccacccgatctcccaccaggtgcgcacctctgccctctactcagtcaccatacccttctctctcaaagtctagccaagggtcagggaggtcatcccaagatgctcttgaacttcacagatttcctcctcccctgtgcttctacaaagcgacaacctaggctgtgtaaccgagcctttcgctgcacacactcgtgtcgcctgctactcttcatgggtctcatccccataggacagtgagctcctggaggcacacattacacttctgcatctttcacagaatgcagcaaagatgcacacacacacccatgggcaaaagtacctgtagatcaattagctgcaccttgcgacatcttctttccgggcagactccacggtgagaggctaactagaacaccctgagcatcagggacagctcagcgaggttgggtggctccctctgccaggccccatccttgagatcaaatgagctatccagagagcaggtgtgtgtgagaggtggaacagaagacttgacagcaaacaatctgcctgccttatctaaacagcgtcctaattctttcattcttccccgactcgggagtgctttttaccaacatagcagaagggccaggcaccatgacaggagtcagcctttctcggctcacctctctgggctccttccttgctccttctaacagaggtgactgtttgttcaccctcaggacagctgaagtgactaggtcctaacggcatggcatccctctcctatatgacctcactttataatctcacagtcacgcaatcttctatcaatgtcaaggtctttatgccaccttataaagattactgcctctcctattaatctaggccccctcattactctggaatctataagactgcctcccacgaagtccctccagcatcctataggaatggggctgggggtcctcaatgcagggtcctcagatggcggccagcctgcctctgcccatcacgatggctctatcgtctgtgtgcagaattctctactgttaccttatcaaggtcttttcactgtaaaaactggcagcacatgttgccaaagaccaggccttgaacaccacagtaaatcagattcaggccctgtgcaatggttcgcaatccaccagagagagatcagacagatgccagagaggtgttaacacgggccaccttgcagacatctccaagagcaaaggtctgagaacccaggggcctgagacccagctccaacttgctgtcatcatcaaccttaggcaaaatatgtgacttctatggatgtgcaagtccccttccgtaaagacaaaaaaccttatttttattgtgttccttttatctcaagttcccaccccgaggtcagaaagcaagtaagtgtccctgaagtcagggaaatgacttaggtaaatgcatgccattctcatcagcctggtgacgctgggaaatactgataagtaagagtcttagagaaagagtgatggagggagaggggcaagaaaggctgggagaggcatgatggaaaagacgcacatggaataaggcaggaaggggcccaaaggcgcccagctcagatggaaacactgtccaagcacagtttctcagtggggccggaggcgcagggtgtctcaccatcctcgatgtcgtaggcgtaggccgagaggcgcagggtggtggcgcagtactcgcacttgaagcagctccggtggaagaacttgccctcggcactcagcctctccatcacgtagacccgcttctggcagaagtagcatgtgtcgctgcctcccaggttctgcgggaactccttcttcatggagccctgcaggaggtggcggtcgggaggaaggggagcacctcagggagtgccacacaggccctcctagaggcacagccttgcgagagcaaagccaaccctcactaaggggtctgctttgagacagacttctaactggctacggtcaactgtgctcttggctctgccacagagtgacggcaccgccacagtcactgcctccacgcactgacagagaacacttggcacaaccgcgaaagcctgggccagcctgctgctgacgagggagccagcatcacagtgcttcacaccagacttgagtaatgctatgatacagcctggcgacgccgggaaatatcgacaagaaagagtcttagagaaagagcaatggagggagaggggcgagaagggatgggaggggcatgatggaaaacacacacatggaagaaggcaggaaggggcccgagggtccccagctcaaatggaaatgctagcagagttctgttctgagggtagctgtatctgtatctattccgtgttgacatagttcacatgaatatatgtgggtccctggactcacacaacaactactgcagtcttaggaatttggttatcaaaacccagacaacctcaaaagcaattaccgcatagcatacacgggctatgcaagctataagtgactcagcacacaggtgtgtttcccatggctgtgctgggtctagctacacagtgcctggaggcgtctcttaccagttccttcttgtctagaagggctttgggttgttctttcctttgaagctgattggctatctgctcagccaatgagctcactccgcccgtgtacatctttatatacttctatcggttgaagattacaaaatgaccagaatgaagggaaatgagaaggaaaaaaatacataaattaagaagacacggggaaaaaaagaaatctttgggaagtgcaatttgaatacaaggtgcagcagcaaaccatgccaacacagtgctcacaggcagggaaaccgggtggaagaaaaacatcgcgtcagtgtccacgcaggggtaccggcacaggcaggacggctgcaggggaagtgtcttccttgggaagaactgggtctctcccatctctgtggaatgcacagttccagggaatggtggtagaaggcagggcgaacgcgcacagagacaggcaggcagggcctgggtcctgcagagctgggctgcattcacagaactcgaggggcacccccatgcacgcagcagtgcccaggctgagcctgcctttcacggtccaggaggccatctcctcactcagaaggaaccatgttcactcctgcacaggccgcctctgtgtgggtagcgcacgtcgccagctcttcctgcttcctgacgcttgaccccacaatgcctgccacaggcagcgaacgctcccaggctgttttggaagaagccttctcagccctttctccctgctgatgttattgggggtctgagggcagcatgatgaggcccgtgtggcccatccaggtgctgaggccagagccttctagactgggctgggcatgttggccacgaggtgtggccatgcagccaagctgctccaccagcccaggaaggtgggaatgtgttctaggccaggagggcttattttagaggttgaagaaaggtaagagaaaaaaacccaaccaactcaagcctctttctggcaacactgaaaccacaggagaaacttccacgtctccatcatgagccgccctgctcacacctaagctgggtgcccaggcagccccgccttgacctgtcccgagaggaagtcctctagagactcccacgatcaaatcacccttccatgtggagatggccacaccaccatgtgggtgatgctcctctcatgaacttcatggagtaagggggctccctgccccctgggggaacctgaccctaattctgactcagcaactcaccatgagccattatcccggggatgccaacagcccccttaggacatggcctgaatggacagacacataaggcctcgtgtgaggaagaaacacagaagcaccgggcagggggaagcaggcgctcgaggggctcacagatgcacacacgacgaagccgttcttgtggctcagctcaaggctcagctgaactgaagaagcaattatagcttttaattcaaaaataagattcccaaggattggtgccatttgcccattaacttcacagattatacctattagtggtcaagacaaacacgtggctctcagatctaaaccttctttagggacactaaagaaactgaggcttgggacagacagacaccaggcagagctgagcaggtaacttaacagctgacactgagggagcagaaaatggcatttctctcattctgcagcagacacggggcagtgtgggccagatgccaagtatgaggccaggacaccaagccagccctgggccctcactgctcagccaggacccttttctcctgaactaaaccatctgggtttagttgaactaaacctggggctgcccgtgcaaaggcatctgccacattcagttctcagcaagttggcaacactgacaagcatccctgcaagagaggtgaagactcaagttctatttgtttctggcatgaaaagcgatggtttccttctcatcactcataaaaaatagcagaaatgtggcaattgcgggatcgatcccaccgcacaccatacgtgtgcatatgctaccatgcacataggcctcaacccaggcatgggaaataccagtaggagcggcaaagagaccttccaatctctctagaaactccctacaactgaaccagtgctacttcagatcccgccgcacaccatacgcgtgcatatgctaccatgcacataggacgtgaggtctggcgtcaactcaggcatgggaaataccagtaggagtggcaaagagaccttccaatctctctagaaactccctacaactggaccagcgctacttcaggtgacagccgcgtacattcctcaaatgatgacaacaggcagccagaataccgcatcatcacccctccattgaggtgatttaattacattgtggttcctactttttaacacatattattttggaagacatgtgaagttaaaaaagccaatggctgcaaaacatttatcattatttgatatagttgaaataggatcaaagcgggttcacatcaacagacctggatgtgtcagatacagttggatgaaagccagcagccactttagctgaggagtgtgccacagacctcacacacgagaccgacacaggcaaacagcaacacatgcagctggctccctacaggagacgggcccaagtgaggaacactgcagcctcctggggtacatgacacttgcgaaagtgacgtgagtggaggctgcggagggcagagttttagtgagtcctaggccatgctacctgtcggagggagtcggaggagggagaggcggggcgggcagaggagcggagactaagagaaagctcccactggtcgacaaaaaatcgacgaggaggttcaggctctggctataaaatacaagatggagaaaaacaaaagtaaaggaaatgttaaattaagtcacacactgacctctgaacataagatggttgtagagccttttactctagacctttatctaaataccatgtatagtaaaaaaaaaaaaaaaaaaaaagtagctccagaagcataagcggcccatgcaaggcttccgttttgcttttaactgtccttccctcatgcttgcagcagagcacaccctggaacgcggtcccgcagctgtgggccgcccggcacagcctcggcctccctctgaatgggtaaggcagcctgcaggaagggcagggggatggcttgtcgactcacatgctctgtgctctgccaagcaacccccggcctgagctgggatttctccagggcaaaaagattctcccgccaccctatcactccattggccttagaagtagcaggcagcggagacagcaaatctagagtgaagctcgctccttctacagaagggccaggaatgcagcatctcttccttccacttagtgctcagagaggctctgcttgccaaagagccagctgaatcccaagcaaagatgaggagaaaagacttgagcccaaatcctctgcagactgcacatagcacacgtaacaaaactgggcaagggtctcccttagccgtgggcccatgcagctaggaacccagtccccagagattgaggcagtgaccgaaagctttggcaaccaataactgcttcatttcccaccaggttcagaatgaactatttacaggtgggaaggacagcattaagtcatgatgctagaaagccctctgctcctccagctccaagccagattggtcacactccctacctcagccacgtgcacttcatagctccgtggggtggcgacatagactggcagttacctggtacttcaacaccctctgcttgagacactcagccagctccttggccctgggctcagcaacacaggccccagagggagctggagaggatggctgtaagcaccgcccctcagaaggaagcaagagggagactcagtagccccctggggggcagagcagtcagagccaaggggaggagtgggggactgggtaggactgggtagaggtggggcagagagggcaagtacacatgcagggttatggaggttagggaggttatggaggttagggagcttatggaggttagggaggttaaggaggttagggaagttatggaggttagggaggttagggaagttatggaggttagggaggttagggaggttatggaggttagggaggttagggaggttatggaggttagggaggttagggaggttagggaggttatggaggttagggaggttagggaggttatggaggttagggaggttagggaggttatggaggttatggaggttagggaggttatggaggttagggaggttagggaggtgagggaggttatggaggttatggaggttatggaggttagggaggttatggaggttagggaggttatggaggttagggaagttatggaggttatggaggttagggaggttatggaggttagggaggttatggaggttagggaggttatggaggttagggaggttatggaggttagggaggttagggaagttatggaggttagggaggttatggaggttatggaggttagggaggttatggaggttagggaggttagggaggttagggaagttatggaggttagggaggttatggaggttagggaggttatggaggttagggaggttagggaggttatggaggttagggaggttagggaggttatggaggttagggaggtgagggaggttatggaggttagggaggttagggaagttatggaggttagggagattatggaggtgagggaggttatggaggttagggagattatggaggttagggaggttatggaggttagggaggttatggaggttagggaggttagggaggtgagggaggttatggaggtgagggaggttatggaggttagggaggttagggaagttatggaggttagggaggttatggaggatggcagcagagtccaagaaaagaacttaagtagtgtcctcaaaagtatccagcctggagccctgcactgaggagtgcagaaaccagttcagagggaaaaagagagaaacatctctgcaagccttattgcctcctgagctcaaaaaccctaactcatcccctctctgcaccacagccctaaacttcaaattgtttctcactgccaatctctcctattcaacatgctcccctcccttcttcttttttttgagaccgagtctgattctgtcgccctggctctgtcgcccaggctggagtgcagtggcgcgatcttggctcactgcaagctctgcctcctgggttgatgccattctcctgcctcagcctccccagtggcggagactacaggcacccgccaccatgcctggctaatttttttgtattttcagtagagacaggttttcactgtgttagccaggatggtctcgatctcctgacctcgtgatctgcctgcctcggcctcccaaagtgctgggattacaggcctgagccaccgcacccggccttcccctcccttcttcttttaggcgctgtttcattaaacattatcagcatctcattaaatacacaatctgcaaaatggagggcactgccctgctcagtgaaaagggctgctttcctttttgaggggacacagcctgggaagaagagagaaagaggctgggcacacagcgccgtgggagagcagccccagaaagggtgagcaccgtggggcgaggccatggaaagggggtgggaaagacccccacctccagcccagtctccactctccgacccagcaccaggttcaggcagcacacacattgcccgctgctagcctggtgagagggcgcaggaagatggcactatgattagctcctatcgggtccgaggggtaacctaatttactgcttggccataactgcatttctcagagagcaaaggcagaagggagttagaaaccaaaatggcttttgtgagattaacaactagagatgattcttcccgctagctgcagagctgtacccacttggagatctttaagggtaggaataacaagaacaaaagtttcataaagtaagccggcttctttaactgggcatctcggctatccctcacattgtacgatggccagctgcaatcagtaatttctcccctcagtgtttcagaaaagactaaagctttccacgggtacagccccattttgccatcacctacctttctccccctcattctcatcccactggaaaaatcctcacgctggtaagagctttggctctcttaggatttccacttcaagatccgtgactgctgaatgccacttgaatactgatttagaccctctccctaagaagttgtatctgacagtccaatgctactactctaccactggcacatagtttgggggtagaaatagtatggtcttggaaggggaacagtgggcagaaatgggaagtcattaaggccctttacaatacgcacatttaggatcagcatcccatctgaatgccagatgggtgactgctttacagtgaatgctatttgcattggtcaacactgctagcaaaaagaattctggctcttggctgggtgacaagagcgtgcaaaaagcaaggggagggggccgtcccccatatcccttcccgctgccccaccaccacagcgtgccccgtgtgcttggctctcagcatcccatgccacgggttcatgctcttttaccctctcatggtgggggctctgcttgccacggttgtcagcatcaagatccctgtatgtctgttggcaacaaagtagaaacttaagctccatgcatatcgctctatttggacctactaaacgacagtgggaaattcaggggcagaaatgcagagttcaacacatatcgccttcccctactaaccccatccccaggtaaccataatcccatctgtatcaaatcccatgacacaaggccgactttctgcacagccattccaccccccactggcctccgacgaggccagctacacggatcaatgaagaactatggttagtacaaaggtggaacaagcatatttctttcacacagtggcataagatcagaggcatcaaatggaaggtttagaaggagaggcaggttaaaagggtgacacattccacaacaagacattttagaaagcaaaggtggggaggtgggaattggctagaataaatgactaagacagcagtccagaggaaactccagagtgggaagtggttcctgaataggagcatcgggccaaagcataatttactaaagggagaagtgaatgtgtttttggcgaatggacgggaaggtatatgtgaaagggtaaagacctgcaggtagggacatggccttgctcatccgaggagccagaagcggcaatcacaggaccagggaaggctcctcgcattactctctggctggctaagggttcaccttacagccacgtgcgggtggaaaaacagccccaaggcctctgacgtggctgctcctatctagcacccgtgagcataatgtctctgtgggcagagggaggccagagcgtagccccggtcccacaagccagattcgagtctggctgcattgcttactatgcggctcagacacgtgacatggcctctccactctatacttcagtctcctccctggtaaaacggagccagtaacagcacctgcctcacagggttactgtgagaactgacggagacacagcttgagaagaactgagcgtgctttccaggcgacagcggacgctgaggacggctagctcttgtgtagatgaaggcacccagcagctgctcaacctgcaacggctcagttctgagaaccatggacacaggtggggcctttaaaatcagtcacgttaatacggtcacactttaaacaggccaccctaggtgggaaaatgtctttccatagatcctgctcttgaaactcacattttatagaaacataccatgaaggtcaacaatgccatcctacaaacatgccgcagacacacgcctgctgtcctcactggcctgctgtcctcactggccacagctgtggctggctatggggctgctcctgaatgctgtgcctggcgtgcaagtgcagtggggaggagtgtttgttggaagatgctgaatgggcaagaggcagagctcccagaatcagaaggaacgaaactcacgtggagaagccctgcggcagtgcccgaaggccttactccacctcactgtgcagcgagagaaaagggctgccttcagtggggttttagaaaaacaggctgctctcagggctcctgggcctcggatgcacgacaaacatcaattacagttgaacttctagttcgtggtgggacagtcgtgtttccatgatgtgggtgggactgactagggtcaggtgtgaatgtaggatgcaccatcctgagggccataaaagttgcttccaccacaaacggtttctacgcatagcctttcttcttgatagttattgctggtaagagggaaagtgacttggtctctacactagccacctacacagacaggcaggcagacagagacaggaacatggagcatgcagagaggatcacctgctggccgccatgtgcccgacagggaggtggagtagggggaggagacagggtgatcacttttttggggcaggtccgagaacactccttttcccgttgcttttacaccaacagacacaaacagagagaacatcattcaaacagtggccatgtggaagctggttctgggaggactgaagggtgtttgtcagaagcaccccagggaggcctttccttgcccctccatcctcagagggcagcccagtggtctcccgtgggcccccaggtgggacgtgcaccttctgataggcacagccacaggggtgatctgcgggactggggagaaccagcggtgcagcactttccaggtgccagggagcaacagttttctcagggaagttggggatacaagaaataggcttgctgatgagtagagagggcaaacaggccaaccactaagaggggacacagagaccccctctcaagggcttggtcacgtgcatccaatgaagcgaagcagcagccccttcagggagcagctgtgatagtggctggcactgctgccctcctctcagtccctgcactcatggaggctcaaagggctccaggaaactaacaaggaaatgcaacaaaggcaggagcatgatgtcaaaattaaatgtgtctcactaacatttgaatgccatatacatgtccctggcttttccctcatttctgccccctccaccgtattcccttcgagagtctgtctacaatttacaaagccgctggtatttgagaaacaatcacacattcccaggcctctctgataccttccaaggaagtctcatctccctgtgcccaggtgacccatggggcagcatgcagggagccggggagcagggaagccacgaggtctggggaaacagccccgtactcgctcagagctcccatgacaatctacttccaaactagggctggttaatgcacagagcttgcctttgggatgtgtttctgagatcaaaaggcaaaagggtggggaagggaagagccacagtgtttacaaagtaaggaaataaagagaagccactggcaggctgagctgctattattttccctcttccatatgatgacctaggctgaggcgggcccttctgtcaactcagctatcactgtcctaccaggcaatgccctcctgcctctgaaccacctccagagaagcaccatgagtcacaatgggatgctgccagtcagccctgcttcttgaagggagatgcggagggccagccatgggaggcatcagacacagggcctgggtaccactggagttcctctgtcccaggcttctgcaagtatctggcactgcaactccaactctctttcaggagataaatttagaaggcccaaatgcatgatttagagctgagaaagttctatgtgaatactatacatttcacatggacttaagaactgtgagttccggttcacagtgctatctccctgccacctggtaaattcgcaaatccctattggatatcccctgtaccaaagaacctaacggggttctcaccgctaacgatttctcaccaatcaagtctcatttatacatctgcccagctactgtctccaactgtaatctccagtgcccatcccacagaacctgcgtttgactttcatggttctattccactgcccacacagcctgccagtctcctactccaccatgaccataccgactcaggtgacaagctgcgctggcagggactaccaacattctccagggagagtgcttctggcggcccctcagtgccattccagccacaaccacctgttcccccactcgcctatgtcactcctgacctccctctccctctgctcctcccacctcaggcacccgttatgaatactgtaagaggttttggaatccaatttggagttcaccttcccctgcaacagatcctcaactaagcatcatctttcaaatcatatcttccacctagacatcaaggcaaaggttaagaaaataaaatgcaagtaaacttccaattacatttttcagaagacctccctcatgcacagagaaagaatgaattcgccttctgtcgtgagtttggacactgctcccaaaattccatctcagccttttgggccctgcctttaatgtgctatattatcaaagaatggttagaaaggaacatttttgcctgaatgtaagtaatttaaataaaacccaactcaccactcctcagtatctcctaacaataaactcactttacagcacaggaggctggggagaccgactacggaaggcactgacggcatccagggcccactcatggccctctcagcatctcagcagacctaaatgatatcggacaacgaggtagccaaccctggctccactcgagagcagggacttgctcagctgtgacacggaggaaacgcagctgggggtcccaattcctctgctgggttttctcttagaaagcgcatgccatcacctgccctattctgtactacttaggataagcagttttccaggagatcctgccaaggttttagtgaaaatttccaaaaacattaatttaaatgtagagaaaacaccaagaaaatgtccaggaataccttcatccaggatttaaaacaaacacaaactcatagttccagactattttcctggataacattctcctatttaatgtaaaaggctctacaccccaactctcaggcctgacatactcagaattctctctcccaaggtcacgaggaaacatgctagaaaaaagtcaacttgagacaaatgtgacaacagcaaacccaagagcgcgggtacccttgggtgagccacctaccacacagcttcagcgagtttcaaaccaaatcaacagtctcccttttaactttctcaaatccccaggagttacataaatcatgcaatcaatcagcactgcctgttcaatgttttcccagagctactactcgaatgagcagagatttcctgccctcatgagctaggattccagagcacaggcctgaaccctggctggctcaggaggaggggtaggaaggcctggagagacagcacccatcctggccctggcagttcctttacctgtttccaccggggggtgggggcagggcgaacctgcccaggcaggcagcaggacggctggctggccccacgctcttgtgtcagctgggacacacaggccaagtgtgggtggggacaggacatggagacaaaacaaaataaaaatacattaaggtgggagaagaacagaaagaactcacaggcgacagccccatatctgtgaactgtggggaagagggggactcattcttagaaagttacacttctaaagcaaagctaacagcctcccccaaaccaaaagcaaatgcaaaagaacagaaaaaggaaaacagaagctgtaatacgcatcatctcttttccaagctaaatgttctctgagtctaagccactaattctgatttggaaaactaatattcccatccaaaatgaggaaagcaaccttctcttagaggcaaccttcctctaacggacagcattccagccttcccaaggtaggggcacctggggctgccagagcctccagacaaccacaaccgtttatcaatgaatatcatcaccttttctgtgagccatagcatgaaaagactggcgtgcaaagactagatgtgggaggtagttaattatggccagactccaagcaaagctgctcccacccatctggtccataggaagaatggctgatgggcatggaaaagacggagagagagaagagaaattcagagaagcagccctgccctccagctgctctctccagttatcattgagatttatgagacacttccagtgcgaatcttcaaaatcccagccccgcctcttgtaagaagtcagagtgacttttagacaatcaaggggagagacacgccctaaccaagacaccccaagccacaagctgctgccatgcactcgcatgcatggcatgtgggagtgctgcttagcactcaatgctcatattcctaggaaaatatcccgggaaacagctgcaacacacaaaagaagctttatcataagaacgcttatccaaagatgagaaacaactcgaacatccaacactagagcaacagctaagagaagcctgatgcccacacattccaaaaggtgcttgtaaagagtcaggaacaacatgggaacgcctacggttaaatgaaaaaaggagaatcgaaaagtatatgttaagaatgacctcatctacaaaaacaagaatacactgaaaaaaacaccagaaagaagggcaggaaaatattaattaatagaattacaggtggcttaattacctttactgtacttttcagcattttcctcagtaagtgtgtacttctctagaatttaaatatgtctgcaaacatgtacagatgtacaggtatatgaatacagattttttttagatccctctgctgattcttgtcagtggacacctcaggcctgaacactgaggacggagcaaccctcagagcctgaagcaagcatatacagggctcttctttgctgcagtcaggcgagggaaagccagatgccagcccacgaacgctggggtctgtgacacagcccatctcaatggatggaaaagatccccccttcttgtgtgatctgaccaaatcggtgtgggcagggcacgggttgggtttacctgtctccgtatgccgatggactgtgcgggcgcattctcttcaaatttggccagcagctgggtcgccatgtacttcactttgttctggttcccaacggcaacgtccatcctcctgtctgtcagagtgctcaccagggtcggtctttctcctctgtggccccgaggagcttcctcctggtcaatgccaaccccaaagaacccggcgctgtgacaggaggctccccccatgcccctccctcacagaagtgcactcaggacctggcatgggggctggtggactggctcagctctcaaggttcccgtgtccacacagagacagcaagcctggaggtagggccgtataaagagtactgggacctgtgctggtactgccacattccaggaagccactgccctcgaacacatgtatgaaccaaagagacaaggaggccctggtgcacgtgtgtgcatccctggtgtgctctggaaaattaaacaaaggcaaacatccacagaaaaaaccagagaggccaggcatggtggctcacacctgtaatcccaggactttgggaggccaagatgggtggatcacttgaggccaggagtttgagaccagcctggacaacacggtaaaaccccatctctactaaaaaattagaacaatttggccgggtgtggtggctcatgcctataatcccagcactttgggaggccaaggtgggcggatcacttgaggtcaggagttcgagaccagcctggccagcatggtgaaaatccgtctctactaaaaatacaaaaattagcaggacatggtgatgcacacctgtaatcccagctacttgggaggctgaggcatgagaatcgcttgaaccctggaggtgcaggttgcagtgagccgagattgcactactgcactccagcctgggtaagagagccagactctgtctcaaaaaaaaaaaaaaaaaaattacaaaaattagctgggtgtggtggcacatgcctgcaatcccagctacttgggaggctgaggcaggagaattgcttgaacccaaatccaggaagtggaggttgcagtgagcccagatcgtgccactatactccagcctgggcaatggagaaagactcttgtctcaaaaaaaaaaaaaaaaaaaaaaaaaaaagaaaataaaaaaaagaaaagaaaaagcccaacagaaattctcataaaggatgaatatgaaaagacctagcaataccaatgtggaaatgaagaattttaaccaaaaggggctattccacatgaccattctagcaattccccaagtgaatctcacctcctctgattgactggtctttctcctcttcccagcaccatccaagtccttttcctttttatcctgtaccaagggaggagggaaactgcattattctagccatacataccttgccattagctttgcagcccatcaagagactcctccacataccttgggagaacgcttccgagagatggtctggccaagtttgcttaggaaggagataggggatctggtgctggctatcaggactgctttctcctcggcatttaggtccaaggtgtctgggaatagaaaccagtgatgttcaagcacagcccttgagggcgccgcaaaatcctgaccaaaactactctccctcgtggatggttcgcagagcctcagaaggctctaaaggttcaccagctccaggacaagcatgtggtctcagtaggaaacgccacggaggaaatgcatacttgggtatggacattgaaccttcttttgttcatccacataaacaaaaatgactcttcttcccaatctactacagttaccaaaacccgcacttttgcttttcaaaagttggaagctggctgtgattgttagttacagcagagtgctgaaggctcgtttttgtgacaaaaatttcaggacagagagagagggagggagagagaaaagcagagaggcgatgaactcagggttcctggttttagtgtatgcagatgccacactctgagctgcacacagatgggggtggcactgaatgggtacgtcgatgttagagctgtggctttctgttgtaagaacgtcatggctaaccaggaaaagccacagatccttacaagaatatatgggctggaaagcactggagggtggtaacacaagctttttggatttcaatgtttcattagtaacaacagcaatttttaaaatagtcattaattcatagtaaatcactaacatttattaagtacttccactggccaaacatccttcttggcacatcacaatgtaattatacatattatccccattttacacccgttaccccattttacaagataggttgacggaaagtgagacacaggaaaattgagtaacttgcctaaggccaagtggaagcctgggatactgtaaatccaggtcagaccccacagccaacactctagcctcaacctacacttactctaagggacaattaatgacaacaggaatattttttgtagcactatgagagcctgagacagcaagctgagagacaagcaaagatttttgggaagtgctaacaagtaggagtagaaagaagccaagagaatgcacagtgacaggagaaagaagggcaacaagagtggttcaggatcacagacacagaggagacaagataattccacgaaaagggacatcgttctccggtgctcaacaatgcagaaaagcaagtgcatgagagatgggaactgagaaaagagtaggaggtgggaatcctcctcactggggaacagctgcagtagcgcggtatgaagagaagccggattataacccgttacaaagtttgggccgtgcagaagcagaggccacaagcacaagccacttcttcaaaaaggctggctctgagagcacgagcactagaaggtggtggtcacggaaaaagacggcacaggaacgatttctgcatttttataaatgcagtgagaaagaaaggaggggttgagaacacactactagagaagggagaaacaatgaagcaaagctccagagatttccctgacagctaactggtaaaaacacagagtaactttgtgtttggtggcactgctgcgggacagtcggaaggaaggaagaacagccgggccacagcacagcagcagggggccgcaaagcagctccttccaggccttaccgctagaggggagggagtccttaaacatctcgtagaactgagtcaggtacatcaccatggacagcttatcaggctcccccacggaggccatttctttgcctgtcatgatgggagaaatgcccaattccttctcagcaatgtcaaaggccagttggttattcttctccacattttgctcatccaaagaatcaaaatctctgagaaacaggacaaggaaaacatatcaagataggttgacagtccttaaacagaaacgcagtatcctggagtcatcgtcctttctctgttttcagctaaaatccagggtgctgtgcatcgctgacatttgagagcaaacctgtcttatctcacctcttgttctttttctttttactgaggaaaagcaaagcaacctcaggaagtgatgaaaggtctacccaccaaagaaaaaaagggagaaagtcaaaaaacgactctcatttttctagtaacacaaatttactactaaaatgtgagctcgagaatagggactggctgggcacagtggttcacacctgtgatcccaacactttggaagggtgaggcaggagaattgcttgagcccaggagttcaatttaaattaaaaatttaattcaaattaaaaattagctaggcatggcggcatatgcctacagtcctagctacttgggaggctgaggcaggagaatcacttgagcccgcaagttcaaggttgcaatgagctatgactgtgccactgccctctatcctgggaaatagggcgggacctgtctctaaaaataaaaataaaaaataataggaactatctttaatatatcttgatccttgtgtatggcccatccacattaaactaatgtcaaaacatgatacatctcccatttggatcagattgctcctacaggcctgggactatcacccaccatggcccttagacctgacaagctgttaaggtactaaatcagctctgatcaatcttagccttctcctggaggggaaattccaaaatcctcctcaaaaaatttttccattgctaagtttcctatttagattaatggccatttcctactgggtttaagcctcttgcttttcagaagactgatcgcattcttctttacatgacttcaggttaacccagcagcccttaattctgtgttaatctaggatcccacagcattttccattttctcaaactcctcctcaccataggttcagcctctgaaactatgacctcactgctgctgaacagtgccgcgctgtccctgtgctgctttgccttcctagaagacggtcccctaaccttctccaggcgcccctccacccccacctgctaggctccctcaaccacttctgcctgttccctttggaacagagctgactcacctgcccatcctctgccactgatcacaatctttcccaagctgctcttccttgccctaccccctttctttggcaggagtgaataagccctatttttacttacttgctatcaacttctgggtgagctaagtgacaggagcaccagaggtcacttacctccatccaagcacaccagaaatccccatttgtaatccacactgcacaaggctatttttaccagctcttgccttgtcagtttataaccatcatataaatagcaactatatcttgtaggattccttaagcaatcattaaacaaaacaaacagaaattggccccttaagtggacctaatgatgaaaaggacaggaaaccaaaataatgcaacatgctctgcttctgaatccttcggtttggcttccgtggtaacaaatgccgatgggggaacctgggtgtgctggtccccgcagctgacctggggtcaccctagaactctgattctgtagacaggtgagtggagaatggccaaaggagatgtcactgggataggtgggtaggacaacagagtatgtctgtaaaaaacgcagtctttaacacagagaaaataccaatgaaccatcataaattggtcaactgttcatgatgttttgctttgttagtagtgacacatttgccttgagctggccaaatgttctagccaggtttcccttgtgacccatagaatttgagagacagctggccgaaatgaagagttcaaccggggccaataaacagttttcctttgtgggaagctaacaggcccaggtgggtgtcaaaaccagtttttgacttatgagtgttgtgatttttaaaactcagctataggagcacaaaaaaaaaaattggaaaaaaacaaaaataaaaatcattcctgggttgagctatataatacatgacatacagagtttcaaatatagtgaaatcaaaatcactgccttctagagaaagtatcttactatgtacctcattctaggaaaaaggacaaaatgttacttgatagcagagtggtctgagatccttgaggagtataaaaaaacacaaagtttgatcacaacttacatcaggtcagggcggtatctatggataattgcacaaagggccaagccacttttccaggacatggtgagatctgtcacgtttacccctgcatagccatctgtctgcctctggcaccaacccagcagtttgcttgaacgagctacagactctaaaacaacaaaacacagtattattggaggtgtggtcacctggtaatgctgacagagaatcctctttgtaggacacatgtcccctttgaaaaattactgagggtagggacgaaacagtcaacactagtttccatgcaaagaaaacagtgaggaacaaggttatgcaaatggtatcatgacagcgaattctaagaaaagaaactactagtttatccagactctaaggtcaacgtccaccccccagtaccctgagggaccacagcctgacagccacaacctgctgtccccacggcactgaggtggaggagcgccacctactgtgtggccagcctggcttacagcagctctgagttcccggacagtcgctggcacctagctgaggaagcctaccccctccaaagtaacactgggaagaggagaggagaaaaggctccattctatagggtggcacgttcaacccaaagcacccaggcctcgcccttgcacttccaaggcactgtataacttgccaagagaagaagccctgcagggctccgctgacaaccctggggccccagaccagacagtccccgaacagagcttggcaccttgtactatgaattctcaaccctgagaaactgaataggcaaacacatgtgctgggatgctttttacagttcattgaaacgtcttctaaaacccgaacagcctctttaaaaatcctattattaatcacatcagaagagctctgatatcggccattcaaaagaatctatgaactatttatatccaagaaagtctgttcccttaccgagggcaactgaagtttgtactaagtcatttagtaatttgtgaacataagctaaaaaccaagtatcatgaaaatcctgtttcatttaggtttttcgccatgaaaatgtattctgcgataacacataaaaccaccttctggtgccatctcttggctcagaaatgagcttttactcagatctgtctcctatgtgtatatccaaccatccaatatgtaacaggcaacttcaatattccatgctctaaaataaaaacagtgaataaagatacactctctgctttcaaagagaagacgctccagtggagaaaaatgcaaatgtttccaactgcctgctggtcctcacatccaccctggcatcccaatggcacgtcaaattcacaatgtccaaatgactcaaacctctcaaccctctcagccctccctctgccttgcctacgctgatgtagcaccatctacaaacacctacctcttgccccacaaggtgatcaattgcccctgcccatcgacttcacctccttaccattctctctcacataaccaacaatggcaatgaccatccaccacaggcccggcactcatgatcacaatgtgaggtagacactgctgcccccacttcacagacaaggaaatcgaagttcagagctattcaatcacctcttcgaggccgcacaattcaccagcagcaaagcttggcctgggacccagttgcacctggcccaaagtctgaggtctcctccactgcctcctcccttcttcatccccagcatcaggcccagatctgggcctccaccaccttcagcctgactatggcgaggtctttctacctggtctccctgcctctggtacttccctcctccaacccctctcacgtgtggctgaccaggtgtactcatgtcattctctttcaaaaaagtattcagggccttcaatacatacaaaatctggagtggtcctcacctgtcactgaatcctggctatgttgcaggacccagccaaagactttttccacaaagtcttctcccgaaaccttagctctcacactctctccctctctcccctctgccccgcgtctgtacctggtttctctctgtgctctcgtaacacctcaggccaaggtaattccgtgtggtggaggcctgtctcgtgcactgcgggatgttcagcagcatccctggctcctgcccacccccaatcatgaccatcaaaaatgtccccagacaactaccaagtatcccctggagggcaaaatcaccctgggttgagagccactgtctcagacagtacttcggccactgcctcggaccgcaccttgtggctcagggaatgagtatagacttctctgaaggggctgcctgcattttaaaaagccaccaccagaactcaccattgcgagtcaatttgggggtggttcgggaattcaccaggctctccatttccaggtgaatatcttttgtttcgccagtatcatataaatggcgcacctggcagaaatttacaaagtcaaacagaaagaaaatcaaatatcaagtaacaaattcctacctaagagcagaatggctgaaaggaaagtctgggatagaaggctgggtaaagttcagacagaagttaggatgatgacctttaaatcttttatgaaataaggtggggtttgagaaaaacaaacacattttaactgtgggactttgtgctagaaatcagctacacagggccgggtgcggtggctcacacctataatccctatagttggggaggccgaggccagcagatggcttaaggctaggagtttgagaccagtctgggaaacacagggaggcctcgtctctacaaaaaatttaaaaattagctgtagtcccagctacttgggaggctgaagtgggaggatcccttgagaccaggaagtcaaagcttcagtgagctgagatagtgccaccacaccccagagagcctgggcaacaaagcaagactctgtctcaaaaaaaaaaaaaaagaaaaaagaaaagagagaaaaaattagttactcggtcatggaggtccctctaagagtctcggttggactactaataatgctgcctcttaacagaaggcctaaaggtataaacttcaagtagaaggtgaacagaaaattacactaggggccaggcacggtgggcagatcacaaggtcaggagttcaagaccagcctgaccaacacagtgaaaccccatctctactaaaaatacaaaaattagccaggcgtggaggtgggtgcctgtaatcccagctactcgggaggctgaggcaggagaatcacttgaacccaggaagtggaggctgcagtgagccaagatcgtgccaccacactccagcctgggtgacagagcgagattccatctcaaaaaaaaaaaaaaaaaaattacactagaacaaattctttcaagtgaacaatctcttttgtcctcacaataatcctgtgagtagtcagggattattattcccatttttcaggtaaagaaattgaggttcagacaatgtaagtcacacgtgaccggcagcaacaacacaggtggaagttacctctcctcactaaggggcaagtgctcttccgtaaagtaagaatttgaattagaagacgtggcataaaggcctggattcctatcatgtttgattttctctaagtcatttaacaactctatgccttagctctcaatctgttgatggaaaatgctatctacttctaccaattcagagagacatctacctggatgactaaaaaagtatccttgtatgtgtggtattaataggtgcacgcatctcaacagatcagaattctcattggtcctgcagatgggcccagatgtaaatactgacaagaaggtcttacctggcttggccggaggaagttgacgttgatattgggataccgagtgacagggtcgatactgtactggctgaagttcttactcacattctcaggggtggtctgaggcagcaacctgtaaatactttccctgcaataacacaacaatatactcagaatcgggaccagcaccatgaacatctccctctcgtttcatgattgttctgacagcgcagcaagtcacctgacatgcctgacaaatcctcatccttgaccagtcttcttgagtcctacgtcagcccctgctccccacacccacctgcagtgatcccacaggaaccgaccgggtaagagccgaggagagagagcaggcacaaaaccgtgagcgcccacagatgctgcctccaactcaaaaggtcacacatttactcttttattttttcaagcatcccaatatttacttcaattttaaagaaaatcaacacaaaaaagaattatcactatatttagtcagaataccttaaataagagacaaaataagatgatatcaactcccaatttcatctgggaaatcttgtctctctaattcttctggttaaggcattagttctttatcagaaagcaaatcacaggatttttattgcatttgcaaaaatctgcttcaaaatatcccatttaggggtttgagaaacacttataagcagtttggtgttttcctatgaattcaaagctacttttaatttcttctctgtcagtaagaaatttatcttggaaaggagtaagagaagacttagtctaggagactcatctttaggtttctatgattttatgaaatcctatcttgcctttcctcttttccacatgaaaacatctttaattaagaaggcagagaaagaagaaggaagaacttgcactctgcctgaagagtaaaccactccttcttcccagttttctcatgaaaggaaccccgggttacttcccattacctctctgccagcacttccaaagggctcgttcctagagaccaacttcggaccatccaggcagagtccatagcagctagaaagccccgggctattcctgttcccattggccagaaaggctgtagataagacataaaacaaataattaaaatataacacacctttcaaaatgggaaaaataaactaaggaacaaagagtttgctgtcgacagtagtgtttggcaactgtttcaataacaaattgctctccttcccagattggcaaggagtaagtcaaaaaggggcagaatttccactcatacttaataggcctgggctcccagtggcctgtagccctcctctacttcctggtgtgactcctgcagggagtttacctgtgctgtacaacactgcagacgctcattccaagacccaggatgcccagattcactcctaattattcctgcccctaccacagagtgctgccatgcttagcactcacctctaggaggctgtccccgaccagagccactagtaactggtgtccgttctgctcccgcaccaaggcggcgttctcggaggcatacatacaagtgaagtcaaacatggccacatcgggctgcccatagtgattgatggcaaaatccagagacggcagctgctgctgggtagagaagtctgccgcctccctggcatagctgagcagagcctcctggtccacgttttctcgggaaagcaggagctctgtgtcggcgtagtcctgtctccagagaaagaggagggtagggatggagaagctctggcactcagccagaaccatgttacacaacccagggccacagcttcttcttccccctaaagtgactccacgttccaaaaccaaaacttttataccattaaaatgggcggggggaaaggcagccaggcacaatggcccacacctgtaatcccagcactttgggaggctgaggcgggcagatcacttgaggacgtgacttcgagaccagcctggtcaacatgatgaaaccccatctgtactaaaaatacaaaaatcagccaggcatggtggtgtgtgccggtaaccccagctacttgggaagctgaggcaggagaactgcttgagcccaggaagcggaggttgcagtgagctgagacagcaccactgcactccagcctaggtgacagagtgagactccaactcaaaaaaaaaaaaaaaaaaaaaaagaggggtttggggggtggattattcccgagagaacatagaccttgctgcctaaacacacagtcatggcttttccatttgcttggaacaatgactacttctttgatcttatccaatctgcctcagggttgttctgagtatcacatacctgacagtactttgtgaactgaaagggcatttcattatcttctgggtagtaaatggcttttgtcaaatgggaccacgtgaaacactcagccttgcataactcatgacacccaaaggaagaactcaaaaaagcttgagtgccaaaaagacatggaggtgggagcaatggtagtccaggaggctgggaaggaatatgttgaaaatggagcagaggttttcaaaatagtaagtaagacttgaaagcctccacagaaacccacaaagaagaacaaaggactgaaaaactccttttctgttttggaggttcctggcacactgagccaagtctttattctctgaaagtggggcctacggtttctaagtggccatgatggtcctttcagccaccactacaagatgttaaagccaaaacacaaacactcaggttggtcctagaaagactgtttgctcaatactaagtagccacatgggtttactatttaacagcatacaccaaaggcatggcccctgccctcttaaaaaaaaaaaaacatgaaggcaaagtaaaccaggtctcttggcattctagactgctcctatcaaattgtgactgacaaccacagttctgcctgcgtggcagatttaaatcttcaccttgtcccaaggcgtacgaactgcttcactggctatttcttactgacagcaatgtaaccctgatgtagtcccagataattagcaaggcaattttagaaagcatctaaccagatacgtcttgcttatgcttttgggaaagtgggctgtataaacagctttgtcctggttctccctgaaagcacacagggtggctgtgctgagaaacacacgcaaggttcctgggtagaaagagggggctctctgccaccggcacatgctcgtcagctcactccccgctctgctgtcatataaggtagtactgtagctcagactaaagtgactgcattcacatcaccctgcaaagacaaaggactccctgaaattcagctgtgagtctcttgtgggaactgcacaggcctgaatcagcacaactggtgtctctgcttctgtttttctcatcgcatggggacagtgattctcacgttgagaccagtgagaccaggaaagacttaaaaaactctccttcagggaccatccacgcggtggtcttctgacttcatatttcaggccatcatctcagggcacaccatgcagtcacctagaaacaggctgagctggacctggctatgatggagctcagacctgttctgtggtcataaagaggcctaagtgtagcctgatcctgtcagtgctgcctggacctctgaaaactgtatcggcagtgacaccagaatcctcatcaggctcccataaacaccaattattgcttcttggtcaaactcctttccctctgttgctccccctcccaaaagataactcttcaaccaaccaatcatcagtcagatatggaaatcacaataaccacaaaccaaatcacctaaaattaaactgagtatttatgcatgaaatgctgtctgaaacctgctttgcaagaatccagtggtgaagaaggagtgcacagaaatattactgacagaacactggccacgtgttgagaactgtgaaagctggacggtaggtacgtgagggttcattacactattctccccccgtttttatttacatttgaaattagccatagttaagagttgttcacgctaaactggaaaacatcaggggttaccagaagatgcattcagtgctcattttcattcccttgcaggaaaaacccatcagacaattctttctcttggtgatattaaccacttcaataagaaagagttttgaaggaaatccgtggctcacatgtagtatcactcctttgtccagcaaactctgctttttggctgtcataacgaaatagtgtgtgtcatctttgtagtaaacgatgttctccaagtcaatacctggggccagaagacaaacgtgtgcatgtaagtttgctgagatgaaggtgcatcagggcaggctgaaaggttacacacaggcctacagagacaagggcctgaggctccaggcagggaaaggtgtctaagcccagattctcacgtcctgtatcatcagttcatggaaatacagggagttttgtttctctgtattcactcaacaccccaaacaatcctaaaaactatgactgacagtaaacagaactgtttttacgggaataaaaacgaaacaagcaaaaaaaaaagaggctaacctctaaagagggcttggattagttatcgggttaagcctcttgggacagtcatcaaggaagctggaggaatctcctagattcttaagaacaggatagacaacttgacgcctggaagcagagagtgaactactgactttttaattaatctaaaaaatagatgtaatgaaaagaaatcaagttctagaaaacaagagaatgaaggcacatttagcaaaatatctaagttgatctattcaaaacctatcatacaacaatctcatcgctatctgacacacggtttgccttcaagcctgagctggaactcaggaagaagactacatacttaaaaggcctaaagtcagcttcccaagcaaaccagggagccaccggccagcagctacaccaagcagcatgcctcagcatcacagcacagggcaggcattgggaagaactagtggaggcagaacgaatgctttacaacaaataaacgaacaaacaaaacctcaggctgggtgtggtggctcacgcttgtaatcctagcactttgggaggctgaggcaggtggagcccaggagtttgggagcagcccgggcaacatggcgaaactccgtctctacaagtaatacgaaaaattagccaggcatggtggagcttgcctgtagtcccagctactcaggaggctgagatgggaggatcacttgagcccaggagttcgaggctgcagtgagccgagatcacgccactgaactccagcctgggcaacagagcgagaccttgtctcaaacaaaaaacaaaacccagagccgcccagtcactgtgaggaggttaagaatacaagaggaggagacaagttctgcaggaagcaatgcgctaggaagaaggaacaggagtgaaaagagcaggaggggcagacagtgcaggagggacaccgacggccactcaccccaccaatcccccaagaaaaagccaccagggactatttaagtttctatcctagggctccggagacatcaacaccaacctgtggcttccctcagttcctggaaaaatttttggttgaatataaaagccacaccactgatctcttccactttagcttctgctgttgtatttcggttgataaaatttgccgtgatggcgatggccagtttgccacggaattctttccgacgaaaccctggagggaaataaattttcagaggtgataatcattggctagagaaggaagatcacttcagataaagtgggggtgctgataaagacaacagggaaagtcagggatgagaactgatgggaaagttagggcagctcttctgcagatgaaaataaggcatttacctacccaagaatatgaaaattcagggaagaagtcaaagtctccattaacaaacaatttgaaatctgactggccagaatattactcagtactagggattcctctttaaaaaagggatgcgtggggggagcacctgcttattaatatgtagattaagtcctacaggtgccagccactcaaggtatggttggtctcctagtgcctcagcaagagtgccctgtaagcagcagcctgggccaggtgaggtggttcacgcctgtaatcccaacaccttgggaaaggcgagcagagtgcttgagccaaggagtttgagaccagcccatgcaacatggcgaaaacccaatctctacaaaaaatacaaaaattagctgggtatggtggcacgcgcctgtagtcccagctactcaggaggctgagatgggagactcgcttgagaccagggagatcgaggctgcagtgagcgtgatcatgatactgcactccagcctgggcaaaagaacgagaccctgtctcaaaaataaaataattaaataaaataaaagcagcagcctgactgccagctggctagaggatggtggggcctgccattccatcagggcaggaagcacacattcaggctctcaaaagggtggacgctggtcacgcacagtctcgccccagaggtaggatagcatcagctttccctctgctatgagccaggcagaggagcacagaccaataccttccaaggtgttcctccgaccatccccaccgatgatcacttcaaattcatactctgacacaggatgagtcttggggtgcaccagtgcccgccagcctatccctgtgaaccaaaaccaaataaatgggggtcaccacccagaccacattcacagccaggaccatctctagatacccagtcatgtgaactgcacaaaaccctgggccaaaaacactatgtgtagaagcagtggagacagaggctgtgcacggtggctcgtgcctctaatcccagcactatgcgaggcagaggctggcagactacttgaggccaggagttcgagaccaccctggccagcatggtgaaaccctgtctctactaaaatacaaaaattagccaggcatggtgacacatgcctgtaatcccagctactctggagacctacgcaggagaattgctcagaggtcacagtgagccaagattgagctaccgcactccaggctaggcgacagagtgagactctcatctaacaaagaaaaagcagtggggacaaaccacagaaggaaagaagccttgcagagggctcacggggcccttcccaccacatgtgcgcctgcgacatctaaggctgcatccaggccaagtccccaaaggcacaggctttggctagctctggaagcagccctcaggagcctttggtttgctccctcaatctcatcttcctcacccatcaacaccctctcacgccttcttcactcctccagtataacttacgttcattctcttggtcctcaggaggctgtataagtccttggaattccacattgacgtggatttcaatgcctaggatcaaggctactttcaaaagtattagttggagctgacggatacctgggagaatacagagatgacgttgatgggaacacatggagaagggggtacccatccgtgtcgcagctcaggctcccaccccgccacctacgcccccttcattcagattcccaaagcctgctgtagcaggagaccttccaaagccacgctctgtaacttcttcctttcttaaaggcaaatataacccagtggaagagctgttctagagcaacacacaggacactcccacgtctcgggttcagtgttttaaacaatcaaaagctcggagacaacatgggactgtggcctacaggaggttcctttccatcttcccaatttggggctgccatattggcagcatctccaatcctgctaggaggcagatgtgcacccacagggtgcagcccacggtcagatgcagagctgctgcatgacctccccgcccacaggcgtctttcagcccattccctggttgatcatcacacattcttataaggcaaggaagggaaatcgcaatccaactagatcctcctaccattccccctcccattcctggtctatagctgtggaaactgaggccagaatgactgacaatcttgcttattttcatagtgagactgattgatttattcgacgtccatgagcacctgcaggcaccaggcatggcagcgacttaaggtgcagagataaagatctaggccctggtagaagaccctctcaaccctaagatgaatcttgccacaattaaggcagacaaatccactgcgttaatgacccttggttctctcttaagaccaaacttaactggagcctgtgactaatgtgccaggagcaatgcaaatcctcctcacgtcatcttggttgttctccccagtttaccacagccaccacccttctgagtcccattcccaaatacttgttaagctctgcgctagcacagtattttcgcagagaactgtgggtcccaagatgctttacaaactatagccagcagatgggcagagggcttcctctgccagtggaatgtggtcactgccagccagcgtctgataaattggcacagctgctgcaaacagcaaaaggttccatgactgactgtgtttacaggacacatctggagaagctcagaacaaaggctccttgataaagctttcctgaaagcattaatgataatcaataaaaagctttcagtttcataacgcacactgtctgttctgaattgctttgctggccacttacagtcaaacaccgctgattgcattaacttgtattcataccctgtaggatctcagaaaagcaaaggcccgggctgagcttagaggtgacaaaagaacagcaagagcttgcagaccgcacaagaaccacctgaccagaggaatgccattatccccttgccattaacggccaggccagggctctgcgcctcctgcaagtgtggctccccccaggactgtgtccccacagcactttgttcttacattagtagagaatgtatcagctcacagcacagacagctgcatgcttgtgtacttctgccactgcaagaaggaccaccagagggtctgggcccaaactggtcatcgtttccccagtgcctgccccagtgcccatcccacaaactgcaagagctcaggaagagtccacgacctaacagaaatcctcaagccaaaccccacatttcacaggttatcgatacactcacatttaagagtcctaaattatagaaccaccacatagcaggtgtttttacttcaagatgagtgcacttactataagaaagacagtaatgagattagaagaaattgggtggcatatgaattcctcagctaatctgcctgtctctttctactgaacaagcgtgcaaggggtagggtggaatcttacaggaaagctagttttacttactgatatggtcgatggctccagcacagaacttgccatagaacttcttggcacccagacctcgtagatcatgtatggtgaatggccagagatgcaagacgttgttgcgggagaaggcatctcgtttctcaataacaaccaccttggcccccagtaaggataagtcgatggctgtacggagaccacaggggccagccccaatgatgagacactgaaaaacacagctgctttcagggcaggcggcacttccaacaaacaattctcaagaagtctcatgattgtaagatcatcactccctaaagccccgaaatagggctattctccccactgccaagaaaccttcacacctacgtgggtcacagcagagcacctgccatggcttaagagaagagctagtgatcaccaccatgaatggagaagacagaaccatcagtgctagacacaagctcggcacctgttcaccttggacagcctggaaggcccttgatctgcagcatatttaagtggccatcatctcaacaaacgatatgacaatcaaatacaatcttacatcaacaggagaggaccatttcgaaggtttctaggtcaggcagatttctgtccaaagagatacagagtactacatacacactccaggcaatctcaagcctcctggaatgagtctaccacacacatgattcccgggaagcaattttcaagagccaaagttttgtgtgctaataagagttccaaaatccccatttctagactgaacgtccaggaacatgatctcgaaaatccacactccagagaagtactgagcaggagactggacacatatcttaagtagtttgctctgtgtgtgcggaaggaaaacgtgcaatgcttttggctttgtttttgttttgttcttagtggagtccagtactcactcatgaaagtcatgcctttacagttcttgaattttgctgatgaatatctacccaaatgcaaatccactgggggtggggctctaggtatcccctattgcacaaattaaagctcgtgaaagaacataacgtagccatgaagtcatctgcaaatttgtgtccctgctagcttgttccaaacttctcacactaggtgttcttctaaggagggaagcaggaaatgtacctctccatatccgcttcctcgcacctaccccgacaaaggcaagtgcataactcaggtctttgcttgggcctacctgcttcgtggaaaccccatttctccacatggtgaagaaagcaacagaaatactttggttcacaaagtccttgcttatgaatcaaaacagacttttggaacatggatgggaagaggttggaagcttgtggcaaatgccaagttcgcaaacagtataccttaccagctactgagtatggaactttggaaagaggacatgccaagaaccccaaagccgtgttcagacaggataccagcagggcttggctatgtccctgctaagtgacctgcatcctccgaaccacgtgaggttcaaaagagagcttcagcaaaataaaaggttcccatgccacttgactttggttgttcttaaatacttgaaactttgaacgctcaatatgtaaatacatgaaacatgcttaaaacagggtctgggtcatgcaagtcaaacaaaaagaggttagacatccacaaaatttcaacagggttgaagcctgatttcttatgctaggttgtggctagactttgcctggttctcactcagcctacctctaactcaatcctcctctttggcacctggatatggtcgatggctctggcacagaacttgccatagaacttcttggcacccagaccttgtagatcatatatggtgaatggccagagatgcaagacgttgttgagggagaaggcatctcgtcagtgaccccagggcccaacaggagcaaagcttaccttggtgttagtgcacgcttttccctttttgtagtctttgtgactgccccgtttgtccaattttgcccagagggctttggctttccagtagttaagcttggacttgagcttgtgatagaaggagcggtagtcctttggctttagttccaggtggtcacagagctcctggaaagccttgagggttcccttgcaggtggtggcctggacaaaccggtcaaagaggacatgagctgggttcatggtctcatgcttcctctcctccatgctgcctcactctcagcactccccagagggggaggtgggatggctgtgggtccacctgacactgtcacgttaatctgacaaaaagaaagaaaaacgtggttagcatttctctgtctacaaacattctccaggagacatattcctcttcaaagcagagttctaaagtgtcgcagtcatccatccataagtgtggactgcacacctgcaatactccaggcactacgaaacactggggctggaaaggtgagcaggatggttcttgctctcaaggatctgacagtctaggagacgaggcagacacagacacagaatgtctcaatggactgtaccaagtgccactagagagggagacacaaggccatctcggaaacagagaaagaggatctaagtcactattggtggtgaagggggggggtccccactgaaggcgagcctctgagaggtgacagctgagtctctcagcataaatgttagccaggcagggaagaggtgtaggacatgggaaagtgacaaagacaggcctgagtgactcgtacagatcaaagaggcaaggataactcccaggtttccagcttaggccccggattaaacggagacatcaggccaatggattaaaaacagaagcactccttggtgccagtggagcagtgagccccttcctcacctgcacacgtgagctccaagtggaggtgcttaccgggaagtcggtacaaatgtgaagttcagggagtggctggggacgcagatccagatttgggagtcgctggcacacgggcagtagctaagcatacaaaagcaggaagatcacgaaaggagagtgcacagggcagaagagccgcagactctggaagagatccaggaggccccaccttcaagaggctgggagagaaagatgagccctcttaaaagatgaggaacagtagggagaggtctgaagagaaccaaccagcagcatcacagaagtctaaggagcagaaagttcgagagtgtcaaagttggcagggattaaaagaactgaagaagtcctgctattgcgtaaggtacagggttgggagacttcacagtcattccattttcaccctgaatcgaattgaacagcagtaaatgacgatatctatgccttccacctatggaaatgtccgcacacctacgtccagtgagtctgctggacagaggctgggaggtgggagatggcaccgcgtgtactcctgcacccaccggctcctgtgagtctgcagaatcgtttttgcgtcacatctgatgaaacctcaccactggaactgtattggaaggtgggaggcaaaaggacaaaggacaaaactagtgagtagagagtgggtcagggtgacaagacgagtgtgaccacagggctgagcccacacagccagaccccagctgcacgaccccgctgcacaactctgggtaagcactgttgcacgaaccctcagtttccttgtgtgtaagacaaggaggttagacagcgcccctaagactttctttttttcttttttttgagatggagtctcgctttgttgcccaggctggaatacagtggtgcgatctctgctcactgcaagctccacctcctgggttcactccgttctcctgcctcagcctcccaagtagctgggactacaggcacccgccaccacgcccggctaattttttgtatttttagtagagacggggtttcatcgtgttagccaggatggtctcaatctcctgacctcgtgatctgcccgcctcggcctcccaaagtgctgggattacaggtgtgagcctggccaagactttcacttctgaagttctccaaggctactgctgagaaatccacatgcccacagcacttgctcctggtgctctcatcacaatggcccagcacaggcacatcaccaattcaccacgagagtgaccaacacaactggactggactttgctttaaagatgtacccttggggttgggtgcagacagaggaagggagtggttgatgcactacgttcagcaggcatgtagaagcaagagactgcccactattcagctgcaggtgctgctgaaaccaactcttggaagacaggcaccatgttccagaatgatacagaagaggccctgaagctcttactttgggtaagcacactgagcagcagtgtgaagtagaaatgacatgccacttctctccgcacctcaccatggtatcacaggattaaaccaaaccaaatgagatgcatcttaagtttcatgagagaaagttgtaactaaatacaaggaactgccctctccaccttatattttctatgtcaacagacacaacactcgtcacataatgtggaggatacattgcagatggaacacactggctgggcttttcgcctcaaatatatcacgtactcaacaaaccctcctggctctagatattaaaaactatactgctggcccagtgtggtggctcatgcctgtaatcccagcactttgggaggccgaggtgggtgaatcacttgaggtcaggagttcaagaccagcctggccaacatgatgaaaccctatctctaccaaaaaatacaaaaattagccaggtgtggtggcacacgcctgtaatcccagctattcaggaggctgaggcatgacaattgcttgaattcgggaggcggagcttgcagtgaactgagattgtgccactgcactccagcctcagcgacagagtgagaccctgtctcaaaacaaaacaaaacaaaaacaatacactgttaacacacatagcttctctcaatagccacatggccaagaggccagcaagaaatggagttaactggaattaacattcagtttccccaaaaaagaaaggttttattctaggtagcagcaagagaaatactttacagttcctaaaaagggcccattatttatcttacaagccaaggcttatcttagaaatgttagaaagtcaaaagatggcttgtagggcaggaaagagcagatgtgcttatgtgaaggcaggagaaatggtgacagctgacaacccatgactagaaacaaaggtcccacaccattttctacatcagggaccctctttgcctcctgacctctttgtgggacttctgaggcttcacttgctctttgacaagcacacagcatggcacaatcctgaccctgtgtgccctgcctgcattcacagtcaacctgaactccaccagagtcacagtgtttggtaagctttgcatacactgggtctgatccaccgctacctcatgtcaaagaagaaaatgacttttctttgtttctaaacagtagccactttcaactccttgccaggattcagagcactcagaaccatgacattcttgctgaagccaatacattaaaggtcctgcaacccataactccaaaatccttcccgtcatagcgcctgccttggcttacacctaccctgaaagagggtcttgggcacttatttcccaagaagagttcttacgtgtgagctaacaaccccatggctggttgtcacccactcggtttgaaataattcacttccaaagagctgctaaccgccacaaagaatttccaaatcaaaccccactacagaggaacggcttcactaataactgtccccaatccttctgctagtgaaaacacttttaaattaacagatgtcagccacagctcccagagagctgcagagccaaccagcaggcaagttttaattccccggccgaagagatttcgacctgcagggcactggtgacaatggatgaacagaggcaggatggctcctggaacaatgcgaccggcacccaaggtaagacgacacaagatgaattcccttgggctgcctcacttttcctgctttgcagctgaatgatgactgcagcgcaaagactcctccagagtgtgacagcattgctctgtggctctgctgggctgggcctgtctcactctgcaaggggcttacccggcattctccttggctctgacaacagccgggaagcacagcagagcagggctatttctgttaccgcccccatttccctcattccttaaggtcaaagccagatcatgctcctcctggcctgtcctgcaccaccctgtgtacagttcataatcacaggaacctggagaccaggaaacctggcaggaaggtgccagaaatcccagaaactgaaaagccaaggtgtgcaaggaaggggtagaggaagtgaggagccgggttgggggctgggggaggaagaggaggtgatgccaggtttccaggcatctgtgagtctctgccagctgactccagcctgcatgttttgtccgcagcagctgactgctgactcagaagccccgcatgggccttggctgtggaggatggcactgcagagacggcctctgaagcacacgcaggacatggttatgtttctatttataacaatagttgaaggttgtcactgacttctggctggctatgagaacactcaatctctagctcttagaagaggtagctggatgtttgtgggggagtagaaaggagaatcatgtttaaaaatagaaaaaaaaaaagaaacaaaacaacaaaaaagaatgacacttcaagagtatggcatcagagtgaagcttagttttctccctagccaatgcaccatgaacacaccagcgaacgtgcaaatttctgaatcttacacagcaatctgtgaactgcgccttcccctagcccattcagtcagaggtatgtctcatctaaacagatcttgaaagcgggtggaaggccaggtgaggtggctcatgcctgtaatcccagcactttaggaggccaaggtaggaagatcacttgagcccaggagttcaagaccagcctgggcaagacggtgagatcctgtctcttcaaaaacaaaaaaattagctgggtgtggtggcattcgcctgtggtcccatctacatgcgaggctgaggtgggaggattgcttgagcccaggaggtcgaagctgcagtgagccatgatcatgccactgcactccagcctgggaaacagagcaagatcctgtctcaaaaaccaaaaaaagaaaaaagtaggtggagaggaacacttgatcatattttccctcagaaaccaggacccaaatcgccaacatgcctcgggctcctgatctgtcttccttcaacataggcaacttagcatcattatttgaaaagcctgtcctttccgtactgagtagtcctggtatccttgtcaaaaataatttgaccgtaagtgaggtgcatgaggctgaagcaggaggattatttgatcctcccaggagctagactccagcctgggcaacatagcaagaccccatctcttaacaaaacatagtttgaccatatatgttagggtatgtttctgggccctctattgtattccattggtttatatgtctgcctttatgtcagtaccacactgttttgattagtatagctttatagtaagttttgaaatcaggaggcatgagtcctccagctttggtctcctttagaagggctgttttggctattcagggtcccttgagattccatgtaaattttaggatgggtttttctatttctgtaaaaaaaaaaaaaaaatcattgggattttgatagggattacactgaatgtgtattgtttgggtaattgtgacatcttaacaatagtaagtcttccaacccataagcgtgaatttgttctcatttatcttttaatttattccagtgatgttttttagttttcactgtacaaggctttcacctccttggctaattcctaagtgttttattatttttgatgctactgtagacaattattttcatcatttccttttcagactgttcactattagtatataaaaatgtaactgatttttgtgtattaactttgtatcctgctactttgttggatttatgtactagccttgaacaggtttttctggtggaatctgtaggattttctacacataagatcatatcatctacaaatggagataactgtcttcctttccaatttggatgccttttaatttctttttctggcctaactgctctggatagaacttcaggattatgttggatagaagaggcaaaagtgggcatctttgtcttgttcctgatcatacgaggaaaagctttctgtctctcactgttgaacataacacgtaccatggtttttcgcatatggcttttactaggtgaaggtaattttcttctattcctagtctggtgagtatttctatcatgagaaggtattgaatccacatgtattgcatcctgggatctatcctgactctccatcctatttatcatcaagctgacactcagcaggatggagaggaaacatgaagccagctcctccccccaccactgtgcccttcccctctcctgcctgtcacccggctgcactcctcatctgctcctgccactctgcaaggacattatttaaatgtctctctcctccattgtgaacttccttagggcagggactgggtctctgcgctataacccgacctggagtagaaataagtcgtgtttctgtggaggtgacgagggtaggatggagcccagcagctctgtacttgaaggaccggtcctggggaaagcactagcctggcctgcgtggctgcggaaggtgaaggagacctggacacatgttagagaaagacttccaatgtgctaccaaaacgtggtatccaggaatgcaacagtcagcctgggcgggcagtgacagtctaacaggaacactgcaagagtgtggcatttttctcatgaccagcactctgcttggctgggtgtggatgacccctctctagaggcatctgagaagagccagacccagatagcctctgggttctcttccaagtccctaatcctgcaggactgtagtacagtcctaacacttatgttgtatcttttctaattttcatttctattctttgctaacaacctatttcttcatgaaaaccaagttaagaacatccacgcagctgagaaatgaagtaagtcagaagtgacctgacctctgccttgcagttctgtcaccccaaacacattaaaatgtctgaatcatagcgaggcacccaataaacacaatcactgatgatgacgtcaactcacgttcaaagtaacccccaaaacaagcaatcaagaagaatgcctgaggctcaccatcctacagtctcctcatctgtaaaatgaaaatcacagggttttgtaggaagtaaggtaacgaatgtaaaatgtttatcagtgccaggaacagagcaaggaccaacccacagtagcgctgttatcatccagcagtttatcaataaactccagcaatgaaagcgcatactcagtctaaataaaaacggaacaacagggttcagatggttttgttttttgaaggaaagaaaaatggtttggaactttctctgctccattatcactcttcccctctccactccatctgttctagaaagcgtgagaatggcattgggtggaggggggtgctaaaggagtaagatctgtgtaagtcctgctaaactgtagtgttaaacaagacagatagaagatactgagtcgttactactcggtgccacatccacgcctatggcatcttcaccaccatcccgcgaggcaggatgtatgacctccattttgcagatggggaaaggcatgttttgggtccagacttgtccaattgagagcctaagtccttagccatcatgaaaaaccacctgagaatacagcttgagaaatgaaagctcatgagaatgcatgcctccagtccctaaccacccgagagcaggaacttgcctgccaggaagatagctgcccagctagcaatggatatgcagtttcaagtaaatttagcaaggacacacaatacaggattctttttctcctcatgatttatcactgcatctgctcctttgaaatggagccctttccaaatggcagtgagagcagtctggtttcacagtaattcttcttactggctgccaaaaggctaagcaactaaaacagtgctaacacagtatgtatcagttggcattctgcggcaggctcttgcaccccagccatcagcaacgcctatgaggagtcaatgacaaaacattttccaatcacctaatactactccatccattgtaggagcttggggaaggacagaaggtggacctcaacctgcccactgtcaacagtacagaccaaaagacccacaccttcctgacccactaatctaagagccctgccctcaggggtgatgaaaggcctctgggtggggagaaagcctcattgaggatgtgggaaaacacaaccaaaggagaatcccaaaaaaaagctgttctcctcaagggccggaatccaatctataacgtcggtgcagaagtcagtgcagttacttttgccgttacttttaatagcaaaaaccgcactgacttttgcaccaacccaacactctgcttagcaccatgtactcagttccaggcacacagcaggtgctcaataaggttctgctgattaaagggctacccggtcacctacacttgggcagacccaggaagctggctggttggtaggccgtacagggcaacctccaggccactgcacacagggactcagagaatgccaagcctccagcagtccgaagggagagaaatacctcacgagatgaccggagaacttgtgggaaacatgcaaggtcctaccaaggcactcgggtcaggtcgcttcctccctcttgcaggggcagagcctgcagctaaggctttccgacgctggcccaaaacacagctggcaggagactaacctggaacagaatatggggtttctcaggtgtctcgcctgcctgtcgtcactgccacagaaccacaaaatacactgcagtcaaggctcagcaccatctgaaaggtcatctaggcccaccagccaccccacacctgcctatcgatgacatgtcaacggcaccaagctgagcagcttgcaatcaatgttcatttctcaaggattcgatttctgtgtagaagaccaaaataggctgggtgtggcgactgatgactgtaaacccagccccttgggaggctgaagcaggaggattgcttcagaaggagttcaaaaccagactgggcaatatagcaagaccctcatctctacaaaaaattaaaaaattagccaggcatagatgcacacctgtcgtcccagctacccaggaggtcgaggctgcagtgaaccatggttgcaccactgcattccagcctggggatggagcgagatccagtctcaaaaaaaaaaaaaaaaaaaaaaaaacccaaaaagcaacaaaaaacaaaaaccaaaaaacgaaaacacaatttctcttctgccatggttctcagtttctccaccttctcggcattcttccgcaagtttctatcggtaatcaatgtctatgcccatatcatctgccttccctccaatgatagcgagcgacatctgccgcatgtctcgctgaagccagcctctgcctgtgcttctgatcctgtccccgttcttactcaagcatgctgcctcccacactggtcccttccctgcagtgatcctccctcaccccactgaactgtcttcagcaaggacacgtctttcaacacccagtcctgaccccacccgctccaactaacttactctgctccccttgacagcaaaactcgctgaaagaattgtcaatgctttgttcacaactttctcttctcccactatctttgaacctccaacaagtagaccttgtcctcagccctccacagaaatgcctcatcaaggtcatgaatgacttccatgctgtccaatccaatgatcaattctcaaaccttgttttcctcaacctgtctgcagcacaagtcacagctcactaccgtctgcccccccacaaccccaccggcctccaggacaaggggacactactctctgggtcctgctgtgacctcatagcccctctctgcgtcctttgctggtcccagacccatcccaagcctctgcacgttgaaatggccccggaatcaactcagtctctgatctcttttgaaactacatctccttctacatcagtggcttttaaactgtgatctgcagtttaaaaaaagaagtttcatactgtgatctaggacacagctctcttttcacataaatttaatttttaaaaaatgtttcatagggcaaaattcccctatcagttggcataaaaggaaacattttacaacagcccttactaccgagatattgttttcaattctatttcgttttttgaaaattgctggtgcccactgtattgacttcatgacccacggagacacaagccactgtgaaagctgtgccctggaggatcctccctcccgtagatttatctacacagtatcaataaccaatggtgccttaatatttatttcctctctcctgaacttgtgcgaccaatcacttgtgtgacttttctacctggatgtttgacaggcatctctagcttaaagcactggaggcaacactctgatgccgctcgccagagcctgttccttccctagtgttctgcatcttggtaaacaacaccgccagctacccggacactcaacccaaaaccttgcccccgtctgcatttctgtcacatcccacggtccgttcttcagaaaattctgtgttctaccttcaaatacagccaaatccaaccacttctcaccatgtcttctctatcatcctcattgagacaccaccagctctcacttgctcattgcatgagcctcccctacttctgctcctccaaacccaccctccagaatattccacaaagcagccagagcatccatttaaaacacccatcagacacgttgactgccacatcccagccccaggtcagatcctgccaccctccccaacacccttaggcccagccacatggcctctctcctgctcaccaaggcctccctgggcggggctgccctggccagccatgcagagtgcccctcgctcttcaggtcttggctcaccttatcagagagagctctgctgaccacacccagggaagaaggccccgcccctgccccgtcactctcgacccacatcctgtggacactgtgtacaaagcatgtcccttccctctatctcccctggcagaggtaagcccagctatgagaagggagtagagcatgagcacacagtgactccagagccttctcctgctgaggtgcccatccacagcatgccgcccacccggatacacctgctttgtcctcaaggacaatcaggaattggtaaactgtcttcactaaatttcctcagctgattcagccatgacttcccatctcagccagcataaaagcaaatataaaataatggcctacaaggccctataaacgtgtcgtaaacattttggtctcaggactcctttatacacttcaaagctaaggaggaccagagttcgaggctgcagtgagctacgatcatgccactgcactctggcctggcggacagaacgagactgtctcttaaaaaaaaaacattgaggacccaaagagctatcaatatttactatatgtaaaattaagactgagacaaaatttcaacattaattcactttaaaataacaattaacatatcttaagaaaaaaaaattactttccaagacagaaattcagtgagaagagtgacagttttccacatttctgcaaatctctttaatgtgtggcagccagattctcctgcctgctctgtctgcagcagcagcacatatcacgtagcctctagaaaaggccactgtacacacctgggcaaacgagggtgggaaaagcacataatagcactcagtattattacaaaaacagttctgacctcatggagcgccccccagacctgcacccatacacacgccttccctctgttgcctcctttcctgccgccagcctctccatccctgctggccgcaatggcctccccatgttccccacctaccagacaccctctcacctcagcctccgcatctgcagctccttttgtctaaaaatgctcttccctccgatccgttcactcaaaagatactagtgagcatctattatgggccgaggactcttctacgctccagaaataacagcagtgaacagagaaaacaagctctgacttccagggcacgagccttctaatgcagctgacacatatattcaaatgccagcttctcagtgtggacttccctggtcacatcgtttaaacctgctcatcctctttccctggttttctccaaagcacttaccacaacttgacatactccaaatgtttttggtttttgtgggttttttttttttttgagacaggctcactctgtcacccagcctggagtgcagtggcataatcatagctcagtgcagcttcctcagctcaggcgattctcctgcctcaggctcctgagtagctgggaccacaggtgcacaccaccaagcatagctaattgttttttacttgtagagatagggcctatgttgcccaggctagtcttgaactcctgggcttcaagcaatcctcttgccttggcctcccactgggattacaggtgtgagccaccacactcagcctctaaatgttatttacttacaatccatctttctgctacaatgtaagttctggaagggtgaggatttttgccattttattcactgttgcgtccttgcacctggaacagtccctggaccacaacaggtggtgcacagtgaggaccacttgatgaacaaacggctgtgtatatgaacttctccaggcagaactgagttaggatatgagacagaagtcgtatcaaatgaaaatgaactgtgtgctttcaggcagtggcaccaggctgggagtcacagagaatgggacccctacaaggagagtccagatggcttctgcccagcgggggaggtgctcccctggagacctgccctttttccatgaccacgaccagccctggacctggctcacacaggctctgcccagcaggccccacacccagctcaggacctgttcttgccatcagaagagagcctgtcaggagccaggacctggaggcagctttgtttcaatagccaaatagcttcagtgtaactgttccctataaaaagaaactggtttctaaagaactgcggtatcagtgtcagcaaatgctatgcaacagccccagcccactaccccagagacgagtgaaggacccataacacttctgattccaagttacctgtatggctaacatctgcatgagaaagccacgaagctgccacaagcccaggtgtcagacaaggcaacatttcttcatttgaggcaggaggacacaggactcaaagggttactgcgcatttcatacttgctgggcggtgacggaggaggcaagtgagagggaaagctgcacgcgtgaaacgccagccttgggagtggaatgggggtgggacaaaagcatattttctgcaagtccccgcagtgaggactgatgtggctgtacctgccccgtcatctccacccataggtggggccccaatactgccttctacaataccccactggttcctccagcctgacgctgtgtcttggggcccccagcccgtccccaccctcctaatgaccctcttccggtcatcttttcactccctctccaatctggcctctgtctccaacactccactgagggtgacggtggctttcaagtgagacaggctcagacgcgttccggtcttatctggctagctccctggctgcagcgcttcctggaacccgccctcccctggctgtgctctgtctcctgcttctgcccactctccacaccggcctccagtctctcagctgcaattctttcatctgccgctctcaaaaaattggatggcccttgatttttatcattctgaccttcctccagagatccaaagctactaaacatttccatttagccatccacaggtgcctcccaccaaggaagtctaccccacacggagtcaaacccaccacccaccaaatggaaatctggggtcatctcagacccttctctgttctccactcctcaacccaatctgctgattctaactttagaatgttcatctgcctaccacaatcctggtggaagccccgagattcccagtgtgaaaggaaaataaatcttggggccccaaactcactaagccaaagggaaaagccaagctgggaaagggatcatgcaaacccaccttccattctggttcctaaataagatgactacaaagatgactccctcgcattttgcccacaaggaaattccttgtgggccccaagatctttaccctaaagcatttctgttaaaattcaccatggcaatgtaagttgacagcttatcttcacaggtacggggacataagacagaactcaaagtcatctctctgcccacctgtgacaaaggcatatctgattgtttcctctgctctattgtctatgttatctcatgtaaaaaggcagattcagagtcaaaggcatgaatgactatttttcccttccctcaacatgaaaactgtgtatttcacaatatcccactctttctcccttaaatactgaagctctcaaaatcatcttcggagaaaggcatagaactgtctcccgggtatgcaaccttaactttggcaaatgtatctcttaaaatgactaagacttgagactggccttggtcatttcccttgactgacactagcttggactagcacagctgcctcttaatcttttcttttgtgtgtgtgatggagtcttgctctgttgcccaggctggagtgcagtggtgcgatctcagctcactgcaacctccatcttcagggttcaagtgattctcctgcctcagcctccctagtagctgggattacaggcatgtgcgaccacacctggataattttcatatttttagtagagacgggatttcaccatgttggccaggctagtctcgaactcttggcctcaagtgatccacccacctcggcttcccaaagtgctgggattacaggtatgagccaccgcgcccggctagctgtcccttaatctaaactcgctccaatacatcctccacgagtgccagaggggtcttttgtaagggccaatgtgacccgtttcagcctctgctgacactaggaaacaatccaaaccctcagcaaggcccaaaaagctgacttctctcactactattaatagatgcaacccatcctctcaggttcccagcatgcaccacacttttacgtgttcctcacctctgccgcctcctcacctttgcctacaacgcccctcctgcacttgagactgcagctcagcattccggacctcactaaagcgaccccgcccaccccagccccaagcagccaatcaccttttcccctgtgttccctcccacctgggtgcgtgcctccccttcaacactcctcacttgctctggaattaagtccaggtctgcctacccgtttgtgtttgggtctggctaggtagaggaattcacgttcatgtttgcacgtagtacagatgcgggcagatgccaagaaagaaggaaaaagataaacagaagtctcgcctgggccataacatctaatgtcacagaactacacaaaaggagaaagggcatttgcatgatgattaacttgttactaacttgttggacaatttagggggtgtaagaaggaccaggaagcagccacagttgagttccctaaggcatattaggagtctgaatggctcctaattatgaaaacaacaggactgttgttttctgttcacattccaggatgatcctcacctttttcagacactaagtcactggtattatgatgttgaagctcccaagagttagaatggctgaagggaagactcatgcccacaggcttcttagagatgcaaatggctcgggacgaaagaaaaccaggttcaagtgtatgcaccagggcacaggcttggtgagcacagccttgttccaggagggtccttattctccaataaggtagctgtgcatgctcaaacccaagcagtgtgtcttggttccaagccacagaaaggaatggggaatgagggctagctagctccaaggccatggttttcttcaactattttcatggagaaaatctcagttgttctctccaaagcagaaataaatctagacaactgaccctaaaccagctcagtggaatgtattttcccttgaaattagcttaaaagagtatgggacttaggcatgattcatcagtggatcaaatgcttctccaagccaaacctctccctctgctgattcccgctgacccctgagatcactcccccagctacacccctcaccacaccacttccatgggaaggaggatccatttggttggaaatgaaacattcagagaaagtgagtaacaagcttgctttcttctgctcaaggaatactgcaaattccccaagctacactcaggcagggtcttgaaagtccacagcccacaacttctccccacttatgcaccccttgccctaggggtgaccctaccctgtccggagcatattgaactatagccaaaactgtggtttcttttctcccaaagaccagttgccaaaaaccaactgccatgacctctctgggctccaaaattccaactgctctgggctccaagccagcaacctaccacattttttttctacagaagacttattaatctttactcaattcagcaccaataagattagccagtgtagagccagaggggctaccagctccattccacatctaccctggactaagatgccagcacctgatggccaaaaggcccaggccaccttctggtacctgctggggcccagtggcagtctcaggtcctgagctgggctttgcccaccccttggttttctaaagcacttgtctagtttgctacaggcacaggactactgttcattggcctgctggctctgggatacacattctttggcttgctccaaggactgaaacctaaaatctgggcaaaccccagtgttccctaagggatattagaaagtgttactgctgtgaccctcttgccaactgtggcttacacaagtctaactccagggaagccatctgtgttagtccattctcatgctgctaataaagacatatctgagactgggtaatttataaaggaaagaggtttaattgactcacagttcagcacggctggggaggactcaaggaacttatgatcatagtggaaggggaagcaaacacatccttcttcacatggcagcaacaaggagaagtgcagcacgaagagggagagaagccccttataaaagcatcagatctcaagagaactcactatcacaagaaaagcatggaggtaaccgcctccatgattcaattacctcccaccaggtccctcccacgacacgtggggaatatgggagctacaattcagtatgagatttgggtgggtacacagccaaaccatatcaccatccttatgggaaggccaccaaaggacaccgtcagtcctctcacaaatcctggagagctctgtgtctgcagtcaagctccacagactccaactcaccagggcacagccagcggatcaggcacatctcacccctcggaccagttcaggtacagattaaatataccgccttgagaaataccactcactggggcaaggaaaagccaatgtactctgttcaacttaaataaatatttgatatagatacaggttgggcatctcaaatctgtaaatccaaaactggaaatattccaaaatctcaatgtttttgagcatcaacaggacactcaaaggaaacactcaatggagcatttctgatggcagattttccaattagggatgctcaactggtaggtatagtgcaaatattctaaaacctgaaaaaaatatgaaatccaaaacacatctgatcccaagcatttcagaagagatattcaacctgtgctaaacaccatggacgtactttgttaaaggaccttaattaagcaaccctgtatttcagaagacctgcaaccagaagccccagagcatctcaagccacagtgtgagaacagcaggtatttcataaacattgctgcaggatgacatagtaacatgcccacaatagctccagtgctctgaccttccttcctcagggcaactcaacccactgttcacagtaagcttccatccctgctggcaacaggtatttctttataacaacacaacaatggcctaacacaccctgcaaactgggtgccaacagaacaatgaaattgaccaaatagcaacggggggaaagagtcctgggatccgaataagccacaaactggatattgggctctggatcctggagagctaccctctggccagaaaccaaaatgggcttggctcattcctggtaaatattccaaccacactaggtgccgagcacctgagagagcaaggggaagggagccaggtgagagccacaagctgtaccaagttcctgacatcaggacctctgaagggctcggccaggaaaccaaaggactcagagcagggcttctggctccccaaaaaccaccaccaggccagaaaaacatactgttctcaggactggagggcatgtttttctataccacttgattgcagtataacttacagacaataagagtcacccgttttcagtgtacaatcagtgatttttagtaaatctgccaacttgtgcaaccatcaccctggaggggatatttaatatctcccaaacctgaagacgattatggttcagtcagttttacgaggaatgtgaaaaaagaagttgatatctacttgttgctgccaattcagcaacacgaagggagctcagagcaggcagaaagctgaggaggtcacagctatcttgcctctgcctgaaaagcattcatctgggcttggctggaggacctggaaacttaaacaatttttttttaagtaactcttgttgagaatagtgcttctcaaactaaaatgaagaacccgttcatctgtccatgttttcccggcacccctccttccacagtgtcggaagggtactactgcacaaatctctcttcaccatgacagatcttagcaccacagccaaggcatcaaacacgtttcagttaaatcctcaaacaggcattgtcccttcctcctgacagctgggtgctttcaaaaatactgtacaaaatgacaggctgtgagtcccaaacccaaacattttctaaatcactgatcaaagaaataaaataaaatttatgaaaaaaaatgttttgacttggaaaacataaacgcacaggcattttaagtgatggtatccatgggactgtaaggtcttactgatgtctttcatcttgaccttgatgctggtcaaagctctcaatttttcttcatcagtagaacatgagcaaagatgcaatgaaaggacagtggaatcaacaaagcagaactggttagaagactaaaggtctacaacttcccgatatacaatccaacttccctgagtccatttcaccatcctcaaccttggcattccaggacgtctgtgccctcccaacaacagcctggcttggaaaaggaatatcccaggggagaagcgtgaatctgtagagtaaccgaaaagcaaacctggtggagaacaaaggattatatagctgaactctcctgccctggtttctctgtgcatgctcctccggctttttatgccactttctaagtaaagaggatgctcagggctctgtccttggccctctttctattttgttctagcaccatctttgtaactgtcccctggacatctccatcagaatatgccagggcatacatattctgctccaactcaggttactcaaaatagaaccccatcttccttcccaaacttatgtctctccctgaatctcaattctagtaaaactgccatctacctaagtcagaactccaggtgttggcctccacaccgctcctacttcccactgcaaaaggccggaggcgtgggcgtgcaggcaactgtaccatgctaagcatggtggggaggcagcacagtgcagggtatattcgcatttgctcttcctaaattcctcgcccatttattccttcctttctaacgtcactgcattggacttcattatctctacctggacccttgcaatagtctcttaaatgtagacccttcttcaaggtaattttggtttattttcttattgtgttaagatatatataacataaaagttgtttttaaccatttttaattgtacaattcagtggtattaaatccattcacaatgttgcacaaccatcgccactgtctatctccagaacttttttgtcatccgcaacagaaactctgtacccattaaacactggctccccatttccccttcctcagcccatggttgtcaccattctactctggctctatgaatctgtctattccaggtacctcatataagtagaatcatgtatttgtctctctgtgtctggcttatttcacttagtataagggcttcaaggttcatccacattgtaacatataccatgacctcattcatttttatggctgaataataattccattgtagtccacattgcatttagtttctccattcacccatcaatggacaactgggctgtttctaccttctgactactgtgcacaatgctgccataaacatggggacacaaatacaccctgctcaagtgtgcaattcccatactatgtttcttccaaagtgatctttctaaacaaatctacttaagccacccccttgcttacactttgaaagacaccatttctctaccaggctaaccttggggctgcaggtcctgcttcacctccaccctcatcaccttaacctcccaacacccctgtactcagcccccgacatctgcctgctgctccaggaacacccatgttctttccagcacagtttcttttcacagcctagaacacactttccccacccgtgcacacacttctctgaacctctgcttgtcctctgagctgcttcagtcttctctgaactaaggcagatgacaaatatgaacctcctcatccatcggggctttagggccacatctccaagcccttctcagaacaactttgcccttcccttcttcctacacccagatcttacctctgttctccaagcacctcccaccaggtgctgggctcctacaagacagcaagtggctctgcgtctggtttctattcccagcatttagcagcgccagaaccacaacacacactcagatctttggggagtgaattaaaggtttggcttctgactgtatactctgagcactcgagataaattgggttttatttacatgtgtcttgccatactttactatatgcagcatagcgtggtggacacattcacccactgcaggaacgctacctgatgcgaggaatagtactgttagaaacacctgtccgtgggccgggcgcggtggctcatgcctgtaatcccagcactttgggaggccgaggcgggcgcatcacgaggtcaggagatcgagaccatcctggctaacacggtgaaaccccgcctctactaaaaatacaaaaaattagcggggcgtggtggcgggcatctgtagtcccagctactcaggaggctgaggcaggagaatggcgtgaacccgggaggcggagcttgcagtgagccaagattgcaccactgcacaccagcctgggcgaaacagcaagactccgtctcaaaaaaaaagaaagaaagaaagaaagaaagaaacacctgtctgcatgcgtcttcatgtagtgtatgagatatatctagtgtggtgaacacattcactcactgagataagactactgtgattcacatgtgcaaggagcacttaagaaacataaagccaactttacgtaatgcagtacatgcaccacgctttggtggacacattcactccttgaaataacactgccctgatacgatgaacaaccagaacacttagatgtttcataccgtggctttatatattgtgttacatgccccataggggggtgaccataatcactgtaatgacacaaccctgatgtgacaaatgactggcacccttagaacttttttttcttaagacggagtctcactctgtcacccaggctggagtgcagtgtcgtgatctccgctcactgcaagctccacctcccgggttcacgcctttctcctgcctcagcctcccaagtagctgggactacaggcgcccgccaccacgcctggctaatttttgtatttttagtagagatggggtttcactgtgttagccaggatggtctcgaactcctgaccttgtgatctgcccgcctcggcctcccaaagtgctgggattacaagcatgagccacggtgcccggcccttttttttttttttccttttttaaagaaagagtctccctctgtctgccaggctggagtgtagtgatgccatcatagctcaccgtaacctcaaactcctgggtcaaacaattccccctacctcagcctcccaagtagatggaactacagatgtgcaccaccacgcctggctaattttttttttttttttttttagaggcaaagtctagttctgttgcacaggctaatctcaaactcctggcttcaagcaatcctcctgtcctggtctctccaagtgctaggattaagaggcatgagccaccatgcccagcctccaatattttgtttttaaaaccatgtgtaagttgggttatttaacttccaattcctgaaaaaagaccgataagtaacaacattttttccaaaggctcccctctgtaaacaggcctgaaacccatctgtgctctatttcatttttctttctttccttttcttttctttttttttttttttttttgacagggtcttgctctgttgcccaggttggagtgcagtggcgctatctcggctcactgctacctccgcctcccgggttcatgccattctcctgcctcagcctcttgagtagctgggactacagatgcccgccaccacgcctggctaattttttgtatttttagtagagacagggtttcacctgatgcccaggctggtctcgaactcctgacctcaggtgatccacccgccttggcctcccaaagtgctgggattacaggcgtgagccactgcgcccggcctctatgctccatttcagaaggaataaacctctttaaagcaaaagggctatgtgtaaccaagaaaactctcatatctggaatgtagaaaaattctgtataaaccaatacggaaaaaaacagacaccaaaggaaaaacgggcagaagatttgatcaggcatatcacaaaagaggacactcaaatcaccaaggcatgtgaacaggtgtttaacatattagtcacaggaagtccatcaaaaccataatgagatcctatcacccatcagaataactaaaattaaagactgacaatgccacgagtaggcaacgatagggaacaactggaactctcagacaatgcgcgtggtgaactcgtacaaccactatggaaaattgttcagcagtggttcttgaagctacatacacatctaccctaaaactcagcaattccattcttggggatacatccaacagagatgaatgtcttatgttagccaaaagacaagtaaaagaatgctcattgcagctttattcataatactcaaaaattggaaacattcaaatgaccaacagcagcaaaatgataagctgcagttacagtcacacaatggaataccacacagcaggaaagaggaatgaactactgcaacatccagccacaccgatgaaactcacagattagtgctgggcaagagagggcagacacaggacagaaaatactgcacgactccatgtacacaaagacaagaacaaagtttatgtctatggtgcagaagtcggctcagacagtggctacctgggcagggctgggacttgggaccctgatctggacagtggtgctgtgtcaacttggttaagctgggaactgtctcccagggcccccagttagagtctgagttagaattggccacgccaggaagttccgtaaagcttggaaggtgaactgaagcagtggccatgaggtgaagggcagagacacgggcacctggaggttccagcctgccccactctccacactgcggccagctcctcttcctcacgctggccctgctggccaatcacaggccccaggcctgccaccggtcactgggccggggacccaactggacagcagcttcccagaggcagcgcctcccaacgccccctcctccggtggctccacctccgcaacagaccgggttccgggcatccctgtgagctcgggcctgtccaaccacaccagtgcttcaggcgaccagtgagtgacccctctctgacatccccaccatctggacccccacaccccctggtcccccaacttgtggagagtctaattcttgcaataagtcccttatccctaactcccctgactaaaccctgctgggtacacacagatgttcacatatataaaaattcaagttgcacactcaagctttgtgcactttataaaatgtatgttataccaccatttggaaaaaaactaaaaacaaaagccccacaagggtatcgcataagtggtctgagaaaacagtgatctgagggacccagcagcctgtgaatggaatctgcaccaggcttcacatactaaggaagaaccacacaccactgcttggcatcagatctggcagacagctgggagcccaacggggtgtggcttctgaccaggaccagggttgtgtgctatataaatagccaacaggacacatgctccctccctggcaaactaccagcaagctaccaactccgtggaaccaggtccagagtgacttgtcccttctgaagggacagactgacagaattcaatgtgcaccctgaatgcaagctgagtctggcatccccaaatgggcagaaagggacatgtggaggaagggcagggatgagtcacagatccagcctgtggcatttagaacctgcaccagcagtgttctcagatacccttctcagatgtgcacgcagctttgcatgagaagataccaatgaggtgtgcacctgagcatccccacagcagctgtgtgtcaggcagagacccatgtgtcttgccacctttcacttcatttggcacattatttattgagtgcacagtatatgtcaagatccgtgcttgcaattaaacttacagtggtgaatggaaacacagtgcctgcccttggggagcttaccgtctagtggaaaatacagacaataaacaagtaagcaaggaagcacataattacaacctatgggtgctagaaaggatatgcacaggtgatggtgacttagaatagtaggagaggcccaacattcaaattcagaaaatacagagaacaccacaaagatactccttgagaagagcaaccccaagacacataattggcagattcaccaaggttgaaatgaaggaaaaagtgttaagggcagccagagagaaaggtcgagttacccacaaagggaaggccatcagactaacgcggatctctgggcagaaaccctacaagccagaagagagtaggggccaatattcaacattcttaaagaaaagaattttcaacccagaatttcatatctagccaaactaagcttcataagtgaaggagaaataaaatcctttacagacgagcaaatgctgagagattttgttaccaccaggcctgccttacaagagctcctgaaggaagcactaaacatggaaagaaatgatcagtaccaaccaatgcaaaaacatgccaaattgtaaagactatcaatgctatgaagaaactgcttcaattaatgggcaaaataaccagcgaacatcataatgacaggatcgaattcacacataacaatattaaccttaaatgtaaatgggctaaatgctccaattaaaagacacagactggcaaattgaatagagtcaagacccatcagtgtgctgtattcaggagactcatgtacaaagatgcacataggctgaagataaagggatggaggaagatctaccaagcaaatggaaaacaaaaaaaagcagaggttgcaatcctagtctctgataaaacagactttaaaccaacaaagatcaaaagagacaaagaaggccattacataatggtaaagggatcaattcaacaagaagagttaactatcctaaatatacatgcacccaatacaggagcacccagattcataaagcaagtccctagagacctacaaagagacttagaatcccacacaataataatgggagactttaacaccccactgtcaatattagacagatcaacgagacagaaggttaaccaggatatccaggacctgaactcggctctgcaccaagcagacctaatagacatctacagaactctccaccccaaatcaacagaatatacattcttgtcagcaccacatcgcacttattctaaaactgaccacataattggaagtaaagcactcctcagcaaatgtaaaagaacagaaatcacaacaaactgtctctcagacaacagtgcaatcaaattataactcaggattaagaaactcactcaaaaccacacaactacatggaaactgaacaacctgctcttgaatgactactggctacataacaaaatgaaagcagaaataaagatgttctttgaaaccaatgagaacaaagacacaaggtaccagaatctctgggacacatttaaagcagagtgtagagggaaatttatagcactaaatgcccacaagagaaagcaggaaagatctaaaatcgacaccctaacatcacaattaaaagaactagagaagcaagagcaaacacattcaaaagctagcagaaggcaagaaataactaagatcagggcagaactgaaagagattacagacacaaagaaacccttcaaaaaaatcaatgaatccaagaactggttttttgaaacgatcaacaaaattgatagagcactagcaagattaataaagaagaaaagagagaagaatcaaacagacacaataaaaaatgataaagggaatatcaccaccgatcccacggaaatacaaactatcatcagagaatactataaacacttctatgcataaactagaaaatctagaagaaatggataaattcctggacacatacactctctcaagactaaaccaggaagaagttgaatctctgaatagaccaataacagtctctgaaattcaggcagtaattaacagcctagcaaccaaaaaaagtccaggaccagatggattcacagccgaattctaccagaggtacaaagaggaactggtaccattccttctgaaactattccaatcaacagaaaaagagggaatcctccctaactcatcctgataccaaagcctggcagagacacaacaacaacaaaaaagaattttagaccaatatccctgatgaacatcaatgcgaaaatcctcaataaaatactggcaaaccaaatccagcagcacatcaaaaagtttatccaccatgatcaagtcagcttcattcctaggatgcaaggctggttcaacatatgcaaatcaataaacgtaatccatcacataaacagaaccaaagacaaaaaccacaggattatctcaataggtgcagaaaaatcctttgacaaaatgcaacagcccttcatgctaaaaactctcaataaactaggtattgatggaacttatctgaaaataataagagttatttatgacaaacccacagccaatatcatactgaatgggcaaaaactggaagcattccctttgaaaaccagcacaagacaaggatgccctctctcaccactcctattcaacacagtgttggaagttctggacagggcaatcaggcaagagaaagaaataaagggtattcaattaggaaaagaggaagtcaaattgtccccgtttgcagatgacatgattgtatatttagaaaaccccactgtttcagccccaaatctccttaagctgataagcaacttcagcaaagtctcaggatacaaaatcaatgtgcaaaaatcacaagcattcttatacaccaataatagacaaaccgagagccaaatcatgagtgaattcccattcacaattgctacaaagagattaaaatacctaggaatccaacttacaagggatgtgaaggacctcttcaaggagaactacaaaccactgctcaatgaaataaaagaggacacaaacaaatggaagaatattccatgctcatggataggaagaatcaatatcatgaaaattaatgccatccccatcaagctacgaatgactttcttcacagaattggaaaaaactactttaaagttcatatggaaccaaaaaagagcccgcattgccaagacaatcctaagcaaaaaaaacaaagctggagggatcacgctatctgacttcaaactatactacaaggctacagtaaccaaaacaacatgatactggtaccaaaacagagatatagaccaatggaacagaaaagaggcctcagaaataatgccacacatctacaaccatctgatctttgacaaacctgacaaaaacaagaaatggggaaaggattccctatttaataaatggtgctgggaaaactggctagccatatgcagaaagctgaaactagatcccttccttacaccttatacaaaaattaattcaagatggattacagacttaaatgttagacctaaaatcataaaaatcctagaagaaaacctaggcaatatcattcaggacacaggcatgggcaaggacttaatgagtaaaacaccaaaagcaatggcaacaaaagccaaaatagacaaatggaatctaattaaactaaagagcttctgcacaggaaaagaaactaccatcagagtgaacaggcaacctacagaatgggagaaaatttttgcaatctacccatctgacaaagggctaatatccagaatttacaaagaactcaaacaaatttacaagaaaaaaataacctcatcaaaaagtgggcaaagaatatgaacagacacttctcaaaagaaaacatctatgcagccaacagacacatgaaaaaatgctcatcgtcactggtcatcagagaaatgcaaatcaaaaccacaataagataccatctcatgccagttagaatggcaatcattaaaaagtcaggaaacaatagatgctggagaggatgtggagaaataggaacgcttttacactgttggtgggagtgtaaattgattcaaccattgtggaagacagtgtggcaattcctcaaggatctagagctagaattaccatttgacccagcaatcccattactgggtatatacccaaaagattataaatcatgctactataaagacacatgcacacgcatgtttattgcggcactattcacaatagcaaagacttggaaccaacccaaatgtccatcaattatagactggattaagaaaatgtggcacacatacaccacggaatactatgcagccataaaaaggatgaattcatgtcctttgcagggacatggatgaagctggaaaccatcattctcagcaaactatcacaagtacagaaaaccaaacactgcacgttctcactcataggtgggaactgaacaatgagaccacttggacacagggcggggaacaccacacaccagggcctgtcgtggggtaggggactaggggagggatagcattaggagaaacacctaatgtaaatgatgagttgatgggtgcagcaaaccaacatggcacgtgtatacctacgtatcaaacctgcatgttgtgcacatgtaccctagaacttaaagtataattaaaaaaaaaaaaaagaaactttctgagataacagaaagagtttatatcttgattatggagattatgtgaatatatattcatctgtcaatgcccacctaaaggcttaaaaatatctgtggattattttgcatgaaaattatacctcaattaaaaaattctctagaattgaaagtcattattgtaaaaagaaattaccattaaaccaataaattaacaaaaacaaacaaacaaaaaatagtaggagaggccctaagtcagagaagcttttctgagtaacttaaagcagaggtgtgcaggacaagagggaacagcacgtgcttggtcttgactcctttggtaggtctcctctctgatgccaccttcctctgcaagagcacagtgatgactacgcacgtgtccccaaccccactacgtatgtaggtagcacttcatgcttctccaagtacttccatgcagattatcccacttacaactcgtagttccatgagtctggaaggctgatgctgatgtctcttcttgacagatacagaaacagaagtcaagagagatgaaataacatcctgagtcgcacagcaagctaccaatggcacttgcttaaatggtaaattacctgctttatctcttttggcttctttccatcattactacttttaagtatgccaaagaaatactccctaactgttctaccacaggtccttctgaggacccatcaattctccaaggatgttattttaaattggacaaggccaaagtctagctttccccccgatctacttcagtcccatacttatttaacaaaaaagatgggccgggcgtggtggctcacacctgtaatcccggcactttgggaggccaaggtgggcagatcacctgaggtcaggagttcaagaccagcctgaccaacatggagaaacgccgtctctactaaaaatacaaaattagccaggcgtggtggcgcatccccgtaatcctagctactcaggaggctgaggcagacgaatcgctggaacccaggaggcagaggttgcggtgagccaagatcacgccattgtactccagcctgggaaagaagagtgaaactccgtctcaaaataataattaacaataataaaaaagatggattgctatcaaaaacagattgctaacttcaccatacctcaaactaacctctatcatgacacctggaaagtttaattattctctcataaccagtttacgtgattgtctccccagattcatgagttcctgggagtgaggaccatgtctcatcttttcagcattaaagcagtcaagatatgaatgaagccaacaaattacttgcaagagtgcacatattctcttcaccttctggcaaacagttatatttcaaggtcagatgtcaagctcagtacaagactttacaaacatccctttcttgcaaggaggaggcatgagaggtctgtcggccgtgtcttgctgattatagtatctatctttatttattaaatttttttaaagtgtcaagcatggtactgggcacttcacagaaatattttcacttcatcttcacaacaatccagtaagaactcatgattctcactgcacagatgagaaaactcaggataacagggtaattaagttggccagctaataagcagaggatgacaacattcaaactcaagagcgcctcactttaaagccgtaattattccacttccccacaaagaactcacaggtgtcaagaatgaaatacaaactaatacctccatagggggaccagagcaaccaaccgggagggaagtaggtttgaattcagatcactcaatagctggacatacggccaagctcagcagggttcagccatgaacacagctccacaggtaatacagatttggtaggggtgggctgccttttccctacgctgctgtgttaccaatgctcctccttacgaacggaggaggctgtattaggccgctgggattctgtgcattcctgagcttaaacttggcagaccactgtgctgcactttgataccaagcacaattctggacaacagatttgggtgttgaaatgaatgaggagtgccttggtctaagctgatgctttgatacccagagtcttaaaggactaaacggaagcgtggcagagggtgaggccactgctcacttgtgaaagtcagcccaccctcctccacaccagtgctcctggctcaagctgacatctcaaggtcattcagcacgtgcagcaaaaaccatctgggtaacacgtggtgaaggtgaagcacacatctacacaggcattacagctcatgatctgcgtgagtctcaggctcttgctcccacccctggctaccatgtacagtatacaaactcccagtaaaggggtgttgtggttggaatgtttgttccttttgaaattcatgtagaaatttcatctccaatgtggcagtatggagaggtggagccttcaggaagtcattgggattaatgactaatccattcatggattaatgagttagtggattaatgggttatcatgggagtgggactggtgtcttcagaagaggagaaagtgacttaagttggcacattcagctcccttgccatgtgatcagccctgcacggcctgcagagtccccaccagcaaaaaggccctcccctgacaccgcccctcaaccttggacttcccagcctccataactgttaagaacaaatttcacttctttataaatcactcagtttcaggcattctgttacaagcaacagaaaacagaccaagacaaagtgggtcagggaacagggcctgagattcagccggcacccaactcagcaagtcacacaccagctgaggaccagtgccacaaagaagaagggctgcacctcctgccctctcacaaaggtgctgcaggggcaagtagcagccacgtatccctgccatccccctaggaggccaaactccagaggcagggcgggaagcctgggagactgggctgaattctggatagtgaatttggccacatgaagggctctgactcaaccctctataccttatgaagaacagacctgcctctctctgcaattctgttaagatggcatcaatgatttccaaaggagctagacaaacacttttttccacatgtagaaatgaaaagccctccctagctggagagtgactgggaaaccaggctcctatcttcctatctttacattaaattagagcaactgccctcctctacagcaaatagtctcagtcacttctgcctacctaacgccaaaaagagctactctacgcaagacaccatggaaacttggataaccaatttaaaagacatcgggaccagcaacactactgcacactaatgacctgagcccttttccgcaggcacagaagtatgtacatactgtatttactgaagatactaataatcccctagagtcaaagcaccacagccggcagtcctgtaccactcctaggccagccagaacatgccttcagatcaccagagaaggcccctggacttcatccctctgaagttaaggacaaaagctgaggcaaggaaatgccaccatctgattattttcaatgtatcaatcaattgtcattttactatctgccctttcagggccagttggatacaacttccaaaataagacttcttatggtgaaaagtatttgtgagtcagcctataaagagaactgatcctgccaggtgcggtggcatgcacctgtagccccagctactcagggggctgaggtgggaggattgcttgagcccaggggatcaatgctgcagtgagctatgatcgcaccattgcactccagcctgggtgacatagtgtgactctgtctgaagaaggaaggaaggaggaggaggaagaaggaaaaagaaggaataagaaaactgattctgatgaaggctgttaaacccatacatcacaactttatcaaaccaaacccaaagatgaaagggaacagtgaaggactagttccatgaaatagtctagtggcagaatacagggaagaatatgacaactttgacagtaaaagaataaaaaataagctcattacaaggaaagaggcaaaggtagggtaaatccaagaatatatcataaaaacaaaagcaatggcagccagagagaggatcagaaagggaaaccaggcagaagaggcagtcaaaatcaggcagagaatactcaagcagttaaagaaccttttccagatctgtggactaatttctcaaaggaaaggctataagccctacctcacaggacaggccagcatcaaatagctcaagaggtatttaatcagggtaggatgatttacacaaaacaagccaaatgccatgtaaactcctgtgatatcagagccctgggtagaattataagcccatccactcctccccaacctacccactaaagaaagcaccagacacccagttatgcctaggccacgggatgaacccactaaagaaagcatgagatgctcagttatgcctaggccacgggatgaatgggccaagcagagtactgcttccactccgtctcaaacacagcaggtgcttcatccacaccagctggaccccaccgttcacctgctctcttcgtctcataacaagtcttcactcagaactgctccacatcatttttctcagcctgcatttgccctaagagactcaaaagacccctgcccaaagagattccatcattagagaagtgaactatgtcaacaccggcaccgatgtcagccaagttgaaaactagtcattatggggtggagatgatggctgtcaatcagtggataatgatgatggcaggtgtgatcttgagcacatccccattctcagcttctctggaagaaaagtgtctggggcttggagagaggccaatggattatgaggacttgcaggagaccctgccactgggttcttcccaggagacaaggggtcccctgcaaagacggaagtcaaaagacggaaagtagaaacaggttgagcttcaaatgctacaccagagcaacagctgtcattgttcataaaattcaggcagttctcaatttgagaagtaactgccacatgctttccatatgccactcttgggatacaggaactgagaagcgaagaagaaaaatgtatttttactatactgtgaggttagctgtttggttgaccttcacagggtatacataaagctcattagaatcactgacgaactttaaaactacaccaatgttcaggccccatccagacccatccaatcagaatctgtgatggcctggggcaggcgtggtcaatcgctccctcccacccccattctaaagtgcctccagggcccaggagggggaaagcagaaggaaggcctggggctgcagcacaggcagcggaacaggcagaggttcacccaccttcaagcgggccttctcccttacctgcacgtcaaccacctgtgtggcaaattcctccgacccctagccttaagacaacaacaaggagaggcgcccagccacagcactcaaggaaacgacttgcctaatctcggagcgtgtctgttttgttcaggaaaatgtgaaccagctgtaacattctgtctctccagaggtgcagccacaccgcaacatggctaaagatagcccggtgattgtatgcttgcagggaggcacagaattaagcacagccaagtgggcgaaggcagtccatgcaccaagtgaccgtggctgtccagccagctgtagagtttcctctcacccaacaaatcaaagcccagggtgctccagaaggtaaatggagcccagccccaccaagaacagctctgtgggttgggagggaggcttatccagtcctctgcctggtaccacctcctgtcagacatgcctcacctcctccacttagcggagtggtgtggctttaacagccaagctttctagaaacagctgtgaaggtctgtgcagatccatgggcatgaagtggcaatgatcatatgtaaaatctaaggagagtggctttcagacgctcagagacctcaccgagtctgaagacagtcgccagcagatccctgatgaaaagggagcttcctgtaggggactgctgtagggccactgcggaagccctctgagggagcctggcctcacactaggcttccagagtgtctgaacagctatagatgacaagcacctagagatgcccgtgacgctgctgggcagcaccaggtgagccaggcccgcagttcaaccagggcagtcccagagggctccagcttgatgggtgctgccctaagagacttgggccaggcctgctctgccgaattcccagctgcacgaccgtcctctctacagcacagcagacccagcaaggtccaaggtgaaagcagatctcattgagtagcttctgccctcaggcccttcagaacacaggcgatgctgaactcacacaacacagccactgctacagaactacagttcacctctatgatggacacatgctgacagcaggaagaattcccaagctctgcaaaggaaccgagtgacattcttctgattattttttatttccctgaaatcaactcctcttcctactctttcttgggccagaagaaatttctttgaaattgtatctatccttcttttttttctttaaaatggagtctcgctctgtcacccgggcttgagtgcaatggcgcgatttcagctcactgcaacctctgcctccagggttcaagcaattctcctgactccgcctcccgagtagctgggattacaggcaactgccatcatgcctgcctaatttgttatatttttagtagagacggggtttcaccatgttggccaggctggcctcgaactcctgacctcaggtgatccacccacctcagcctcccaaagtgctgggattacaggcatgagccaccgcaccctgagctgcatctatccttctcttaacagagaagattaaagcagacaggcaaaatatctccagtgaaaaaagtattgttgctctcgtgaaaaacaaaggctttttcctgatgtgagaagccctccttactcaaggtgcccaaggctgcgctttatgaatagatcaggcgatgtgcagccatggctctgctcccacctttcccatcttgtttgatagcgtaaactggaggaaacaaaagagcaataatagctttgctgtctgctgttttgggacctgtcccatagagaaaacaatcagtttgagctttatgccatgacatcatcagccaccaatcagcacagagaaggtggagcaggttttgtctgtgaaaccaaccactgcaattgttaaattggaaaaggcagtgcaggtgagagatggagtttttcttttacctttttctacatcaaactatagaagagagtgagaagcagaggacaaaaacctttctatggaaaaaaacaggcaccccagggatgcacctgcactcctgcccctctccacctcccacccctgccaacactgacagtggaagcctctgtcccatctgcccagtgctccccgccaaggacagagtcagggccttaggaaagctgtttttggtacctgagtgcatgtgtgtgtgtgttttcaaacagggttccactccagtggagagagagaaaaagactttggttgacatggacatcagttaaaacctctatccagaaactaactaaccagtgtttacttgtgcgtcatagctagaggttctcgggacttcattattttcagccactttcctcccagaaaacactggccatctcatgaatgaagctgtttagccaaggttagaatatgcaaggagagagggggtggcagtaggagagggcgcagggttccaggagagcagggggtgaaggagaatgctcacagagcaaatattgtttacaactgcagagccaagctaatgtgatctcccgcctgttcaagcatattattacattaagtcccgaacaatgaagtcggaggcagggagagcagagccgacccagcctccgctttgctaatggcacaagggcaacattccatgcaaagtttcggtgtgcaggcctcctgagaacccagcagtgccaggcagcagtgagcacacgcacccactgacgataggactgtggggacaggcaggtgtcaagagaagggcactacaccctttcacgtgccgctccaggggaaagcaggtgggagaaaccgcatttttaactgaaaatagggtacaactggacatgttaagagaagcacaggctgctgggtcctccaacagctatctgagggtggagcaggccacggcagcagatgggagaagaggctgaggcggagcagggttctccccacagttcctggggaccgctgtactattcacttccaggaacatcactgcacacctctgagatcatcaaacttactagaaataataaatatactatcaaatgccactaaatatgaagttcgcactcaggcactgggggacctttttttttttttttttcaacagtatgaccaggtgtaaaattaagatcaagccaataaatatagggtctaatacctcaggctggactcagtctatacctattagggctgagtgctgtcaactccaactctccctgacccccaggaaaaaagcctcaagtcctctctcacacaccatttcagcctttacctttctccataaggaagcccccaatccccatatttctttccccatttcagcctagccggtggtggtgtaaaacgactgccagccgagggcctgcgtctccttcaccctcgtccactaatgcacatgaaaatctaaattaatagggcaccttgggcgctggcccagagagaaagcagggtccttggccagctccctgcacacgcgctgccaacatccgctgtgggctctgagcacccctgcacaggccctgtgggagtaggagaggcacctcaaagaaaaacaacccgaaacaaaggcaccagccaggaagaccttcacccattcacattcccgggtgtccccaagtaaaacagcaggattcacatgaggacctgggttcttctccctgagatgtggagagcaaggggtaacacgcgccctactgcccagggaggggaggggctcagtaaaggcagcgggcccctctccacacagcccccatacgccccaattccaccaggcacctccctcccccacccagaatgccttccagtctagcctcccacatcaaagactacagccaaagcttctcttctgcccagagagcagagaaagaagggatgagggagagaagaggctgtatttagcaggaagactgagacaaaagggatgaggtgggtcacacaggccaagccccacaggagcatgttcactcggtggcggaagggccatagaaactgaagggcccagctgctctctcagcttacagggaggggcagacacaggcccagagggatccgaaagcaatcaccttatcaagttattcaaaatccagattgaaagtcaggaccggaaatcctcgctagtaacaacagggtattaagtggaggagagtgtggcaagcaggtacagatgacaaagcaggcagcatctcaagtccttggctgggtattcctgggagtcccctgtggctgtctcagggaacagagacaggatgctcttgacagttttaaccggagcagctctacctgaccaggaggccagagaagactgcactttccctggcttcgggggtgggcaggcacccctacttccgaaaagaacaaaaagagaacaaaagctgcctcataccttgtggaccatatcagagcagccagcacagcttgcattctcacactctgcctgcaaccaggacaccgcctgtgtgaaacaacgacccacatgtgtattcactgcacacacacggccccggagagttctttcatttagtgtagggaactaacttataaatgggacacatctttgtatgtgcaaaagatccctcaggcgagcctctgtgagaacacccacctgcagccccggaatgtctcagcacatgcgacactgagtcatcttagcgccacacacatgcagacagaggcactgcacacacatgtggacacatccccaaagtaccaggggacacaaatccaaaaccaccaggtgattggggaaagttcctcttatgtggaagatagaggaaaagccaatggctaatgtgatgtttaagtgagggctgatctattttccccttctctgctccaaagccattctactccaagtgtgcacatcacaggaggacctgagggagtggtgggcaagttcctacaagctgcctatttttaacctctggtctttcctgccctcttccctggggaacacccctccctctgctctccagcaaagggcccagctgaaccacatgataccccttccaagccggaagatgggtggggagggccctgctatcgcctctccatacttcagatttcaaagagtatggactgaggaatttggacaaaaagtgggagggaagaaattgtttaaatcacaaagaaaggaggagtgagacttcagaagagaaacgcagcacatcaaatatctgctgtccatctaagatcagagccgggctgcaaggccacatggctggattggccccctctccccacttcgttctcccaggccagcctacagccgctgcacgcgttcatcttgcagcctgggccctgccagcaagactgtgcccgccaagacagcctctacacacccagaggacagtgggccccccagcatggccaaactgccaatgagacaatgttttcccttcatgaagaggtaactgggacaaggaaatcccttaaggaaagaggaaaagacctcggtgtctgccttgctccaaactccaatttgcagtccagctttctctcaccttcaccgtgttctgtgcgcaccactgagatagaattaccaacatgaactgaacagtgaattctgctcattctggttttgcatcaacctatcattgtaaaatcaaagtatgaaagaaaagatgcctcaatcccctcaagatcaaatttttatcttatttttatttgctctgttgtccaggctggagtgcagtggtgccatcatagctcactgttaacctccaacttctgagctcaagtgatcctcccacgtcagcctcccgagtagctgggaccacaggcgatggtgtgcaccaccacacccggctgatattttcttaaattttttgtagagatggcatcttgctatgtcacccaggtgaaacttcctgggctcaagtgattctcccacttcagcctcccaatgtgctgggattaaaggtaatgagctactgtatctggcctaacttaacaatgctcatcttcaaaccgcttcaaatacagttatgaattcatccacacataccgtgtctcctaccagacagacattatgtgtttaatagcaaaagtttaaaaaaaaaaaacccacaaaactgccagtacagatccaggataccaactctaaggtactgggttctcaagcctctgctcctgtaaagcaaggcacgagagcttgaaagctccagagctgatctaccagatgcctgtgtcatccacctccctcccatccctgccactggaaaagaaatcacactgcagtctggcaagtccccactcccactgcctgccctgctccggcgtggccttactccctccacagcaatctgcaagtgcccccgcaggaggatgcgcaagagctggggaggatgtttccacagtgccgccacaatcttgctggctctccagctggaatcccaagagctcccagaacggtcactttggtggactccacctcttggtagcttgttttgtgcagcatggataccggggggccatgatggtgtcccgaggcggggtgtgccaaggtggcagtgctctccctgcccagctcctgctcctcccctccccagtcctcacataccagctgcagagcatttgacaccaggcatccacaagacacagaccctgctcctcagaatcttgggctcatcgtggaaatcaaggaacaatacaggggaagacagaatatgagtctcagaaagttgtctattttgtcccttttaaaaacaagatttctcatacctgcagtcctagtactttgggaggctgaggctggtggatctcagagcccaggagttccagataccagcctgggcaacatggtgagtgagaccccgtcttcacaaaaaaatacaaaaatgagctgtgcccacatggtggcatgtgcctgtagtcccagctacttgggaggctgaggtgggaggatagcttgagcccaggaggtggcagttgtagtgagccaagatcgtgccactgcactccagcctgggtgacaaagtgagatgctgcctcaaaaaaaaaaaaaattggccagcacggtgggtcgtgcctgtaatcccagccctttgggaggccaaggcggatggatcacttgaggtctgaagttcgagaccaacctgcccaacatggtgaaaccccatctctgctaaaaatacaaaaattagccatacatggtggcatgtgcctgtagtctcagctactcaggaggctgaggtgggaggatggcttgagcccaggaggtggcggttgtagtgagccaagatcgtgccactgcactcaagcctgggtgacagagtgagaaattatctcgaaaataaataaataaatataacaagatttctcaaagattaacaagaatccaactaacgtaactgaacacttagctctggctaagtacatacacccagctaccactcatggccaaacactgtgacatgattcacctgcattatctcattttatcttccgagcaacattatgagtataatgttacctcactgtagaaatcaggcaactaaattaaggttcaggaagttcacacacagtgagcgacaaagcagggagaactgctttgctaagggtgggctgcttccaacacctgtgcccctccccaaacggtgccttacctggtggattcaaatgtattaactatgccctctcttactttttcttgccctctgtcataaacttttataagcgtgcatgccacatctctcctgcaattccctatatgatccgacaagttttcaaataaatggggactgtcagtcaatctcaaataccgtagtgcctgctcaatgccaaggatgcgtcaggtgctacaaaggggtccaaacaaaagacggatctgtaaagcagaggacgaaacagccaggtagtgacccctaataaaacatgataaggacaacacacgatgcaggggcagatactccctgtgtgcacacaaagcaactggggagcctggcacaatgcgaatctgggtccagcaggcctgggtagggccagagatgctgtgcttctaacaagctcctgggccaagcccatgctgctgaccaacaggagctaaagtgcttccagagactccctggggtggtctagaaagggagagatgtgatcagaaacagcctgtagaggactaagtagaatctggagaagtgtgggcagtgtgtcatcaggaagagaggaaacagtgtttcagaaggagggaaaaactcaggcaaggaagaagcacaaatgcacaggtcattcacagggtacagctgtctatttttttttttggagacaagagtctcgctctgttacccaggctggaatgcagtggcgctatcttggctcactgcaacctccacctcctaggttcaggcgattcttgtaccttggcctctcaagcagctgggattacaggcgcctgccaccacatctggcgttttgtttttgtttttttttttttttttttttttgagacgaagtttcactcttgttgcccaggctggagcgcaattgatcctggttcactgcaacctccgcctcctgggttcaagcaattctccagcctcagcctcccaagtagctgggactacaggtgcccaccaccacacccagctaattttatttttcgtagagacagggtttcactatgtttgccaggctggtcttgaactcctgacctcaagtgatcctcccgcctcgacctcccaaagtgctgggattacaggcgtgagccactgcgcccggccagctgtccattttaaaacacataacagcactcctaaactgcaccactcggttgccaggacttacaggacaactccctttgaagagagtcttactgactggcttgagaatgagttcgggggagggaacgactgctgttgctgatctgaagaagagtcacactcacgacagatgtcttgcggagggcagacccaccaacgccactacttggaaagactcagaggctaaagccatgaactctggcacaccacagcctctcgccaaagaatgcttcatgagacatttttaaatacccaccatcccataaagaacaggaaaggaaatcccactgtcagccccaccctgatcccactgtcagccccaccctgggccagtctcctaccacgggtcttccgggagaagggccaaagcactgctctctccaactgggcatctggtgatgtggcctggcttcctggctgggccacttcctccactgtctcaaagtggcactgcccttactcaacaagttcctccacagccagaaatgaatgcccagactgtaaggaaaggtcacccgcaaccctgcagtgtgcccactgtgaataggcagggtggtacagccgggagcactggattaggatcaggagacagggatctggacccggggtccgtcattcagtgagccacacaacctctccacgtccatcttcatgcttacaaaatgcaaactatgacccaagctccatctaccttactattgtcggtgaaattcagcaatggaaagtacttcacacactggcaagtatcataaagggtctgagagataagagcccctgtgtgacgcatgacacactctgctgctgttcggatctagtattcattatccctgcttcgccaaaggaaaaactcagggcacagagaacaaacatgaccttgttcaggtcaaacaccaaatccatgactgctgaggaataaaatgactgctcagggttgccatgaaatcaaacagtcttccattatggaataactagagaattatctattaactacttgcctctagaaaaccagtgtttaaaatttctttctttttttttttttgagacagggtctcgctcaggcatccaagcttgagtgcagtggcgcgatcttggctcactgtaacttctgcctcccaggctcaagggattctcctgccttggccccctgagtagctgggattacaggcgcccgccaccacacccggttaatttttgtattttcagtagagacagggtttccccatgttggccaggctggtctcgaactcctggcctcaagtgatccgcccgcctcggcctcccaaagtgctgggattacaggcgtgagcgactgtgccgggcgtaaaatttcttaaaagtgccccacaagagccaaatcacttagaactcaagggctgctatgtgatgcatgaacacccagggtggaatgaactgcaaggatgggaacgggactgcagcactggctccatgcttactggaccacccatcctgggaaaggatttggtttccttttctgtacaaagacaggactggactaagtgattcaaccctttgttagcagcctatccctaacacctagaacaagtaagcactgttctaagtaggggcaggtgcccccaacctccccatcaccccactctcctcgccagacccctccaacacaaccttgtgttttcatttccttgagaaacctccaaggaaatccgcagcatccagcccacgggcctgtgtgtggcatctcagtagcctggctccaccccaccctgctctcccagcctcaccctcgctacaggcctggagttgaggaggccgaactaagtcaacctgggtccaccatgtggggagaagtggaaacagaaagagagaagaggctcaggaagcagccaatcacacactataaaacacaaagcagccaaccaaaagctataaaacaaacaccaagcagccaatcacgcgctataaaataccaagcagctaatcataagccatctgagctcccaaggcctgctgccaaggcagggggtggagaggtccacacaggcggggcgtcagagaggccactgagtgcaacccaggtgccagttctgcaggatctgcctgatgaggaaaaggctggtctatgcatgaggtactggaaagaacactgggacttggagcctcggttcgatcccagctctgtccatgtggctctgggggagttcttaacctctctgtttccttttcgggcaaaagaagacaacacccacctcagagcacggttgtaacatatgtaaaatgccttttaccgcgcctgactcggagcagctatccaacaaaggctggagacgaccacaacagcaactctgcctcccatccctgacatcgggaaagtgacggcaacttcaaccaaaatcctctgcccagcagggctcaggagcataaggtgtgcacagccactccagccctgcacacgcagtttgcagcgggaagcactcccatatctttcctcgatcagagtgaggcatctctctctaggtccctgaatctgatctgaaagcagacagtaacattcagccaagctttctttacctgtagggcctgaaccagactccataggaaaaataataaattaccccactaaaataaattgaacacaagaacctctctgaaaccagtcctaaggtcagctcccagctaatggatgatcgcacgccctttactccttcccacctctgaaacaacttccgggcagtgggggtgggcaatgcaatttgatgtgagccaggagaacccttccctgggaagatgggacacgatctgtacagaaaggtcatgttaaggcctgggggaatgtccaagccccctagaaggtactctaccttggctgtcctgctgtctggacatgatctctctgggacatgggggctataggggacatcagggcgggggacatcaataccccaaggtccaacagacaagaaactccttgctctagtgtttgagaaaaggaagactggccgggtgtggtggctcacgcctgtaatcccagcattttgggaggcctaggtgggcagatcacctgaggtcaggagtttgagaccagcctgaccaacaaggtgaaaccccgtctttactaaaaatacaaaaattagctgaacgcagtggtgcgtacctgtaatcctagctatttgagaggctgaggcaggagaactgcctggacctaggagggggaggttgcagtgagccgagatcacaccactgcattccagcccaggtgacagagtaagactccatctcaaaaaaaaaaaaaaaaaaaaaaaaaaaaaaaaaaaaagaaaagaaaaagaaaaagaaaaggaagagtttatttcaagaaaagaaacggcattctggggaagcagtgtgacatttatatgaaatatatgaggtgagagagatgtaatacgggaaactatgaaagaaggtgggaaactccccctgctagaatagaggttccacgagtatagaaacttttattgtctggcttactgttatcatccttagcgcctagaacctgttaaagaaaaaattatttggtgctacttacgagaatacagtaaggaagcaccactatgataggtgcagggaccatcgcattggggacctgtagtgggggacagagatcaggttcaactcctaacactgcatggacaagtgggaattcagagccaaggagcaggtggggtcagtgcatgaaaaatcaccaagaggaacatcagggggaaggagattctggctcagccaacctaacaggattcttgctgaagacgggccagggtgatcagacatcacctggggcatggggagggtagggaatggatcagatatagaaaatgagggtttctggctaaaccaactcagcaatgttctttgctaaaactggattttccaaggaagtacatagatgggcctagcaaaagattcaaaaggctggctaatgtttagccaggcaaacgttaaaccatgcctggaacaccatggacactccaacacttgatgaacaaacagagcagcagaatctcagtgtggttaagggcagaggcaagtgagtcaaacaaactggattcaagtcttttccttttttttttttttgagacggaatctcgctctgtcgcccaggctggagtgtagtggtgcgatctcagctcacagcaacctcgccctcccgggttcaagcaatttctgggattacaggcggacaccaccacgcccagctaatttttgtatttttagtagagacgctgtttcaccatgttggctaggctggtctcaaactcctgacctcaagtgatcctcccacctcggcctcgcaaaatgctgggattacaggcgtgagccactgcacccagcttcaagtctttttttaactacttactagctgtgtgactttaatcaagttattcagcctctctgatacttaatacccatatagcaggattcttgttaaggattaaatgacaatgcatttagccactgagaatgtccagcacacagcaagctctcagtaaatggtggctattcactgtgatcacctcctttctcctgcttcactccttcaaaatctccctggtttagggtagaagaggaaagcaggcaccataaagaatgcaaggatctgtccaggagagacactgcagcctgttccatcctaaccctccacaacaggtgtgtgtctgccctgccccaacacccgctcttacccatctgttccagtaaaatccatgctcctccatcccactctccacagggaaccttcctcatgtcctccccctcaggaggggatgtagctatcagtaggctgaggaatgggccgtacttagccaaggccttggaggaagctgtgtgtggcaggggaagcagactgcatccagagagagccctggctgagaaccactgaaaagccaagagatgcctacactcactcacacacttattcccaccttccaacatcccataatatcctcatttaattcttacaaattaacactttctcaagccgatccttggagcagcattttctaagatgaaccccacatttcttctaccagctgcatttgctatgcacctcaatatgtcagtgacaatttcctggacaacttccagcctagagtgggaggtggaaatagatctcatgcctgagaagccccagccagcatcacagaactgctgaggattggaccgggaaaagatctgagagatctccgactccccactcagctgcatgtttgctccagctttcctaaggacttgaatccacagagattttaggaatttcagatttttagtcataaaccaaaatcttcgaccattaaacggtgtttatgaatgtttatgagcacaagggaagaaaatgtccaggaagaggggctcctgagagagtgtcctctgaaattcctggtcttataggagaggcagctgcagaagggagctgcagagggcacacacatgcctgtgtcagcgtctcatgccgacatccacactggctgaatccaacatgttcaagggtgctgcatgctcatccagagcccactcctccggggccccacagtgctaagccatggggctagaagggccacatgtcaagatcacaacttccaaacagacagttgcagaaaggggatggggagaagagcccagaaacacagaggcagcaacctcccaggtatgccaagctttgcactgacactgctatggtacctacagaaatccatgcactaccggccgggcatggtggctcacggctataatccccgcactttgggaggccgaggcgggcctcctgaggtcaggagttcgagatcagcctgacaaacatggagaaaccccgtctctactaaaaatacaaaattagccaggtgtggtggtgcatgcctgtagtcccagctacttgggaggctgaggcaggagaattgcttgaacctgggaggcagaggttgccgtgagccaagatcacgccattgcactccagcctgggcacagccgactcctgcactgcgactacgacttagctccgagaaaagaagagcaaaggagagctgcgaggacagccagcctgtgtctggagggaggactgcttacgtgcatacagggcaggaagaagtggactcacatgaagcagaaggtgctcacgtgagagacactacagagacgaagtcagacaccaactggagaaagatttccttcttagtaacagtaccccaatcttactagagccagtgatgcactcacttacaaaaccgcatttctcaaacttccttgaagctagctgtgaccatgttttccaggttctggttaatgagatataagcagaagtgtgtgggtcttcctgaaagactcctttaaaggagtctctcacatagaaaaacattttgcctttctttacatttcctccctttggtgttctacccagaaagaaaagaaagatggctggagctccggcagccatgctttgttatgaggtaaccttaaggatgagaaagctacgtgccagggtagtggagttaggtcaaattgaactctcacctgtcaatccatagagtgggccacacaatcaccaggctttagctggcaagtccaggtagaaggaacgagacaaaatcctgatggccatgcagctggctacactggctctgggcttcccatctctagggtccttttacataaaaagaaaatcttctttcatgctaagccacattttgcaatttccgactgaaactaatctcatctgatacaaaaatgtgaatagaaagccttctttactgagagcctgggctcgatggctcacgcctataatcccagcactttgggagggaggatcacttgaggccaggaattctagaccagtctgggcaacatggcaaaatcccatctctactaaaaatacaaaacattagctgggcatggtcgcgtgcgcctgtaatcccagctactcaggaggctgaggcaggagaatcgcttgaaccaggaagcagaggttgcagtgagctgagatcaagccactgcactccaacctgggcgacaagagtgaaactatgtcaaaaaaaaaaaaaaaaaaagagagagaaagaaaacgagagagagagagagagagaatgaaagaacgaaagaaagaaactttctttctttactaagagaagctctgaagaagatgaaatggtacagtcacagggagcctggagagatcccaccacggcagcctgtcaaatggtgcctgcatatggaagacagctgtggtggctggagtttcttaagcggcaagccctgctactgagaaaagagcagagctttcctcgtggagttagaccaaggaagattcatcccaaaaaacctaaaaattccacattacccataactgaaatcttaggaaaaactgacccaatgagttggcataacacgatctctttagtggaccccagatgatataaacctgtagatttttctcaacaattaaaataacgtggaccccattacaattaacctatgacactttttggatagcttatcttctactacctcctgcagaaaaatcctccctatacagaactcaacaaatctccaattcctctgtccattacctcattggccaatactcacccttgctagggccactttgggtcctcaggccacgttgttatttgtgttctgttccctaaaaaccgtcagagagactgagttgaacgcactccacacactgatgatgatggcagatggccagaggcagttacggaagaaagaaaagacagtggggtcacagctcagctctgccttcctgctaaggtgtctcctgcatcggccttgggcctcagctgcaccccatcctcaccctcatcccccgttaaagctagaaaactggctcccctaccccaaaaaccagagggagccctcgacagggcaagctgaatcatccgcccatggagtggaccatagcaccaacacacagtagccagcagggccagaactgaccacaagaagtgggctgaagcagggcagcctggtctcagggcctgttgtttttgagttgttgggtttttttattttttttttcttttgagacagagtttcgctcttgttgcccaggccagagtgcaatggcgtgatctcagctcactgcaacctccacctcccgggttcaggtgattcacctgcctcagcctcctgagtagctgagattagaggcgtccgccaccacacccagctaatttttttgtatttttagtaaagacagggtttcatcatgttggccaagctggtcttgaagtcctgacctcaggtgatctgctcgcctcggcctcgcaaagtgctgggattacaggcataagccactgcgccgggcctggggtttttttttttttttttttttttgagatggagtctcgctctgttgcccaggctgaagtgcagtggcgcaatctcggctcactacaagctccgcctcccgggttcacgccattctcctgcctcagcctcccgagtagctgagactgcaggcgcccaccaccacgcccggctaattttttgcatttttagtagagatggggtttcactgtgttagccaggatggtctcgatctcctgaccttgtgatccacccacctcaggctcccaaagtgctgggattacaggtgtgagccaccgtgcccagccatcggcctgggtttttttgaaacagagtctcgctctgtcacccaggctggagtgcagtggcgcaatcttggttcactgcaacctctgacccacaggttcaagcgattctcctgcctcagcctcccgagtagctgggattacaggcacctgccaccaggcccggctaatttttgtatttttagtagagacacggtttcaccatgttggccaggctggtctcaaactcctgacctcaggtgatctgcctgccttagcctcccaaagtgctgggattacaggcatgagccaccacacctcagggcctgttttatatggagtatgttctaaacgcagccagcaccagtggaggtttacaaagatgactgcctacgtgtggaaaatggtggggttgagtgggtcaggactgtttttgttagtaaagaattaagtaggttagggaaatagatagctctccctgcccataagaacagaatccttctgggacagaaaaataaaggcaaataaaggggggaaaaacatggaaagggtacagaaaaaaaaaattaactggatggaagacagaccttataaggcaaggctgaaggaactgaactcatttgacatggacgaaaagctcatgataccttccctaccttcaagactcaatggcatcccaatgcctaggagtgcactctgtaagcaaagagcacttaacgtctgtggataaactgatgagcaaaaggaggcttctctctcagcctcatggggacacaggaagagaaggtgtgcacagaaagcagcaccacagttcccggaaggcatcttccctccaggctgagcgcggctgtggctccctgccccagcatggctagctcactcccattcctacagtagcttccgcatctcttcatgggtgctgttctcactacactgttgctacgggctccgtgctaggcagtgagctcactgggggtcagcgattcatgtcctcttcccctgtgtgtatgtaggcctctgtgtacatgcgtgtgcatgtgtcctgaagcctggtcctaggacataatggatgcagaataaatgaagtcagcaaatatttactgttcactctatgtgccaggcactgaaggcagaagagtgaacaaaacaaaaattcctgtcctcatggagcttcgttctagtgaggggacaggtaccacacatgcgaacccagcatatgggaaggaaacatgcaccctggaacaccccgcccaggagtgtgtgtgggaaggagactccaggagctctgcgaactgttctggaactggacctgttcaggattggcaaggggctccgggaacagatcctgtgggtgtgagactgtgtccccgtccgcttagggaaggaccatgggggtgagagggtggggggaaggaggcagatttggaaacagacacccgccccggggtcagatttgacccaggggggcccgcaaagtggggaaggaggagaggaagcactaagctgtgccagggagattctgaggcgagcaggagcagagcaaggaccgaaggagccagcacggggtcactgggagtcctccaggcatggaaagagcacgagctcagcaggaggtgctgggtcatgaggtgagcagggcaacgagacggtgcgggacctggtaggccacctggcagctttggcattgactggggtgcgaggggaaccactgcaggagtctgagcagggaagaatgacatcgctaccgtgtgttaccaggggctcctggttgccagctgccagcacacctagggacaccagggtgggcatagggaagccaatctggaagtgcctgcaaaaatccagaggatggctggcggtggcctggcctaggagtcagtgtaggttgtaatgagaagccaaacatgaaggcagggctcacaggacctgctaatggctaaaacatgaggtgtgagaaccagaaagaaatgcaaagatttctggtctgagaactgaagagataatgaaaaagaagctaacaaaagcacaaacataaatctccttcccgctgggtcctactagaggcagcagaaaggattgaataacccgcggccattctcactgggggagcgtcagccccgggcaacagacacctagtggaggccccttccccctcagatctgaccaggagggcatcagtctccaaatctgcctccttccccccaccctctcacccccatggtccttccctaagcgaaggggcacatagtctcacacccatgggatctgctcccagagccccttgccaagcctgaacaggtccagaacagctttgcagagctcctggagtccccttcccacacacactcctgggtgccacttcaggaagcaatcatatctccaacatggcaggaggtggcccagacttggggtgtgggtgggagaacaaggcctgcacccctaaccgactctggggctgggcctgcccttagccattctagagttagcgccccttccaaggcaggcccaccccaccccaaccctgctgctgccaccagtgccacggcctgcctgcctccagttgctcctcttcaccaccacctcaccttccaatgggcaagtggcggggctgtgcagtatcacaagatcagcctttgaaaatatctgtttggggtttcctttcctaggcaaatccatacaacctattccctaaacattcaaactaagacagactataggacttacagaaaaatgggttcaaaatgaggcaaagataggaaagtgcttcttacagataattttcaaggccagtgactggagagaggggtaggtctgtcaatcgagtgcttgctgactgcacatatcacatggcgtgtgacgactgctgggagaggaaagcgagacatcattccaaccctccagaagctaaagatcctggaactcaaggggaaaactaacgtaagtgcgaaagcgaacaagcaaacatgtcctcaactgggcaggcaggctgtcggggtacagagctgggatctgggaaggaacagagagggccgctcagggagaggaagcacagtgccaccggaggcacgcactcagcaggcactcgcaggctgggcagaggtagagaagcagcgctgcacaggcaggcagctgacccagggctcttagagccgggcaggagagctggtgtgggacctgggaggaggacaggagccttcaaagcagcaccgcctgattgcagccaggagggtagcatcaaggaagatggaactgcggccaggccacatccaggggtgctcgagcacaagaaaaaaggggatgggttagaactgcagcagtgggaaccagaatttaaaaagggaaaattattcgacaaatttggagcactaactatggcaggtgtagttttaggtgctaggaataagcaatttccaaggaccctttgaacagaaatgaagcaaatgagctacacagggcggcataaaaaccagctgctggtgttactcccttcttatctgtatcctgtgaaagggcaggaaggtgacaaacacttgtttttctgtaggtgcccaggttggttttgaactcctggcctcaagggatcctcctgccttagcctcaggagcacaccaccatgcccagctaaatttttttttaaaaaattttagagacagggtctcactatgttgcccaggcagtcacgaactcctaccttcaagcaatcttcctgcctcagcctcccaaagtgctgagattagaggtgtgagccaccacacctagccagcgagaaacacttctattccaatcaataatttaacttcagctacaaccttcctagacacagatttacttacttatttttgaaacgggtctcactctgtcgcccagactgtagtgcagtggggtgatctcagctcgctgcacccgccgcctcccaggctcaagtggtcctcccacctcagcctcccaagtagctgggactacaggcatgtgtcatcacgcctggctaatttctgtatttttgtagagacagggtttcaacatgttgcccaagctggacacaggatgtttaaaggaagactgttagggacacccatggcgtgagatgaaatgacagccatctccattctttaatgacaatgattttgctccccttgccttcacataaatgcgggctaaggacctgacagtccctatctcccaagcactgacgcaggagagctgtgaacacgtgatgggcctccgtcgccggttccttaccctgccacggccaagcgccatcctgcctccatgcaaccccaaggagaggagggcagtgagcatctctgacaccccttggcactgaggtgagactcttcctgtgagcccgcaccccatcaacgtgctccataagccataggagtcaccacaaacttcgcaagtggataatagtcaggcctcactgaagacacagctacccatgctgatccagccaggagggtcgcttctgtgtctcctcctactccacacccacatgaatcccacaggccgatcattgccttgcaaggtaagatgccctggtgcagacaaggagccgctttacccatcaggctaccagctgagggtcaaataggcacaaggtcgtggggacatattttaaggacgtggtccctactcttgctgcatttataatacacagtacaatctgagaccctcgcaaattttgtaacacaatggcaataacaaccattattggttaccaactaattggtaccattaaggtaataacagagagacttccttctgggccttccccaaaggcagacaaaggttggtttgcttcctaatctcagtctccaggacattacaaacaaaggattcaaaatggtgttactactggagctggaattccgtgttctaacaagaatgaagaaaagagccaatcaagacccaaaaaatctgcctctcctcagctcaagaggaagaaggccagcctgctgttgccctctgtccctgcattccacagcaccaggctcttccctcacatccctctcctcacattcttaccttatatgattgaggccaaatatgcaaagccccgtctcccagccatgtacacagtagctgctggctgaggacactgctgccaacgccacaggccccagcgaacagccctgactcttatgtgatgatctgcttttgggtcctgtcactatctgcgcacacagcacacgtccacatgtatcactgaccaaccctaacagggcaagggtggggatgtcagagattagctccacaggacttggaccctacgtgaagattaaaaatttaaaatcaaactcgggcatttctgccatctgtaacccacctccacactagaaccctctgacagaaagtttctgtgagtagggaaatctggtccacaaataagctgtccctttaaagatctgcagcaacttaaaaccagctggtttctggtacaagccagtcctcagaaagtaactctcacttcaactacagaggataaggtccaatgattttgagttttgttttaaaaaacaaagcaaaacaaaaaccccgaattgctcagctgggacactggctggttcaggagggctgggggttttcagaagcagcagccgcatggcactgctgaccgtaagcgcactgctaaactgaagcgcggtggaggtctgggaaaaggggaaagcaaacactccaaaacagaaacgccatcgctgaaagggcacagagcaggtgcgggcctgcccccaggtgtctcccactccctgcggtaggaagtcctctgacagagggaggaaactgggccaaaggaaatccatgcatccgctgctctcctttccctccttccccttctatttaaaaagaagagagtttgagaccagcctgggcaacacagtgagaccccgtctccaaaaaaaaaaaaaaaaaaaaggaagggaactatttctgtgcctgagaatggctgtgcttgcgagagtccttctgtatcagaaagcaatgactttttacaggattgcaataatacccggaacccctaaaagaccctggaactggcacaagggtgcctataatttcaatgcttaagagaggtcctgaaggcatgtcactaacacaatgattagagaccatttcttaccacacatcagagagtcttcatgctttggtctcctaccttagagaaagcactgactccattcatcccaaggactgaaataatggtgctgatgaagatgaggcccccaggaataactgcagctatagtgtattcatcacttactactgatatactgattgtcactgtgagttaagtatttaatacagcgatcagcctcatgtgatagacaagaaaaaggagacagagaggctacgtaacttgccccaagtcacacagtaagagctgacacctgatcccaggaagcctggaaccgtgaacactaagtagcctctctactgatatctgctatcatcttaatccagaaaccaccctgtaagtagttataattatctgcaagttacagataagggggaaaatagaattaagaaaggtcagatcacttgtccaactagtaagctataaagccaggagtcaaaaatccaggtctccaacctccacattctatgccttttcactacactgcactcgagggtggtctgaccaaccaccacgggaccaaccaccgtgggacttccatgtagacagctgttcccaggaccagaagaaataatactgggccacagggcacacaggcaatgaagagtcaacacacatgaactagagaggagtcggaggtaactccatgccatgcaggatctgccatctgctgccagcttcatcattctcagacagaaccctcatcctgccacatcctgcttgacaaccacacacgtttccttatcatccactgcttcatgcctcccatcgaatttccagtccctgactctggccacccagcttcatcccactttccctgagataactgccctccaaagtggccccacagcctgtgggcacattccactccctcgggcctgggtgtggttccccacacctgagcgctcctcctcccctctccagccttattccagaaccccgcagaagacctgccttcttcacaaagcctccatctcttctcgtcctttctgagcccctccacctcctcactcctctgcagttccaaacaattcaatccttattcatatccagacagtactgtttgcattgtttctgtttctccaatggaaaattcctcaggggaagaaccatgaccaatcctcaggagatgagggtagcagagggcttcagagcacaggcttgggagttggactgagattaatcctgactctgccacacacttggctgtccaattcctagttaactcccctgccaatggtgataaagacagtaccaactgtctagggtatttctaggaagtaaacgacagaatgcatttctaaagcatcttccatgatacctggcaaaaatggtccatgagtaattatttcaatgattatgtatctgcccccagtgtagcctgagccttgctaaatgtgcagctggaactcaggaagcagctgcaattaattgacagaaaattattggaggttagggttatctgtaagaactagacaaaggaagaaaagtaagagggaattcaagaaagtgaaatagcagatgggaatgggtagtggaacaggggaaataggatccaaggactaagtcaaatctgtaagtacttcctgggcacccatgtgtgcacacactccatgggactgatcaagggtaggtgagacagaggttccatggacaagggccaccatccagctaagcagtcaaccaacacgtgctgaaagaacagaacacctgtggcacagatgcaaatgaacaggatggccagcatccctggtctatcctggcataactactcgttttcaccatcagtgattttgttatctttatgtgatagaggctattccatacaacctattggctgaaaataatgcctaacaataaaaaagctactaagaattcaacattttcccatgcatttgtattctgttcatcacaacggcatctacataccctgcaaaaaaaagtagaacacatatatttaaggcatttactcaagcgacaatatttgatgaatctgccctatggattcacagtcttggccactgggcagtgtacatgcaaacacacacacacacacacacacacacacacccacacacacccactcatgcctacagcatggggatcccactgacaacagctcagaagagaggtaaaggttaaggacaggcttctaacaaattcagttcaatacatttaagtacatattataataaaaatgaggaccaggtgtggtggctcacgcctgtaatcccagcactttgggaggccaagatgggaagatcacttgagaccaggaatttgagaccagcctgggcaacacagcgaaaccccttctctattgtaaaaatgactaaaaattggctgggcgtggtggctcacgcctgtaatcccagcactttgggaggccgaggtgggcagatcactaggtcaggagttcgagaccagcctgaccaacatggtgaaaccctgtctactaaaaatacaaaaattagccaggcgtggtcacgcacacctgtaatcccagctactcagaagcctgaggcaggagaatcgcttgaacctgggaggcggaggttgcagtgagccaaggttgcaccctgtacttcagcctggatgacagagtgagactccgtctcaaaaaaaaaaaagagtaaaatttaaaaattaaataaaaataattattaaatgatgcttgtaaaagtaggtaaatagatgcaagtttcacggaagaaagggtggatctgaggagatcctgaaggatgagaccaagtccagcagagtgaagaggaaagagaggaaatggcgagaattcacatgagcaaagggggaatcagatagcgtgcccagtgccgagccctgcctctgtggaagcgttgggggagggagaaaagcctagcaaccttgccagagctcagacccgccctactgaggggacactcacaggtgagcaggtgttcacaggtgaggacactccacgggggagcagcacaggagccgggagctgctctgggaagagctgaggcgccagagctccacagtcgcagactcaaaccggagacctcaccagaccctggctcgggcaagcttcctcaggctacatttccccaccacaaaacaaagatatattagtatgtgcctcttatggatgtaatgattttgaggtgaggttcaaataaacaaccaacctgaaatgcctgggagagtgtccaactgagagccgatactcaaagagtgatataataattaccacaaccactaatgccccaacgagccgctgaaagaaaggccggttccacactttagctcaccttcctcaaacagatgtggccaccaaacagtttgacgtaggatatatggaaagcatactaaaggagctcgaggggagttaggcgcttttagattagcatggggcgacaaacttcaaacatgccttgtgaccaaaaactatgaattcaacattttaaatagatttgtattttattaactacaaataaatggtctcatgggtaaattaaccaatgcaaaaaatggtcagtttttaaagactttataaacaaaattatcccccaacacacaaagtcaaaaatatgtaaaattcaatgacttattaagaacattctttaactttctccagaagacttttttttttctttttgacatggagtctcactctgtcacccaggctggagtgcagtagcaggatctcagctcactgcaacctccacctcccgggttcaagcaattctgcctcagcctcccgagtagctgggattacaggcgtccgccaccacacccagctaattttctgtatttttagtagagacagggtttcactatattggccaggctggtcttgaactcctgacctcgtgatccacctgcctcggcctcccaaagtgctgggattacaggcatgagccactgcacccggccaaatgaggactcttgtagaaatacatgtgcttttctctaagggacgagaaagaaatgtaaaatgagcagtttgtccgcagatcgtgcttcttgggttggtctggagccgacaggcgttgtggaatgacagtgtccatctggagattaaaatgagaactcctttgttctaggcaagacacatgcttttttttctcttccttccttcttccttcttccctgccacctttattccttttttggtttatcttagaaatgatttaaggcaacatgggcccttgatctgtgaggaggtgaggcaggactgttactctgttctgtggaattctagaaacttattttgggactttggaggtattcgctttttcctaagctctcagaatcatttttgagaagcagccgatgctgctagccagaacagctgtgagaagcgcagcgtctaggatggcctctttgccgacaccctgggatgggtgcatgcttcctcatgttttagagagaactgaggctctcagctctccctgtgtgctgggatgccgtctgtgacttgcctgagaaaatacctatggaatgagtgtgagggcctcatgaggtcacgtccacgaaagcactgggagctcgtcagaggagaagggcactctgaggccacatagtcggtaatcagacttccctttggtccacatctctgccctggctgccaggattcacagtgtgcagagggactgggccgttgctccagccgctccagcaggttagcaggctctgtgccactgtccccagagaagtctccctgagtggggtctgtgggctcttctctcggtcccaccttcaacacccacttttctcagcctggtgagaagggaggacagatggcttcccctccactgtcccccgcccatgttgttgaatgggatttgagaatggacgccaggttctaaatctgccattccgtctgtccttgagtgagcggctgaccagctgctggcccatgcttagaggatgttcgtggtctgccccagggcccactggtccttgagtgagcggctgaccagctgcagggccatgatcagaggatcttcgtgatctgccgcagggcccactggttggaggcccctttgggagtcagataacagaactctgcagtcacggctgtgaccgactcactatgtggcagatgggcttctgtgctttttagttctcacttcctgagaagtgtcaggtttcagcactaatatcatgtatacattttaaaaaatccaaaatcagaagcagaatttagtaattccccaccacttcctatgttccctcctctaacacctgtaatattcctggcacacagtaggtgccttaaacaggtccttgaattggggttggtgagaaaaggtgctaagtctgtctttccaagccatttaattgagcagcatttttttttaatgtggaaaatttttttatctgttacgtctttcctattatatttatcttgtccttgatttcagcaccccacccgatttgcaggcagtgctttctaaactgtgccctgtgagctgttaaaaagtcttctggaggccgggcatagtggcacacacctgtgatcccagcattttgggaggtcgaagtgggcagattgcttgagctcaggagttcgagaccagcctgggaaacacggcaaaaccccgcctctgccaaaaaaattagctgggcacagtgacatatgcctgtaagtcccagctactcaggtggctgaggtgggaagaccacttgagccccagaggcggaggtcgcagtgagctgagattgcaccactgcactccagcttgggcaacagagcaagaccccgtgtcagaaaaaaaggggggggctgggcgctcatgccttcaatcccagcactttgggagactgaggcaggcagatcacttgaggtcaggagtttgagaccagcctggccaacatggtgaaaccccatctctactaaaatacaaaaaattagctgggcatggtgttgtgtgtctgtaatcccagctacttgggaggctgaggcctcctcagcctcagcaggagaatcgcttgaacccgggaggcggaggttgcagtgagctatcgcaccattgcactccagcctgggcgacagtgcaagactccatgtcaaaacaaacaaacaaaaaacctcatcattcatctagcattgactgcattcatctagcattcatctagcattcatctagcatacatctagcattcatctagcatacacaggcaccagacactgtgttggggctaagcacagaatgtgaacagaactcctatgtctcctgtgccccagagatggaaggacagtggtggacacagccatcggtgtaaaaacgtcaatatatagatacatccatacttacacactgtgagaaaaagaacagcagaacctaagacagaacatcggaaggggccccctggcccttcaggtggtaatgaagaggtatccagcccgacccgggagggaggatgcccagggaaaggaggagcttgctccaggggcagaagcagcacacgtgcaccggcacaggcgacaatgcacatggccttccaggaccaccggccagtgggctcagggctcagtgagagaggaagaggaggatggcaaggcaggcaggccactccacacaaggccaggcaaggcctcttaacgaatctggatgcaaggaccttgctttttcctacatctttcattgttcccaagcccagtgcgctcctcaaggcaaacactaagaacacatgctcagttcagcaaatcagttacaaaccagtggctatttaataagcaaggtactgttaaaatcttggccctcaaattttataatttggtttgtagaaaaaaggaaccagaccatcccatctcaaacaaaaaacaaaaaaatcttgagacaagaaaatatatatcctgaggcagtatctgattaaacaccagatgaaatgttcaagtcacatggtccactggaaggggaaataattcccaggtaaggtggtgacaacgggtttcccaaagagggtgggactccaagtagaaactgaaatctggagcgaaccaggctaagctacctgggagggtggaccaggcacacgcaacaggtgaacggacgtacgggagtagggacagcaaggcacatcggggaggggtaagcacacagaaaggttgagcccgcctacaacacacaacagcccatcccgggcagctcacccccatcttcagggccttggaggcagaaggaagattcccacaggtcagggtccggggctggtctcctggcaggcacactttggggcagcaggagaaggaaggtgagtaagactgtctgccccaggaaaaagggcaagggcagagagctatggatctcattcactgggataaaaaattaagtgccaaggagggagaggaaagggaggaaaaataatccaaattgttgtagtattgtgcaactgaaattccatgcataagccaggaaattcaaaggtcacagttcccacagcaactgtaacctgacccgtcagcttaagtagcctttggcactgccagcccccaagcgcctgcagcccctacaatgcccacccagacctgccctcaggcccctgcacgtcaggcatgttgcgccttgcccagccgggcccacgtgggctgcccacctctggctacaaggggccctcagccatgcccaatagttctcagttctttaaggagcatcctgtgactccgagcctacttgctgtgggtctttacttctgactcttctgtggggtgagtaagcctccttcaccacccagatggggggaaaagggagaagagaggtgtgtgcatgcagacagaggcgctgctaccaccctcttcactcatgccctgtggcatcaacacttgccaagcctcaccatggggaaaacaaaggtggggggagcctggggagggaatgttgtagttcaaaggacatcagaaaagacggcttaccaaatgggagaaactttctaccagtctgaaatctgataagagacttacttctgtagggtatgtaactgagcatatgatccttcccaacagggcctgggacaccggcttgatcatcatgaggcccaggacggagccacacataggtcatgatagtggaagcagcacagggtgtgaagctgatggccacaaccgaccccttccagccccactgtggaaccggggtggcagttcagagtttgggtgtctgctgtgtgcagaagggagaccaatcagagccaggcttagacgcaggcaaatcatgggccctttcgaaaagacaggctggccaagtgcgatggctcacacctgaaatccctgcactttggaaggtcgaggcaggaagatgagttgagcccgggagtttgacaccagcctgggcaacacggtgagacgccgtctctacaaaaaattagccaggcatggtggcacgcacttgtggtcccagctactggggaggctgaggtgggaggatcatttgcacctgggaggtcgaggctgcagtaagctgtggtcgcaccactgcactccagcaacacagtgagatgctgtctcaaaagagattaaatttaaaaatgtttaagatacataaataaaaaacaagtcccctgagctcctcctcctatttatcacaacagaaaagactgaagactcacccaaaaatggtttatatcctggaaatcatacttccctctgggccatggtttatgtgagctgccaaaattccaggctcagggcaaagaatgactttcctgttactctggctcccagggtgaacacaggtaaggaaagtgacgaggcagtcaagagcaaagcccagctccctagggctttgtgaggaagaccagctccaccaccctgctgtctgccctgggcctggccctcaacagtgctgataaaacaggcttcaggggactgctgtgagaagtaagtgatggtatgtacagcagagcctatgctgcatggcctggcacacagaagttgctcaataaacgggaattactagtactgctgctatttccacatttcatgttttactcaaacctgatacatttataagagctgtgtgaggccaggtgtggtggctcacgcctataatcccaacactttgggaggccaaaggaggagaattgcttgaacctgggaggtggaggttggcgttccagaccagcctggccaacatggcaaaaccttgtctctactaaaaataaaaaattagctgggcatggtggcacgcacctgtaattccagctacttgggaggctgaggcaggagaatcgcttgaacctggtagacagaggttgtagtgagccgagatggcaccactgcactccagcctggataacagagcaagactccgtcttaaaaaaaaaaaaaaaaaaaaaaagctgtgtgccactgagtcctggttatttcacagcacagtggtagcacgtaatatgtgcttactgtgtgatgagcactactgtgcatgctgttctcttgaactttacacactagagttcttcagtcctcacaataacctcatgaggtagattctgtggatgaagaaacagaaattgagtcatttatcaaggctgtatggtttctatgtggtagaagacagagctgggcccaggcagctggactctggagccccagcatggaccacatcacacccatcctcaaagcatggaaacattcccaggaataaagcaggcaaaggccagcgtggcacagattccaaaaacagctcaagactgacttctttgaaagaactgtcagtctcaggtcagccttgtgatcacaaacccacaagaaaatggttctaagttctgcagaagggaaaggccagaacaatgcaagaagccgcagtcaagctgcagtcaccacaatcatcgtgtgatgggaagtggctctactcagaatgggaacaggaccacgcttcagttcaaaattacacttgctagaaagtcacccaaggatcttggtggctcacggctgacagtgaatgaaaagcccgcaaatttaaaaaaaaatctcataccctacttgactgacttcctaacaaattcccacaactttctggtatttctgagaacttcttacactctgcactcttccttacccagctttcccttgccttccatatttttccgctcccatgccccacacccagccccccagctacaggacttatactcacttgttcagattatgcacaaagaaaaaaattcaacgaattcatttaccccaatttagaaatggaaatacctgataaagagagctaaaagggatacagaacaaaccaggtatgaaatagcacattttcaagtcaccccaagtgtgtccccaaaaaacagaacccagcactgtcccaagagtgagttacacagactctcctgaacaccctcctggcatatgtcctcatgtttgggacacaggatttgctattaaagagtgctgcactttgggaggctgaggtgggcagatcacgaggtcagaagtttgaggccagcctgatcaacatgatgaaaccccatctctactaaaaatacaaaaattagccgggcgtggcagtacatacctgtaatcccactactcaggaggctgaggcaggagaatcgctagaaccgggaggcagaggttgcagtgagccgagataacaccattgcactccagcctgggcgacagagccagactgggtctcaaaaaaaaaaagagtgctacatggctcaaagccggagcaaataagacggccaacagaacatcagtatgtaagttaaatgttttatttctttctaatcttatctgaacaatataggcagagatggactgccaaaatatgttgtggggatcagggtagaagacagtttaagtttttcattctggtaacttgtccacataacccaaattcatttcttgctgttaaattccgtgtcttatactagagtaaataaagctgaaaatctcattagataacacgagggagttaaggttacactgggaaacagcactgcccgattttcttggcttttgcttaaatgtaacctcagtacacttgtatccaacctccagctattcccagaagcctggaaccaatcactgtgttcagcagtcatcagtttatggctggttttttattttaaatcagtggcatgatgaataaaatatacatgtatatatgtgtatatatatgtgtgtgtgtgtgtgtgtgtgtgtgtatatatatatatatatatatatatatattttttttttttttttttgagacagagtctcactctgtcgcccaggctggagtacactggcgcgatctcggctcactacaagctttaaagagcttttgtgacttagtttctgctttcaaaggattttaagtttgcaaaagctataacagtcaccaaacataagttctgagtattaaaggttatgggactgttacagactacttagttctagagacttcttctttttttttttttttagatggagtcttgctctgtcgcccaggctggagtgcagtggcgtgatctcggctcactgcaagctccgcctcccaggttcacgccattctcctgcctcagcctcccaagaagctgggactacaggcgcccgccaccatgcccggctaattttttgtatttttagtagagacggggtttcaccgtgttagccaggatgatctcgatctgaccttgtgatccgcccacctccgcctcccaaagtgctgggattacggcgtgagccaccacgcccggcagagacttaactacaatagaaacatctgaaagcacagaaaactgatgtgcaaatccaggtttactcaagaatcgagagtaaatttgacatcaccaaaattaaaaacgtgtatgcttcaaagcataaaagacaccatccagaaagtgaaaacacacctacagaatagggaaaaatatctgcaaatcaggtaacggatagggaacttgtatccagaagacataaagaactcttacaactcaataataaaaaggtaacccaactttttaaacagccaaaggatttggacagatatttatctaaggaagacccagaagcacaagaaaagaaagacgccaataagcacatgaaaggatgctcaacatcggcaaccattagggaaatgcaaatcaaaccctcaaatgaggtatcacttcatacccactaggaagactataataaaaaaaaaaaaagacagacaataacaagtgttgacaaggatgtggggaaactggaaccctcctatgttgctggtgggaaagtaaaatagtgctgcaactttggaaaagtttgacagctcctcaaaaagttaaacatagagttaccatatgacccagcaatttcactcttaggtatatactcaagagaaataaaaatatacacctggccaggcacagtggctcacacctgtaatcccagcactttgggaggccgaggcaggaggatcacctgaggtcgggagtttgagaccagcctgaccaacatggaaaaaccctgtctctataaaaatacaaaattagccaggcatggtggtgcatgcctgtaaccccagctactcgggaggctgaggcaggagaatcacttgaacctgggaggcggaggttgtggtgagcagagatcacagcactgcactccagcctgcgcaacaagagtgaaactctgtctcataaaaaataaataaataataaaataaaataaaataaaaaaatatacacctacacaaaaacttgcacatgactattcatagcaatattccaaatagtcaaaaagtggaaataactcaaatgcctatcaactactgaatggataaagaaaatgtggtgcatacataaaatggaatattattctgccatgaaaaggaatgaaattctgacacatgctacaacatgaatgaatcttgaaaacaccatgctaagtgaaagcagccagttacaaaagggcaaatattgtatgactacatttacatgaaatgttcagaatagcaaatcagaaagaaagtagatgagtagttggccatggctcaggagaggggctggagaaggtaacagtaactcctatgggtacaaggcttcttttggggatgataaaaatgttctataattgaatgattgtagtgatggttgcaaaactctgcatataataaaaccattgaactgtacacttttttttttttttgagacagagtctccctctgtcacccaggctgaagtgcagtggcacaatctcagctcactgttacctccgtctcccaggttcaaacaattctcctacttcaggctcctgagtagagtagctgggattacaggcagctaccaccacacccagctaatttttgtagttttagtagagacggggtttcaccacgttggctaggctggtctcaagctcctgacctcaggtgatctgcccgcctcggcctcccaaagtgctgggattacaggtgtgagccaccgtgcctggcctgagcggtacacttaaaatgaatgaatggtatgtgaattatataataaagctgtttaaaagaaaaaaaaaaactggctgggcacagtggctcacgcctataaatcccagcactttgggaggccaaggcgggaggactgcatgagcccaggagttcgagaccagcctgggaaacatggcaaaaccccatctctacaaaaaatacaaaacttagctgggtgtggtggtacacttgtggtcccagctacttgggaggctgaggcaggaggatcactagagcccaggaggttgtggctgcagtaagctgtgatcatgccgctgcattccagcctgggcacaggaatgagaccctgtctaaaaaaaccctgaggggagtaaccatgtcttatgagtcaccatattctcgaaagggcctgccatatagtaggtataaacatatgtaaacggcccaggtacagtggctcacgcctgtaatcccagcactttgggaggccgaggcgagcggatcacctgaggtcaggagttcgagaccagcctggccaacgtggcgaaaccccgtctctactaaaaatacaaaaattagctgggagtggtgctgggcgcctgtaatcccagctactcgggagtgtgaggcaggagaatcacttgaacccaggaggtgagggttgcagtgagccaagatcgagccactgtactccagcctagacaacaaggtgaaactccatctcaaaaacagtatgtaaacgttggtaaaaagaatagagatgttgagtctttttaccaaagatttcattagaggaattccccacggcatccagcgccttctacaacagtcccagcctagaggaaacagatccctccagcaccttctcccagcccagcacaccaccaatcaggctgatctctgtctaaagtctcttctcaactggagtgctgctatgaggctttactggtggatttaaaaaaacaaaaaaaaacaaaaaaaaaacccacaggtttttttgttgttgtttttggttttttataatttttgacacagggtctcactttgtcacctaggccggagtacagcacaatcatggttcactacagccttgacctcctgggctcaagcaatcctcctggcctcagcctcctgaggagctgggactgttggcacatgccaccacacctaactaatattttaattttgtatagaaaaggggtctcattatattgtccagactggtctggaactgctgggctcaagtgatcctcccaccttggcctcccaaagtgctaggattacaggggtgaaccaccgcacctggcccccagcaagtctttctgaaagtgggtaatatgagctcttgaggaacaggaggaagcatgggatgtagccctctctagcagtctggctagaggccgaattagcattcgtgaaacagcagcagctcagggcaggggaatggagataaactgggaaataaagacggaaagggcctttggtggaaggagggatattcttctgggcttccaaaaggaaattgctgcaaactactttcctgccttccccattccgcaatcagaattaacggcctcctccacagcattttgttcaaatccgcctgctatcacagctgactgcacacacatctggctccctaccatggaataccctcctagtgggcaaggacaactttcagctcctggaaaaccatcagcagagtcttgaacacaggaattggacagtctgtatttgctgaacttaagtatttacttcacaacaattactactttaacacctcttttctgaagcctataagtatttgtggcaacggagaaaaggaggcagaatcctcaggctgtcaacatgcccttcatgcaacctacaacgagcagctgtgcactccagccacacccactttctccagagtgccacagtttccgtcttatcattccgcccgtcttatcattccgcggcagcaaaccagctgcccgtctgctcctctgcctcagcctcgcccagatgcggctgtgctggcccgtcaccctcagttcctgctcaactgcaccctcacttccgactaagtgccaggtcctgcactttcgctgggcctgccccggcccccaccagtgccctgcacacttggaggtgtctgtgatcatctgtctattggtcccctccagacactgtggactgcaggagggcagtatttacttcacccactgcagtactgtgctggcaaatgcttaacagactggtctccaaaaacatgtgcatgtatttatatggacacatttattttcaattttactgatataaaagatatgcagcacacaatggtaataacatatacaatacagtaataaatatatatcataaaatacacaattatacacttaataaagcacataggaataaaatctgtaatactcttcattgtaaattccactgagccacctgattctcccagaatgctttcctagatttttttttttttttaatttggtccaactcttacatctgtgactattgactctaaggaataaaacaaaagtgaaagaaagaagataaagatcaatcatgatataagcaacttctctgctgaactggacactagtttcaaataccagaagaatatttactcaattttcttgtactattcacaatataatggttacagacacaaaatactaagtttaaactgcaatgttaaattttttttcatcactttctcaatgaacaaaacaataaacccagccctaatgtgttgtgtttgcgagtgtccatggtgtaaatgctcccaccaaggctaatgtccagcccccaacatgacatgtgagcgcagacacagttgggaacagatgcgcatgcacagcactacctggtgtctccaccacagacacagcaggtgtgatggcacaggcgatgctaaggtcaacaggaagtgatgagttttgagtatttattacctttgcctttattataattcatttaattataatggcggcagttaacaaccaacttgcaaaattccttaagagatgggtgaggtagcccacacctgctgaggtacaaggatcgcttgagcccaggagttggagaccagccttggtaacatagtgagaccttgcctctacaaaaaaattaacgaaattagcagggagtagtggtgcttgcctgtagccccagctacttaggaggctgaggtgagagaatcgcctgagcctgggaagtcgaggttacagtgagccgagactgcaccactgcactccagcctgggcaacagagcaagaccttgtctcaaaaaataaaaaaaaaaaaattaataagaggctaagagctggctctggtaggccacggctcactactgaattcccagcattcagtacacgaaaggtggtgacggcacttgtggaaacacagcacagccccgcagtggcttcactcctgaagtctgtgctccaaagggaatgcaggctttcccacagccgggcactggagaaactgcacgtgcaacacgttatcttttcaaaaacgggggaaaatgccattttaaaaactcagcatacgctgaaatataaaatgttttcttggccaggcacggtggctcatgcctgtaatcccagcactttgggagaggtgggtggatcacgaggaaaggagttcaagaccagcctggccaagatggtgaaacgccatctctactaaaaatacaaaaattaggcaggcgcagtgtcaggcacctgtaatcccagctacttgggaagctgaggcaggagaatcgcttgaaccaaggaggcagaaattgcagtgagccaagattgtaccactgtactccagcctgggcgacagagtaagacttcatctcaaaaaaattcataacataacataacataacataacataacataacaaacataacataacataaaaataaaataaaataaaataaaaaagtaaaataaagtaaaataaaataaaataaaataaaataaaaaagttttaatacattctccctgaggtacttcttccacagaaacacttaggtagcagggaagcgcattttaaatccttcaacagtctgactgggtttagcaccctgggtggcgttagtcacagggtattccttaaagcttgtgagctcggctcctcatctggaaaggacagagtccaaaaagtacctcagaaacgaaggaccttgggctgaggccacagcctgggaatgcctctgggccccatgggtctcttctagctcagcaggtctctctcattctgtctactgttttttctttttttagagaaggggtctcactttgttgcccaggttggtctctcccgcctcggcctcccaaagcgctgggattacagctgtgacccaccgcgcgtggccaaatctgtctcttctcacactgctgcaccaccttcccttcaacctccttgggtcttcacccctccccatttccctgggaccctccctgcacccccctaggctggctttggcccttggcttcccagcatccttcccactcttttaacaaccaagggtcttaatttcacctgctgctgtcactagtaactcctaagtccacacaggactatgggcacactcatctctacctattatcctcatgacagaaccctgtgcgccccaaggatggagaccatctctacctattatcctcatgacagaaccctgtgcgccccaaggatggagaccggcagtgtccttcagactcagctgcacctccaaactctgactctgtactcccaagtacaaggctgaagctaaatctgcctcctcagagtctccacatggcttacctccctagaaggcagtgctgcttgtcccacaccaggtcttctggtccacgcctcttctccgtccccagttagtaccctgtcctcaccaccccaccctccagtggacaccattccacactgcccgccacaccttcatcctctctggacaccttcacaccatgccacttcctatggaagaaccctatgctaaaggtgccctatcagactccgagagaatattcttgttcccaggaaacagacactgaaggattcaggagtcaagggagacactttcactaatttacaaattgttctgggaaaaaaattcaaagagaagaaaaaaatatgaaaaagtaaatggggcaaaacgcaaatcatcgtgactctaggtgaagggtaaataggaactcgtgtactattctcaaacttttctgaaattataccaaaataaagctatccccaaaaaatccaaaccctcaccttatcgtcaaagttcaacaatcaacagctcttcttagaagccactcctgccaggcaagttccatctatctgacatcttgtttctgccccactctcaacacctagactcaggatttccctggtccctccctgccaacccacttcctccactgccctgagagccagttcctgactcacttcttccaggggtgctgaggaaggaaaggaactaacattccccaaccacctgctgccagccaggccaacactgcgctcgacacataccatacagtgtttcacctaatcctgcgaacgcctctgcgaggaaggcctccctggagactcggagagataaagacactggtccaagattacgcagacaccgatgcagagctggaacagggacccagtggcctgtgccacccacagcattgacccacacctcactgctccctgacgccttcccagacctcccccccaccccccacgccccacccagtcacttggtcagtgaacacagatgggctgctttgccccaggtcctgctctaaatgcttagggatctgtcagagaacaaaacaaacagggtttctgacttcatgaagcttccatttttgtgggaggagatggacaataaaagctgtatttattaaacgcttatagcactgactccatggcaggtgttatgctatgcattttataaatataaattcatttgatcctcacaaaaattctgagttaggtattgttcatacaaatgaggaaaccaaggcaaaggggttaaataatccacccaaagccacacgagtagcaagtggtgaagccacaactcaaccccaggcagcctggctccagagcccaggccctccacctctcagtaagcatgagtgagcaacacagcatgctagagggtgagtgccccggaaaaatggagagtaaagcagagtaaagggaatccggagcacggagggaaggagacacactgacattttaaactgggaggcatgaggattcccagaggagctgacatctgagcaaagccacgcaagagttgagggagtctgcatgcaatattgcaggaaagagtgtttcagggagggggagtctgtcccacagtcctgaggcagggtgtgcctggagcacgggaggaaggtccggccagggaggggacagcccctgccttttgtgcagcagaatgcccgagcgtgctgcgtgcccgattccctgcctccctggtgggccgtgctgctctttcagtattcaccttgacttccaacatgaaccgtgaactctgagaacagagcccgtaacctctactccctctgcttgtccctggtactttcaagctgatgtttgctggatctgtctgccttgccttgcagattccacaaaactacaaggtccgggaggatgagcaggtcctgccagggaagcttctgacacctctgtcactggtcctcctacactagtggtgagcagtagcctctgcctggggcggggaagcagaagtaaatggcgcttgtattctgtattttcaaagcatgcctgcccaattctatattcaaattttattcccagtaggcccctttaaactggtaggcagccaattccaccctacttgacaaatggcaaaatcatcaggtaactcacctgaactcactgtgcagcagcagaatcgaggctttctcatctagactgggagatcagagtctgcagaggccactcgcatcttcaccctcctttaggacccacccaccttctctcaggcccagccccaggccctgcagaactcatgactcttgaatttcagatgtgctgggacacaagaatcactcttgttttttgttttgttttgttttgtttttgagacagtctcactctgtcgcccagggtggagtgcagtggcagcaatctcggctcactgaaacctccgcctcctgggttcaagcaattctctacctcagcctcccaggtagctaggattacaggcacccgccaccatgcccagctaatttttgtatttttagtagagatagggtttcaccatcttggccagtctgatcttgaactcctgaccttgtgatccacacacctcggcctcccaaagtgatgggattacaggcgtgagccacctcgcccggccacaagaatgactcttaagaggtccgtaatgactggtccgggcacagtggcttatgcgtgtaatcccagcactctgggaggccaagatgggcggatcacctgaggtcaggagttcgagaccagcctgccaacatggtgaaaccctgtctctattaaaaatacaaaaattagccaggtgtggtaacacacgcctgtagtcccagctacttgggaggctaaggcagaagaatcgcttaaacccgggaggcagaggctgcagtgagccaagatggtgccactgcactccagcctgggcaacagagcgagaatctgtctcaaaaaaaaaaagaggtaagtaatgaccgaacagtacagggtcccgatcccatctaagtaggctgaaggcaaagactgagcatttagttaagtcacagagaatttagctaaacgcagtgagtcacccacttcacacagagaaaaatgcatccctctactcctgtctcatcacgcacagaatgcccagatttctttcccatagttccccttgaactatgcaggctactcataaggaattaaggaatatgcatcagacacttccctatttctagtttcagtcttttaagtagccaaaagaaaatgcctttttgtcctacatcagaaatggtaggatacctcttttctcccatttatttccaaagtagattacaccaatttaattccattttattttctagagtaagcatacaaaaaaatccatcctggaagaatcattttcgactggcgtggtggctcacatctgtaattccaacgctttgggaggctgaggcaggagaatcattgagactaggagttcgaggccagcctgggcaacacagcgagaccccatctccactaaaaataaaaaaaaaattgtccaggcataggggtgcatgcctgtagtcccagctactcaggagactgaagaaggaggattgcttgagcccaggagttccaggctgcagtgagctatgatcatgccaccgcactccagcctgggtgacagagcaagaccctaactcgaaaaaagaaaaagaaacaagaataatcattttccacagactgacaggcaatggaggagaggaaagctgaaagagaaggtgtttggaactgtaactgagcggctgttctgttcaggagatggccttcctcctggaggcagcagggactggcaggagctttgtgaaggaaagtacggtccccgccctctgcagcttagatgctcaagacaagtgatcggtgagccctaggcctgctctccctctaggccactgctgggccttctgccccctgggcagcctagcatgcgtgctggggaaccgctgcaggtgtgtgggtgcagagacgggcaggtacctacccacctgtatggaacagctgccacgtcactatttacctatggcaggtactccgagcaagagcaattggagagatgctagcttcaaagacagaaacagcactgtcactgggaactttctcgatcactgtcctgtggtgtggacaagaacatccttattcttcataaacccacactgaattatttagggtaaaggggcacaatgtcttcaattttcaaattggtctgaaaaaaatgcatctacacactggaagaatgataaagcaaatggggtcaaacgatcaaatctaataaatccaggtaatagatggggagtgcctgcactcctcctgcaacttctctgtaaacaggaaattatatcaaaatagagttgccctaaaggtggctacctgtggctccacaaacaggcgggcaggctgccccagtcacagcagggggcacctgctgcccagaacacccgaagccaaggcagcagagaaaccggcacagcactgcccccagggagacatggggacagctaacaatgctgatggaagtctgcgagcatccgatatctcttgggtttttcttcagaaccaagtcatactcctggcacttggaaaacaaggccagctttaccaacagggggctggaaaggcacctacccagcattatccggggcgctgccctctccttatcctttctatcttatcagtgtcctcttctcaaaatgtatctggcatcaggtcccttccactccacatccactgccaacatcctgttccagttccttgtcatgtcacacctgaatcatccccatctgccaggggtgggcacaccaccacccacacgccagatccagcctgcaggccaaagaatggtgtttacatttctgggttttttttggttttgtttcctgagacggagtctcactctgtcgcccaggctggagtgcagtgacgcgatcttggctcactgcaacctccaccctccgagttcaagtggttctcctgcctcagcctcccaaatagctgggactacaggcgcctgcaaccgcgcccggctaatttttttgtatttttagtagagacgggggtttcaccatcttggccaggctggtcttgaactcctgacctcgtaatccacccgcctcagcctccccaagtgctgggattacaggcatgagccaccgcgcctggcctggtgtttacatttctaaagggctggggaaaaaaattaaaaggaagctattttgtgacatgtaaaaatgacataaaatttaagtttcagaggccacaaataaaagcattactggaatccagccacagctatccacttctgtgctctctgtggctgccttcacacaacagcagaggggagcagccgcggagtccaaccagctcatggaacctaaaacatttaccttccggccttttacagaaacaaatttgctgactcctccccggctgatcttgcttgactcagttctcccgcctccacaagattaactgacctaaaactcgacttccgccgtcgctctgtgttcaaacccccggcaggttccccgatgcccataaagcccacactgtaccctgacatccatttgaccaggagaataaacaagaaagccctcaacgccatgcctttgctcatgctgttctctgcctttcaggaagcccttcctgccttccaccgctaagcctgccgctaccttaccttgcccttgcagtcagggcaaggctctgggaatgctcccagctccctgtgctctgctcccacagctccctatacttaccctcatcatagctcttaccacacagcgctgaaatcaactatttgtgtgtctgtcttgccagctgcagcaagatcccagagggcaaggaatacatcttatttatctcccaccacccagacagaacccggtacagcagctcatcaatgctgaaggcaaccccagcctggccaggctggcctcctcgctgcccctgaatgcatgctgctcacgctcaaccctgagcctgcgctcaccccagcacccccacatctcacttaagacaatcctaccatggcctgagcacagttcaaattgcatctcctccgtaggcccacagaagtcaacatggtcacaggttcaaacccccaactcctctcacccatgtgccaagtgcccttgcacaagatgcttctgtctctgggtcctcatctgtaaagagggaatgactcagtatcccctaacttgcagggctgacaacgcatataaagcttctgaaccagtgcttggcatataatagattttcaagaagtaatagttagcatgcttgttttcccgaatcacaccatctatgcctatttcatcccttttcttccccataactgttgtgtatattaccctggctctcctgaggcaggtttgtcatgagcagagacaaggtcgtagtacactttcatgaagccgcccctgccctaaaacccagggcaacacaacacgtggaaaaagggaccaacggatacaactttaataaataagttatttcaggaggcttaaagaattgctaataaaaaaaaaatgcaaagccccaggggatcaggagtgagctagagagcaggcttttgcagatgctttcatattgatgagaaaggcagttagagagcgggagcaagcgggatgaggaggggaccagcaagataggaaagaactcccccttggagggcactgttcattctcacccatccaaacaccgcaaagaaacctgtgctgactcactggatagtctggacccagcatgctcccctgaagactgtctctggatgacaggaagccccaagcctcagaattccattccaagtttcatgagcaccagtcagtgacagtaccagctgatgcgtggggtgctcactgggtgcttaccacgtgctgggaggattctaaatgcttgtgaccatacaaggtgagtaggactgttacgcccttcattgcacagatgaggaaactgagtctcgggaggataaggaacacactcccggtcacacactctagtaaccggtatagtacagcacagtcgggttccagagtccaaactcttaaccacaacacagtttgagtgtcttactctgatttagctccaccatttaccgggtgagagatctcaggcaagtcatctaacctcactgcgcctcatctttcaagtgggcctcatacgggtaactctgtaagattgtcatgaggattgaaggcgatcatgccatgacacatattatgaagcggactcctgagaaatcagttctctcccacttttcccatatcccaatataagtgaggtttttagccaaaccccttgacctcttttactactgggaatgatctatatgccctgctggattttcttgcctgcctgtgcctaagcatttggacctcataaaagcttacaaaaatggcctggagacaagcattaaaggaaagcaactgcacacggagctgagtggggcagcgcagcagagatggtccacacggctcctggcgtgcagatgaatactgcatgagcagaggctgggccagccaggccctgccaggacgtgccacaactgacagcccgtgacagcacctagatccatgtgccgcaccaacaggcccagatgacaggcctgggaggctgcaggcagagccaggagcacctgtgcctctgagcctgcgtgtgtgtaagtgctgtagggggacaaagaggggcaggcaggtgaaagtgacaggcagtcattcccaccaatggtgggatatcagactgcctaaaatattgtctatagcaaggtaaatttttaaattcctacagaaggaattgttgcaaaattcttttactgtgaagaatttaatttcaagtcaagacgtacagatacacactagtttattttgaagataaatccacgtttccatacatcaattttgcctgaagggtaagagacaccttaaagccatgaacccttcccctgggctggtggtcatgcacagaaggaacttgtcataagcagcatgtaaaagtgtccttcatgttagccagtcagctatattaatacagcaggaagcagagatcaggtgtttaactcatttatagaagacataagtaatttctatttgaatggacctgatcaaatggaaccaaaggtcttagaaaataaaaggttaaaacccaagcaaaacggtatctcactcatcatatccagtagtaagaagtcctattaggccttttcccacaacacgtcagcttccaaatacagcacatgacaaagaaatacttcagggagatggaggaatggggggctcgctactgtgctggctaatgacattattacaaggctccaaccagcttcgaggccgtggtagacacagcaccgtggtcctagggttagaaaggagccgtagaagcagcatgaacaatctaatgcccagagcatggatgaggcgcctccatgcccaggactgctcccacccaccgttgctagagcacctaggaaagggcacagactgcaaaaccctcctctaggaagggctgcccagtccacttggggcacctatatctctcgatgagtagctgggcaaggacaagcacattgagagcaccagctccaaagtggtgacgggcccaagggcagcctgcaggcaagggaaatggtcccagcctttcctgcagccaaagtgcagggctggtcctcaggaaggagttgcaaaatgatcctgtttgcaaaacacaaacattccacaaacagcagacacagggggtaggcaaattctagaaattctcaatcttatgtgcaagaaataaaaccaaatcaagaatattttactagttggcataaatttgcttagcactctacgtccagggcttcctggccagttaaatccaggttactgcacttgcatggctgacaatgcatccaaccccttagaaatatcaacctcttgcagacacaggctgtcttaccacgtggcacttacatacaacagatgctcaataaatgtgctgaaaaaagtcagtgtgtaaaggattcctgaagtaggaatcccccctgctccctggctccctgagggtggttgaggcccaggggcttgtttgtatccccacccctcactagggcctagcacggtgctcactaaacccggaggccgccaattcaagctaccacctgtgaatttcttccctgcctcatactgtctttttctgccccattcctcttccttttgctccctgaacatttatctcacgggatttggagtcattagctatgcaaattattgggtttatggccctttacctcactggaacagcttccctgctgtaaaatggggtgaaaggactctacctgaagactagaaatgatgtgtgcgcagtctggccacggtaaggcgaagcgatcactgttatgactttcttatataattgtccacaggccccactgtctaaaggtacttagaataccaaaagcagaaagtttatttgtttttcctacccatgcaagggtggttttgagaaagcctatctgttttggaaagaaactgacccaagcccatgtcactagttaaaatatttcctttttcctttttcacagggaaatgaatgactctgactactcatggccaaactgggtaaaaggttctgttccataagttcatgtgccaattatacacagtgattaggattcccagatggctttttttttttaattttactttaagttccgggatacatgtgcagaacgtgcaggtttgttacataggtatacatgtgccatggtggtttgctgcacctgtcaacctgtcatctaggtttgaagccccgcatgcattaggtatttgtcctaatgctctccctccacttgccttcctccacccctggcccagctcattctcttaaaagaatcatcacaaaggagtttagctggggcaataatggatctgcttgggttccacaacttgggaatcagaaggaagagaagggcttcttcatcttttccaggagcagggcagccctcagcactctctggattcccaaggcacagcccccaggttcctgaacacacagtgtcttaagtgccccccgggaagcccccctgcgcccacactctcctcccagtgcttcagaattacctcctgactctgccccctgagaagcaggccaggaatatttcaaggaatatgccaactaacctcaatgcacctctcctggcacttcagagagagaactcaagagtgaagagagggaaatatggaggaggggtctgaagacaggaagcggtgaccccccaggacggaggtaaccccgtggaatatgcccaagtcagttgccctcaactggtctgtgacaccacaagtccaaaacccaatgccttcatctaaatcctgacgccaccacttgttttagccctctgtgccccacttcctagtgtgaaaagcagggatcataacagcaccccgtctgtccgctgtggtgaggactgagcgcgttaagacacgtgggcactcaggacagtgtggcatggccaacagtctctaagcatctctgatgctgccatcgctgctgtgctcatcagcgccaggtgctgctctcccacccctgtccctgtcccatcacagcctgacaattctcagccacaacaaggagctttgttggtggaggagggaggaatatggctagaacctctgtaagctgactttctgtgggctggggacagtccacgctaaagggtagctgccattcccctgggggctccaggtgccaggagtgagcactctgcatcttccccctgaccaagctgctcctcctctcttggcttccaacactggcactggcctcccgggacccatgctacctccagacttcaactggcaacagaaaagagacagagggctgggtgcagtggggtgcctgtaatcccagcactttgcagggatcacctgagcccagcagttcaagaccagactgggcaacacagagagagcttgtctctccacaaaatttaaaaattagtcgggtgtggtggtgtgggcctgtagtcccagctactcaggaggctgaggttgggggatggcctggcccaggaggtcaaggctgcagtgagccgagatcatgccactccagctggggccactccagccggggccacagagtaagactctgtctcaaaaaaaaaaaagaaaaaaaaagaagcatgggcaggagagaagagaagcctgggacccactaaggtttatttcgcctttacacaggaaaagtcaataaaagccactagttaaccacaaggctgtgctgtccatccctctcctgccagagttaaccagaccgaatctcctgccagagttaaccagactgaatccttcaacagatatacaattcaacagacacctgcagacgtgcctaatgcaggaagactcctcactagattccctcacacataacacacatgcactctgagctgggcgctagagagacacggcctaacagaacacgaaaaagatactgttgtccttgccaaggtcctcactacttagcagaagctcttgcccttccgcttccacctttcatcaaggtataagccaacagtctcacttcttctctcttctttaatctgatttctgtcctccctttttcttttaagagacagggtctcactctgtcacccagactggaatgcagtggtgtgattatagctcactgcagcctcaaactcctggcctcaagtgatcctcccacctcagccttctgagcagctgcgactataggtgtacaccaccatgcccggctaatttttaaaatttttgtagagacagggtctcactatgttgcgcaggctggtctcaaactcctggcctcaagcaatactcctaccttggcccagcctctcaaagtgctgggattacagacgtgagacattgcacccagccttttctttaatttttttttttttttttttttttttttttgggacagtagggtcttgctctatcaccaaggctggaatgcagtggtgcgatctccgctcactgcagccttggcctcccaggctcaaatgatccacctacctcatcctcctgagtagctgggaatacaagtgtgcaacacccacacctggctattttttgtattttttttgtagagacagagtttcaccatgttggccaggctggtctggaactcctcacctcaggtgatctgcccacctcggcctctcaaagggctgggattacaggcatgacccaccacacctggcctcttttcttttttaaaactgcggcaatcatctctcctctgttgaactcaccaatgagaaaaagtcaatggggccaggcatggtggctcacacctgtaatcccagcactttgagaggctgaggcaggcaaattgttcgagcccaggagctctagaccagcctggacaatgtggcaaaaccccatctctacaaaaaattttaaaaattagccaggcttggtggtgcacgcctgtagtctcaactactcaggcagtcaaggttgcagtgaaccatgatcgcaccactgcactccagcctaggtggcagagtgagatgctgtctcaatttaaaaaaaaaaaaaaaaaaaaaaaggctgggcacagtggctcacacctgtaatcccaacactttgggaggccgaggccagtggatcacaaggtcaggagatcgagaccatcctggctaacacggtgaaaccttgtctctactaaaaaaaaaatacagaaaattagccgggcatggtggcaggtgcctgtagtcccagctactcgggaggctgaggcaggagaatggtgtgaacccgggaggcggagcttgcagtgagccgaggtcgtgccactgcactccagcctggcccacagagcaagactccatctcagaaaaaaaaaaaaaaatgcaatcaactgcaaggcttggggtgacagtttcctggtcattcttcccagtttttttgtgtctttatagctagagatgactaaagcccacctccaagaaaacagcaagtcacgtacaactgaagcccatgggggcaggatgctgttctctccaccggggcaatccaagcacctgagtgtctgacaccacccatcacccaggggatccgagctgaattctaaagactggaaccaaagatgacagagtgcgtggctggagagagggggaagtccacagagtttaggtaaatttctgaaccacatccccaccacgcccacaatgtactgcattgaagtacaccggaagctaaagaccaaaaaggaatcagattttcagctctgccacctaaagcagaaactgagggccttattcaccgcacagactttagcccaagtgccatgcctccagtttcacagtttcaccagcagctcaagcaaaatggcctggacactaaagatggcctctgggtcagagtatcactcatttcctctgtccacaaaccactttgattctctttgattctctctgtccctcatctccccatctagtctttttttttttttttttttttttgagacagagtcttgctctgtcacccaggctggagtgctggagtgcagtggtgtgatctcagctcactgcaacctcggcctcctgagcgcaggcaatcctcccacctcagcctccagagtagctgggaccacaggtacacaccaccacgcccagctaatttttgtactttttgtagagatggggtttagctatgttgcccagtctgctctcaaactactgggctcaagcaatctgcccacctcaacctcccaaagtgttggtattacaggcatgagccactgcgcccggcccatctggtcttattaaatacttcattctctgcaaatgcagacgttttctcagctctgattattttttctaaagtaatgaccccccacctggctagatgaatgcttctagcaaaggaaaagaccagaatgtgaaaattgtactgcaatagaacataaagcccgtccaaccccacctcccatcagacctggggtggtggcagcagcaggcgtcagggctctcaggcctgcccattagtcatccctaaggcccgttagcacacgggttaggaggagcacacactctggaatcagaaagcccaggattgaacccagccctgctttcagtcaaggctttgtcactcactatcactcccttgacctaggacctcacaaaaccttgtcatccgtaaaactggggatgataagttctaccttgaatgttgttgtgaggaataaatgaggtaatgtctatgcagcacctagcacagattcctgcagataaacactcaataaatgttaactatcatccactacctagtcatcagaaaagcacaatgatctggtatctttaagtccttccgcttccaaaaaaaaaaaagaaaagaaaaaagaaaaagatgtgtggattttttccccctaaaggtctcagtgaagtgaaacttaagaaggaaaacctgggccgggtgtggtggcttacgcctgtaatctcagcactttggaaggccaaggagggtgaatcacctgaggtcaggagttcgagaccagcctgaccaacacggtgaaaccctgtctctactaaaaaatacaaaaaattagcagggcgtggtggcaggtgcctgtagtcccagctacttgagaggctgaggcagaagaatcgctcgaacccaggaggcagagtgcatgagccaagactgcgccattgcactccagactgggcgcgacagagcaagagactccgtctcaaaaaaagaagaagaagaagaacccaattcaaatcccagttcagggaccaactcatttgcaacttaaagcaaatcatgttacctccatttctttgcctataaaatgggaataatagactctattaaactttaacgacttcagagacaattaagaatcaatgagataacaggtcatgaaaaagctttcacttcctcaagtaaaaagcaactaagtagtaaatccagagcataataataataataattattattattattattttttttttgagatgaagtctcgctctgtatcccaggctggagagcagtggcgtgatcttggctcactgcaacctccacctcccaattcccggttaagcaattctcctgcctcagcctccccagtagctgggattacaggcgcgcaccaccacgcccagctggtatttttagtacaaacagggtttcaccacgttggccaggctggtcttgaactcctgacctcgtgatccgcccgcctggcctcccaaagtgctgggattacaggtgtgagccaccgcgccgggcccagagcataattattattaaaatgccaggccccataatattatggaacataaataagccaatgatggctcttattttttctagaacattagatttgatgcccttttcgtctgttcacatggaacctgctacaagacggagaaggcaaatggctgctcctagcagatcccagttcagaggcacggcccagcaaagctagcactctgccaatggtcaggcttcgaccatctgggccacttcccagaagccagtgccaggagaaattaggtaattcatctggttccacctggacatgtgaaaccaacgacaaccaaaatcctcacctgcaggactactcgacagatgcaggaaagggtcccctttgaccctctgctcttctgtactgaatggtgtaccactcttccagggcatgtgccatccttcctttaaagggcaacacatgatccaggaagaagagctcaatttttccttatttttacttctaggaccaagacgtgagtttcatttttaatctaccacagaaatgtctggagagctggaagtttgagtgggaggaggaatgggggggacctcattaccctaatttaaaaacggagcatgcaaccaaaactgcatccaatatcatcatccccaggtctctcaaacccaaggaagagaggaaaaatttacttttatgtttattgaacatctgctacgtgccaaggactgtgctaagttcttcacgtacattatttccaaagcccattttctcttccacacctagtaacaccatggaataaccaccacggaacaggatcatcccaggtgggggtttggggggaggaattacaatatgcagtcaagtttaagacgtttcaaatgttagcgctgtaaacacaaataaacagccttgactgaggaaccaggtctgagttctaaagtatcctttacaggaggaacacacaaaccatgtctttcctataattatgaaattaactcaagctgttgaatacactataaaagagatttaaaacttctaaacctggagcacaagaaaaactcactataagacttgaacaatctggggctggatttctgacctgagaagtacatctggcaatcaaatatggaatgaacggcatcctctgagagggctgcagagatgtgctcacgggagaaggtaaccacaatgaactggcctgtgtgcggccaggtaaccagaaggcggggctttcccgcaggcggcagcgactgtaggaagatgtctttctcagcttaaaacccagttcatcctcatccctggagtacaacgactgtctatggagcaaagtgtcagatgggaccaaatacacattggtggcctgatattcaaatgtcatcctctccatgcacatcccactaaaaacaagcttagggggaaaaaaaaaaaaaaagctgtccacctgtccacagttgaccttcattcctctacatcaacccgtttcacataaatcacaattaacatctgcattaaacaccattaaaagaacacaaatgtggtttgaactcttggacatactttctctgcattcagagtcaggaagaccagccaagatacggggctggtccccgccccttaacgggatgcggcacagaggccttgcctgaggggcctgccagaccccttcgtcccggctacctactgagcaagcggggtggcggctcaccagtgccgcatgccaggcggagggtctcgctgcggctggctttctgctaggccaggcaagcccggttccgtgtagggctcctcaagatggtttcttagctgggaatttcccatgtgccccggagacctccaaaagcgcggtcccctcggaaggcagccagggaaggggcatcactgagactagaggcgaaggcggctgcgatcgcccggccgcgcccaccgcccccacaaacggaaaggcgcgccggggtcctctcggccacctacctgccagggtcgcaggagcccacgcttggcgcacgctagctccaggccggggcagcgggacggggaggccccgagggccaggccgcggaggcaggacccggcggagcctcggcccggagcctgcggactccggtaaagacagagacctcccccgccccaaaaagcaccccccgaccccgcacccagagccgggctaagcccccaccctccgcctcccgcctgaagcgggcagcctccccgcgcttccccgcgcctgctgccccggaactcaggaccagccggcgcacctggccacgcatcctccggcgggaggtgaccacacgggaacgcgaggcgggggcttcctcgcgccccgccggccggacgcagggttataagcgcagccggaaggaggcgcccgcgccgcggcggctcccggcttcggcactgcccgggcgggaggctcggcgcgcgtccgctcgcggggccacccgctccagaaccgcccgccggaaccagcccggtgcccgagaccccgagctcgggcgcgagcaggatgcggctccccggggacggttggcgcgggtcggagtcccgaagccccgttcttacctctgcctcatactgcggtgtccctcggcgccggcgtcgctgtggcgggccagtgccgccctgttccgcagcccgagcgtccggcgcggtaggtagcagccggagaagcggcgcagccgggggatgggcgggcacatggaagggcgggggttgtggccctcgggccggaccacgggaccccagcctcgggggcgagatatctcagtacacctcgaaaactggcaagcggcccccgtcctcagggactccattgctacttgcacgctcagtcttgccagaatctcacgggatatgtgcaaaaggcaaagaaataagctgtcgccacgcccttcgtcctctccgtccccctgcaggatccatatggtacattcctcaaagcccaacgggagacgggaaagaactgattggttgggaatcttggaaggggcgagaagccacatgaagtggccaatggagaaacccggtgggcatatcaaagcctgcccccggagagaagagaggatgtatttaaaggggacttgttggccgggcgcggtggctaacgcctgtaatcccaacactttggggagccgaggcatgcggatcacttgaggtcaagagttcaagaccagccgggccaacatgatgaaaccctgactctactgaaaatacaaaaattagccgggcgtggttgcacgggcctgtagtcccagctactctggaggctgaggcaggagaatcacttgaacccgggaggcggaagttgcagtgagccgagatggtgccactgcactacagcctgggcaacagagcgagactccatctaaagaaagaaaaaataataataaaggagacttgtttgttgctcttagttgccgcaaaatgaaactaggattttcattctagttgggaagcaaagaggttagggggaatttcaaatttttggaggagggcgctaagagaaaatatagagcagagggcgggcgcggtggcacacgcctgtaatcccagcactttgggagggaggccgaggcgagcagatcacaaggtcaggagctcgaggccggccttaccaacatggtgaaaccccgtctctactaaaaatacaaaaaatagccaggcatggtggcgcgcgtctgtaatctcagctacttaggaggctgaggcaggagaatcgcttgaacccaggaggcggaggttgaactgagcccagatcgtgccattgcactccagcctggacaacagagtgagcctctgtctaaaaaaaagaaaacgaaaatatagagcgaattgaaccaaatatatcttgtatgaccttgagcaggtaagtacaaccctcggcctcagtttcatcatctggtccaatgaggatactggaatgcacttggtgtctgatggccttcacacacttcatgtgtgatcctatcatcctttgcacaggaatagcaatacctgcaaatattcttcaactttgagcattatccactatcttaaagaactttaggctgggcgcggtggctcacgcctataatcccagcactttgggaggccaaggcaggcagatcacgaggtcaggagatccagaccatcctggataacacggtgaaaccccatctctactaaagatacaaaaacaaaattagctgggcgtggtggtgggcgcctgtagtcccagctactcaggaggctgaggcaggataatggtgtgaactcgggaggcggagctttcagtgagccaagattgcaccactgcactccagcctgggcaacagagcaagactccatctcaaaaaaaaaaaaaaaagaactttagttgaaagtcgatagactttctgacacctactttcagcgacagtatcaaccccacctttggtaaagatgaatcctgtcttctttctgggtccctcatctcttagagaagaatattcttcttatgtgtggggccctccacctccaagtagttcataatttctacttctccaggaagcacccctttctcttccttctcccttccttctcataatcagacaaaacttcgattaataattcattcacccaatgagctgtccacaattcctgccttcagcaacaaaccccactgctcacccctccctagagctgcgaaagtgctcgtccctaactcaatctgtgacaaccattcaaccacacatggccaattgtgctttcatccacactacaagccaaatttcagactttctaaccactccttggggtctgctctgttttagagctttacaccagcctgctaggcttacaatttggctaccaagcttcagctccatcttctttagttcagaacttttcaacctcccaacagctggtcaccccactgccactcaaccagcttccaatcacgcagggagtctgggataccctttctttatttttttttttttaagatggagtctcgctgtgttgcaagtctggagtgcggtggtgccatctcagctcactgcaacctccgcctcccgggttcaactgattctcctgcctcagcctcccaagtagctgggaccacagatacctgccaccacacctggctaatttttgtatttttagtagagacagggtttcgccatgttggccaggatggtctcgatctcctgaccctgtgatgtgcctgcctcggcctcccagagtgctgggattacaggcatgagccactgcgcctggcccctgggatagcctttctaatacctccagataactcatcttccaactataatccaaagagctctggaaagtgcatccctccatgaagccttccagattgattgccagaagctgctagcttacagagcttccatttctactctgtgccttgccataacccaactgtccatgctctctgccccaatatacatttcttttttttttttttctttttcttttgagactgagtttcgttcttgttgcccaggctggagtgcatgatctcggctcaccacaaactccgcctcctgggttcaagcgattctcctgcctcagcctcccgagtagctgggattacaggcatgcgccaacacgcccagctaattttgtatttttagtagggacggggtttctccatgttggtcaggctggtcttgaaatcccaacctcaggtgatccacccgcctcggcctcccaaagtgctgggattataggcatgagccgccgtgcccggccaatatacatttcttattgacatatttccctatctccctgatggccacagcagcagcagccacagcttacatttattaagtgctcactatgtgctaggtactgttgggaagtgctttgcccgcattatttaacttcaccctcatatcaattctgtgatgttccttattattcgccttagtaccgttttgccttcctgaggaaaacacaagagcttagtgaaactgatctgcccgagtgcacacagaggtctgacatctagtgcccccaccataactccacaacgcaatactgtcttgagtttcttaagaatctactgcatgccagatgaaagataatctcatatatttacttatttatttttatttttattttgtttttttttattttttttgaggcagagtcacactctgtcacccaggctggagtacagtggcgcaatctcggctcactgcaacctctgcctcctgatttcaagcgattctcatgcctcagcctcccaagtagctgagattacaggctcgtgccaccacgcttggctaatttttatatttttagtagagatgggggtttcgctatcttggccaggctggtctcgaactcctgacctcaggtgatccacctgcctcgacttcctaaagtgctggggttacaggcgtgagccactacgccaggcctcatacatttatattatgtttacatttatttctatacctataatatcatttcagtctcaaaacagtcatgtgaggagagttggtagaagtctattcacagatgaggaaggaaactacagctcagagagcatgaccgtttggctaaggtagcaaggctggtaagtaactgagcctggctttccacactgcattctttccattgcaattcctgccccctgcgtgaacacaacctttttacatgtaacaaccagagaaggaggaaacaaatacaaaatagcaaaacctaagccacagggtttagggagtgtggtacaaggagtgcttacagggggccagaaaacaagtcaaagaagacttctatgaagggtgagatcactgtggacttctttatactggtttgttgtttatattctgcccatgagagtgtgtcttggacacatctggcagattcaatagcaaaaggccacaaaactgccccgtaccgctggagtgctggtggctagaattagccccatgtcaatgaagaagggacttctgtgtgcaatgctgctgccgaccagtttgggaaagttctcaactggctgtttagcaaactatcctgctccaccggcagttttaacactcccctgcaaatacaggctgggctcattatttcttctttttcaactgttgacatcctcacagggttggagagcctagcaaaattgtgtgggagcagcaaacttttaatattgattaagcagcctgaacaaggtgattgtgaggccaatacttctgagttgttctttgccaggtccagccatagtcaatcaagttaattctcactcccatagctctctcttttctcatccccagagagctctaaaatgtctctgcttatctgagtgctttctttatgcattcaaacatttattgggcacccactacaagcaaagaactggcagcttgtgtggggttatcctgatggatccgcacatgaagtgtgtacttagtgcatggggtgattaaatatcagacccccttccgtaaggaaggaatctgcctgagaacctcagagagtgcaagtggatcccatctacggcgaaatgtaggtgctcacgttgggaagtctgcccccctagtaggagaaggagcactaggttgagaaatggccctgggttggggagatgggcagtgtcctgcggaggtggagagtgcccagaaataactggacacttagtaaacaatagggagaatcatctaattcaatccgcaatggagccggtagaagatttgtggaatatgctatcttattttcaatttaaaaaatattttctgggctggtgacggtggctcatgcctctaatctcagcagtttgggaggtcgagaagggcagatcacctgaggtcaggagtttgagaccagcctgaccaacatggagaaaccccgtctctactaaaaatacaaaattagccaggcgtggtggtgtatgcctataatcccagctactggggaggctgaggcaggagaatcgcttgaacctgggaggtggaggttgtgatgagccgtgattgtgccattgcactccagcgtgggcaacaagagcgaaactctgtcacacacacacacacaaaaaaattctgatttctttttttgttttgagacggagtccctctcagccacccggactggagtgcagtggtgcaatctctgctcacagcaaccatcatcttctgggttcaagcgattctctcgtctcagccaactgagtagctgagattacaggcacccgccatcatgcccggctaatttttgtattttagtaaagacagggtttcaccatgttggccaggctggtcttgaactcctgacctcaggtgaactgccctcctcagcctcccaaagtgctaggattacaggcgtgagccaccgcgcccggccaattttctgatttcaaaagtaatacatgttcattgtaaaagaattttttaaataaagtacaaaaaataaaaatacccattacgttcaccagcatatcattgttaccattttgatgtatgtgttttcttgtatttttctgtgtacatgtgtcatatatcttctttttctgtattatctttttaacaaaatttgatcaaactgctttgcaatctacttttctacttaataggctaggaattttcctatgctattctacattacttaaaacatgatggttttttttttcttttttagagtcagggtcttgttctattttccaggctggagtgcagtggcacagtcatagttcactgcagccttgcactcctgggctcaagtgatcctcccacatcagcctcccaaagtgctaggattccaggcctgagccactatgctcagttttgtttttgtttttgacttaaaccagttttgatcagctatctaccactggctagcaaagtaaaaaatgcatgatggggccgggtgctgtggctcacgcctgtaatcccagcactttgggaggccgaggcgggtggatcatgaggtcaggtgatcgggaccatcctggctaacaaaaaattagccgggcatggtggcgggtgcctgtagtcacagctactcgggaggctgaggcaggagaatggcgtgaacccggggggtggagcttgcagtgagccgagatcgcaccactgcactccagcctggacgacagagcgagactccatctcaaaaaaaaaaaaaaaaaaaaaaaaaaatgcatgatgggctgggtacggtggttcccgcctgtaatctcagcacttcgggaggctgaagcaggtggatcacttgaggtcaggagttcgagaccagcctggccaacatggtgaaatactaaaatactaaaaatacaaaattagcctggcatggtggcagcctgcctgtgatcccagctactcaggaggctgaggcaggagaatcgcttgaacccaggaggtggagattgcagtagcagagatcgtgccattgcactccagcctgggtaaaaagagcgaaactccacctcagaaaaaaaaagcatggtgcaataggagctcagtccatcccttccaagcattccaaatagcacacccgtgactgccaccagttcagtttatcatgaaccccaagggcattcagctttaagcaatctccagggaaatcccaagccatgtgtagtctaatggcccccaggatgcctggactggctcaaaagcccatcccatcctatccattggatgagagagtcaagaaggaagaacagagtggtttagaacaaattgattcctgggctgcattcatagtcctgtggacctactgaagacatgaaaggctccatgttcttgcccctcttctacacgaagggactggtttggaaccaacttaatcttctgtagaaaagctaagaagatccatggattgggatgtcttagagctcgaagacatcattctaggttctggggtttatttctaggctaatatctcatagtgaggtttaagaaaattacatatcttttactttttaactaattccagactgatttgcatgttttcaccctgccaggaagaaggaaattaagattgggtgtggtggctccacccgtagtcccggcactttgggaggccaaggtgggaggatcacttgagctgaggagtttgaggctgagcaccactacactccagcctgggcgacacagcgagaggctgtctcttcaaaaaagggaaattaaaacgcaacttgacaaagttgcaaatctacttctgcattagtttctcacaatataatggttcaaaattgggtgatttttcccctaactgattggcatgtgtatgttcagcagtagccagaaattctatgcagtggaaacagacaaaaccaagatgggactatgcagaagaaatctctagttaccaaggcactgcaaaataaagtctacaattgcacatcacaatcatcaccaaaacagagatttctagagtccttctgtaactcgcagaagactccttccctaagccaatttggcctggattcttgaaagtctctgggaaacacggcaaattttataaacagggtttttctggacttatattctcatattcactacatctaagaaaaatttataaaatatatattatatataaagatatattaaaatacacacacacacacattctgtaggacttgattctttgaacacagaccttagagctctgtgctctgcactagacaggagtaaatgctatacctctgcagaactaaaacaagtaaacttgcccttgtcattggttccttttgcagtgaggaggggaagtctttctagtcctaccttcctccactgctcagacatgttgctattaaagataaaagcagtaggctaggcatagtggctcacgcctgtaatcccagaattttgggaggccgaggcaggaggatcagctaaagccaggagtttcagaccagcctgggcaacaaagcaagagcctgtttctataaaaaacacaaaacttagctgggcctggtggtgcatgcctgtagtcccagatactcaggaggctgaggcaggaggattgcctgagcccaggaggtggaggctgctgcgagctatgatgaggccaactgcactcttgtctgggtaacagagtgggaccctgtctttaaaaaaactaataataaaaaaaaaaaacactggcttcaaaattacatgtggtcaaattcagcccaattgggttctatctgaatatgacttattttacacagctctgttttcaactgtgaaacagaaaatgacagagggaaaggactgagggaagggaagggaggggagggagggaagcagggagaaagcatatgatacttcccatttaggaagtggaatagcggtagaagaggccctgataaagcctcagaatggaactaatgaacttgaaaccgccagcatgcacatcggcattttcagatttcagagaagatgcacctgaggggaggagcctcttgtagggaagggaaagatgtcaagccttcctttgtcctgtgcacaggacagactccaaatccttctcttcgctcccatttgagatcatgtgaacttctgtttgatttaagcatctgagtctttttctttcattcatcccttggtgtctgtgatgggcaaggcacttgtctggttgctgagagctgtgcagaggacaattagacatggtgtctgaccttaaggagctaacaatagtgcagggaaagtgagacttggatagagagagtctttgtcaggtggaaagtgctgtctcagactgagaagccttccatctaagagagcagggaacgttctatagaggagggggtatttgagaggtccctcaaaagaatggtaggatttcatggggagatgaaaaaggtattctaagaagtgagcttccccttttcttttcttagctcccactggcagaaaaggagcagagttccttccaccttgagccagagattttcaggcaaagcacctcactgccgggaggtggagacctggagggttagaaagaaggagaattgagaaggataaatactaacatgttcatagccaggtgaatagagggatgggtggggagttgggtgtttcaaaattatattcattttgcttatttgtactttttcatttgggaagagaatggggtatgcctttccccatacttttgtaatggggaaaaaataaacacaattgtaaaatagcagcccttccctggcaacaaaaagaaaaaacaaacaggaagaaaagaaaagcgattgagaagaacctgcatatctctttgagactgaatgtctcctctgtgctctggcagcctcagcgatcacaggcctgcagtgctgcttttggccctgcttggaaacccccatgtgagcaccagcaattgcagctcggcctccagggactgtatcacaccacaatcattgattttcataatcaatgccatcattgacaagtaggcagagagataaatgctctaaaatcatctaggccccttgggccagatgttcccagccttatcaagaagagaagctggctgggcgcagtggctcatgcctgtaatcccagcactttgggaggcctaggaaggcggatcacctgaggtcggagttcgagaccagcctgatcaacgtggtgaaaccccatctctactaaaaaatacaaaactagccaggcatggtggcacacgcctgtaatcccagctactcgggaggctgaggcaggagaatggcttgaacctcccaggaggcggaggttgcggtgagccgagatcacttgcagtgagccgagatcacgccattgcactccagcctgggcaacaagagtgagactccgtctaaaaatatatatataaataaaggccaggcgcggtggctcacacctgtaatcccagcactttgggaggccaaggcaggcagatcacgaggtcaggagatcgagaccatcctggctaacacggtaaaaatattactatattatagtaaatatactaattaaatatacaaaaaaaaaattagctgggtgtggtggtgggtgcctctagtcccagctacttgggaggctgaggcaggagaatggcgtgaacctgggaggtggagcttgcagtgagccgagatcgcaccactgcactccagcctgggcgacggagcgagactctgtctcaaaaaataataataataataaaataaataaataataaaaaattttttaaaaaagaacttagagcagggtctggtggctcacacctgtaatcctagcactttgaaaggccaaggtgggcagatcacctgaggtcaggagttcaagaccagcctgggcaacagggtgaaaccccgtctctactaaaaatagaaaaattagccaggtatggtggcgggagcctataatcccagcttctcaggaggctgaggcagaagaatcacttgaacttgggagacgaagtttgcagtgagcagagattgtgccactgcactcaatcctgggcgacaaagcaaggctctgactcaaaaaaaattaataaataagaagagaagttactttttgtttcctgaaaagcttcacttcctgacaatgaaggccctgaggagcgagtggacagctggcagctggcagtcatcagtggggaaaggcagaggtaccactgttgactctactgggcctcaggcctcggccctcatggggagggaccctctttcaaacttttggaggggtaagggagggccagacagtgctgagaccaaggcgatagtggtgggcggggggcctgaagttccatcatctaattgggcttcttcacgggtgcattgcccataagtgccatattgattccctcagctcccagggctgccagatagggccggggcggccagagcctcccagccagtctcctcctgcaggagcaccttgtcagtttacctcagatatttgctgctcaaataccatcttctgtgtgtatcacaacatgacacgcctacgaagaatgctgagctaggatttctagatgtactgttacatggtgatttactggtctggaattgctgccttgcaggaggtcaggtgaaaacactaccagcaaaaccaagcatttatggagccactcccttgtaccaggtcctgggctgggatgtctgactgcatcagctccacggtggtaactgtggctttagcctgcccagcattcagacccccttgcttggtaacagtgcctacatcttagcttctattgtggaaactacctttcccccactgcatgcaggtctggtgggcatggggatggaggcaccttgctctccatccatgaggaaggcagcacatggtccagcctcatctagtctgacctctcttcctggaagttgagtgtcaagcagggagccgcagaactgaaaacaaccggagctgcttcatgcagtcaagaatcccctgaagaaagaaggcagttacctccctattcttgagatctcttcagctggcctggctctcatcctttccaagacctggctgtttgctttgcattcagttatatgagctaattcatatccttctaataaatgtcttccatccttctccaaagttagccctagagcatattgctgttgtttacaatcagaaagccctagaggtgtactctctaattctcttaataacctcatttttctgtcattactcctgttttagtacaggtagctgagcttcagagaagttaaaagatgtgcccaaggtggcacagctaatgagtgtcacagtcagaatctgaacccaagtctgtctgatgtggggtcatgacaagagcatgggttttcttgggagagaaaaatgacttcaaatccccacttcccacataaaaatgcacaatgggtgtagcaatgccgaagccacagagctgttgagggtggatggaggtgacgcataggaaagcacatggcctagggtatgtgcttagtaaacagaaatgcctgtccctaagaatgaaaattattttatctgcatagtaaattaaagcaattggcacttttagtccaaagattactgcttctgagttgatccaaatacaatctctctatctccctccccctctatttttttaaaaagagaaacaaggtcttgctatgttgcccaggctggcatgcagtggtacaataacagctcactgtacccttgaactcctgggctcaagcaatcttctcacctcagcctccccagtagctggaactataggtgtgtgccaccacacctaatttttaaagtttttgtagaaacggggtcttaccatgttgcccaggctggtatcaaactcctggcctcaaggagtccacccacctcagcctcccaaagttctgggattatagtcatgagccatcatgcccgacctctctctctccctctcttagacacacacacacacacacacacacacatttcttggtttcctgtctgtggaagtcctaccagaaaattcagatgcccttaggaaaaagagcacagggtgcgcataatacaatcgaattctcccatccaacatgccttgggagaaggaatagagtaagaattttcattcctgtgaaggatgatgaaaatgaggcactaagacactaaatatttatctcgaggttatgtagcaaaccaaaggttcaggagaacccaggaactgtatattaggccattcgatctgaaaataccagagcctggaaggaagagaacagcttttccaagttgttggatttgttccttctcttaccttcttccccttccctgtttcccacttcaaaagaaaaagctccatcacttaaacatctacattaggcacatttctaaaaaagcttccccagagctctgttcattacatacccttctttcccctaggagttgtgacctacttaaaatattcttacaattctcttaatgggggaaaaagtccccaaagatatgttccctatgctggaaaaattaaagtcctaaaaataagcagttaaagagaaagtgttaggccaggtgcagtggctcatgcctgtaatcccagcaatttgggaggctgaggcaggtggagcacgaggtcaggagatcgagaccatcctagctaacacggtgaaaccccatctctactaaaaatacaaaaaattagccaggcgtggtggcgggtgcctgtagccccagctactcgggaggctgaggcaggagaatggcatgaacccagaagcttgcagtgagccgacattgcgctactgcactccagcctgggcgacagagtgagactccatctcaaaaaaaaaaaagagaaagtgttgcttgtactaagatttctgatgctttttcagagataaattcaagttttcccaggcctgtgattgtgaaaagtacaactaaaagatggccttggcatttattcagcagtcagtagatattcacaaactacctgccgtaagcaaggacttcaccaaagttaaatgacagcaagaggaaagaaaacccacacagcttggatttattcaacataattgtgactcttgggattcttctggtttctggggctaataaaaaacattctactttgtaatatatcataatttctgagatttctcttttcttctacattcatttcttccaatctcgaaggttttatttgagggtgctttgttattgaaaaggcagtataataacagcaagagaattttacaaatttaagatttaagactcatcttttttttttttttttttttgagatggagtctcactctggagtgcagtggtgtgatcttggctcactgcaacctctgccttgtgggttcaagtgattctcctgcctctgcctcccaagtagctgggattacaggtgactgccagcacactcggctaatttttgtatttttagtagagacggggtttcaccatgctagccagctgatctcgaactcctgacctcaggtgatctgcctgtcatggcctccgaccacgcgcgaccctaagactcatctctaatccatcacttcagcacagctatggcacaggcacacagattattacagttatgaacatgatgtgcttgctatgttctattcgctattgttccttttatcaaaagtattttccatgtttctttctacatgcctcttgatttaggctttggttgtgaatgcaagatattccattgtataatgtaccaacaaaattttaaactgtccctataatattagacatttcagtgatttctacttatttctattataaccaacacaacagagggtattttttatgcatctgaaatttaaaaaacctttgttaactaactttattgggataaattcctgggtctggtaattatatggcttttcctatatagtggtagtaattttatggcttttcccatatattatcatgttgcattccccacaaatgttatcaatttataatgcaacccacaataaatatggaattttactgtaacctcaatagcattatgttgcggttttgaaaaattattaaccattagcaagaagcataacagtataatggtgttgtaatttgcacttttgattgctatcaacagtgaacacatatcaatgttttgttcattgcattgcctcatgtagatgaatttctttttatgaactgtgaatttatccctggagagttgttttttgtcctccagtcaggtttattcaggtataattcacatatcaaaaagttattctttttcgtgtgcagttctatgacttttaacaactatagacaggtcactgaatggttctatgatcctgaaaagtctccctctgtgcctttgtagtcacattctccctccaaacagcccttggcaatcactcttctattttctttccctgtagtttcaacttttccagagtgttatataattggaatcatatagtagacagttatgcacagaattgtaatgttttaaaactctttaaaatgtttctaggccgggtgcggtggctcacgcctgtaatcccagcactttgagaggccgaggcaggcggatcacgaggtcaggagatcaagaccatcctggctaacacagtgaaaccccgtctctactaaaaatacaaaaacttagccgggggtggtggtgggcgcctgtagacccagctactcgggaggctgaggcaggagaatggcgtgaacccgggaggcggagctcgcagtgaaccaagattgcttcactgcactccggcctgggtgacagagccagactctgtctcaaaaaaaaaaaaaagtttcttttctttctgcagtattcaaaatgctttattaaaggtttggttcaacatcaaaagagcagtatgtagtggggggaacagaaattgtaactaatttaccactaactttcttgcaccaccacactcaggaaaaaagccgtatagaacctggccttccaaaggcccaagtcagtccttgagtctctgcctctcccttgtccacaatcccatgcccattctccttttttgaaatgaattattggtttaacagaggttaactttttttttttttttgagacggagtctcgctcttcttgcctaggctggcgtgcaatggcgcaatctcggctcactgcaacctctacttcccaggttcaagtgattctcctgcctcagcctcctgagtagctgggattacaggtgcctgataccatgcctggctaattttttttatttttttagtggagatgcggtttcacaatgttggccaggctggtcttgaactcatgaccttgtgatccacccacctccgcctcccaaagtgctgggattacaggcatgagccaccgtgcctggcctaacagaggttaacttttaatttgtaatatataatgcaaatatttcccccactctgttcctttttcatttgatagaatttttttttcttgagacagagtgtcactctgtcacctgggctggagtacagtggtgtgatctcagctcactgcaacctctgcctcccgggttcaagtgattctcctgcctctgcctcccgagtagctgggattacaggtacccgccaccacacccggctaattttttttttttttttgagatggagtcttgctctgtcacccaggctggagtgcagtggctcgatctccgctcactgcaagctccgcctcccaggttcacgccattctcctgcctcggcctcccgagtagctggtactacaggtgcccgccaccacgcccggctcattttttgtatttttagtagagatgaggtttcaccatgttagccaggatggtctcgatctcctgacctcgtgatccacctgcctcggcctcccacagtgctgggattacaggcatgccaccgcgcccggccgtatttttaatagagaaggggtttcaccatgttggccaggctggtcttgaactcctgacctcgtgatccgcctgcctcggcctcccaaattgctgggattacaagcgtgagccactgcgcccagccgatagaaattttaaatttaaatgaacacagttttcccccatggattcttttaacttgaaaattatccatagatctaaaatatattgaattctatttttttgctagctcttgaagaatttgaccttttaatatttcattttgattcaactccaatttctgtcggtatttgctcaaggtaacgactttaaaagtttcttgaccatgattcataataagaaatatattttgcatcacgattcagtgtacacaacaaaaatatacatatacaggctggacatggtggctcacacctgtaatcccagcactttgggaggccaaggcaggtggatcacccgaggtcaggagtttgagaccagcctggccaacatggtaaccccatgtctactaaaaatacaaaaattagcagggtatggtggtgggcacctgtggtcccagctacttgggaggctgaggcaggagaatcacttgaacctgggaggcggaggttgtagtgagtcaagattgtaccactgcactccagcctgggtgacaaagactctgtctcaagaaaaaaataaaaataaaaaatatctatctatctatctatctatctatctacacacacacacacatacacacatacacacacacacacagtatacaaaactgaaacacaaatctcaggacacaaatcttcccttcactacacgtatacactctggtattttctattctttctttttaaaatggcccacctggccaggcacagtggctcacgcctataataccagtactttgggaggccgaggagggtggatcacttgagcccaggagttggaggccagcctggagaacatggcgaaaccctgtctgtacaaaaaaatacaaaaattagctaggcatggtgatgcatgcctgtagttccagctactcaggaggatgaggtgggagcatcgcttgagttgggagttcaaggctgcagtgagctgagatcacaacactactgcactccagcttgggtgacagagggagaccctgtctcaaaaaaaaaaggacccacccaagatcaatattccattattccccagacaaactccatagacattaatggttgtattattgtgtattctgccacatcaatgaaaagttctgaagtgattacagttatccatggcaaatcattggatatggtggggaaagtggaaatatctattatgtcggttggaaataagaaagacctgcatatgaaaagggtgatcagatcgagcgcagtgtctcacgccggtaatcccggcactttgggaggccaaggcaggcagatcacctgaggtcaggaggtcgagaccagcctggccaacgtggcgaaaccctgtctctactaaaaatacaaaaattagctgggcatggtggcacacgcctgtaatcccagctactcaggaggttgaggcaggagaattgcctgagcctgggaggcggaggttgcagtgagctgagatcgcgccattgcactccagcctggatgacagagcaagactctgtctcaaaaattaaaaaaaaagaaaaagaaaaaaagggtgatcagggaagctttggcagaatcttggaatgcggcttttttggaattttctactagagaaaatgagaatgctgctgatttttttttttttttttttttttttgagatggagtcttgctgtcgcccaggctggagtgcagtggcgcgatctcggctcactgcaggctccgccccccggggttcacgccattctcctgcctcagcctcccgagtaggtgggactacaggtgcccgccacctcgcccagctaatttttttgtatttttagtaaagacggggtttcactgtgtcagccaggatggtctcgatctcctgacctcgtgatctgcccgtctaggcctcccaaagtgctgggattacaggtgtgagccaccgcgcccggccagctgctgatgtttttaagaggacaattttagaggcagataaaattgacagggcagcttcccaatgaaaatcttcgtgctcagtgatatgattctactgcaaaacctgaggacactgggaatatcttccacctgaagaaacaaactcccatcatcctttaagataaactacacttctttttccttctcttaacctgaaagatatattttgggtcagagatcctctcccttcagattatgttaaattctgactgtccaaacgagtgcacttccattttcaaattttaagcaatcatattttcaatttatatatggtatttcttaatattatgaccaagagttttatcggcattaatttttcagtgtagtttgttgtttaaaataatgtaatcatcaaaatatattgttacactactattaaccaggcttcaatatatcagtgtttatttcatggtgctaaatgtatactttcaaataaaatggctgtaaacctttaaaaagtaaaaaaaaaaaaaaaaaaataggctgggtgcagtggctcacacctgtaatcccagcactttgggaggctgaggcaggcagatcacttgaggcaggagttcgacaccagcctggccaacatggtaaccccatctctattaaaaatacaaaaattagccgggtatggtggtgggcacctgtggtcccagctacttgggaggctgaggcacaagaatcacttgaacctgggaagcggaggctgcagtgagccaagatctcatcactgaactccagcctgggtgacagggtgagaccctgtctcaaataaataaataaataaataaataaataaataaataaataaataaataaataaaatggcccaccaagttgatttcatgactcactgatgagtcacaatccacagtttaaaaaagtgtgaaaagggaatttattaaagccacacaatgtctccactagtcccactctgagtttaggtagcaccctaaagatgaactgatatacatgggttaagctggatcaactggacattttcccccagtggcctgtgccataaattgcccttttcagagaatagatattggtggtcgtggcagggaggggtaatagaaatgagatatggttttggtattcctggattagccatctactgggctggcagccctcacatggctggcctgccctgtctcgtgagatggatcagccttgaggtgacctgtcaggaaaggacatttgggctggaagtagcagaagcctctgtgagccatccttcatgcagaactagtcaggagcagctcccgctcagccaagagagtgaagcatgcccatcgcccagctcagccaggtaagtactagggaaacctgtgggaggcccaggtgaaatgaaggcattgtctcaagaggtcaggctgactccaggaaggaacaaaatgatgcatgcatggctatgcacagactagaaaagcaaagactaaagggaaggatggaagttgttctaactgttttgggttgcttggagggagtggggcatgggagagggagggagtgtgtagtcagtgcgtgggaatgcagaaaggagcatgcagagacaagcaatctggtaggccatgtgggagactgtggccattctatggtagggagacccttcctggccactccctcagtggccctggcacattaagctttgttgtccacattgggtgggttgtgtatgctttaaacaacatcttaatccccttgcctatttatgaggtgtatgactgagccgtgcccaagagtttcagaagatatggtaccatcatttatacctatctcgcaggagatcttaaccccttctctacttaacccaaatgaaagcgaggtcattaggaagctgtgcctggtgaagttctggcaccaggtgggtagatcacattttctagtttatgtaaaattttaacatttcagacccccagttttaagaccttatctaatttccttgagccccttagtcattgtgaactcgctgtggagtgtctgcctccacctgccttggtgtttatgaacattcatggtaactttagaaggcaagggttagaggaaactttttgccgcccacccccagtctgcaacagtacctgtggggaagattttaccctgggactccaattttcagggagaggaagtttctaggatttcccataggcttacgagggactcgccatgtggaaggattttaggcctgagaaggataataacactttataatttctaggtgatcttatttgttgcctcttccttctccagagtgactactgcattccgacctgcacccccacccttttttttttcttttgagacagagtcttactctgtcacccaggctggagtgcagtggtgtgatcttggctcactgcaacctccacctccctggctcaagctattctcatgcctcagcctcccgagtagctgggactacaggcatgcaccaccacacctggttaatttttgtatttttagtagagactgagtttcactatgttggccaggctggtctccaactcctggccccaagtgatctgcctacctcgggctcccaaagtgctgggattacaggcctgagcctctgcgcccagccccctcttctgctttctaagtgtccattctccttgtagtgagtgggtggtggggggatatacacatgtgactctggttagtacataggcagccatgaagtccacaaatgtacagggagccacagctttcatgctacagacttgcaaaggtatgcatctgctttccccttgccctggaatatagatcagaacacttcatttagtgaagggacctgttccgagagtgatgatccctccctcgtttgagacactgccttcatcctgagcttcttggagcagcccaaggccctgccagctctctttgcctgtagcttgtaggcatttatgacagttgcataccctgccctccaacggcagcctgagagactgaactattaccaagttcacctggaaaaatgtcaccctgattgattagaatggtgggtggccatcttagctcattagaatcacctgggaagttaaaaaaaaaaaatccagtatgcactccaaattttcccaccaccactcctccccacaaaaagaaaatttaaaaaatcccagtgtttgggccatatcccagaccaattaagtcagaatctccagggattggacccaggtagcaggatttctaaaaatctccccagcagccaggcctgagagctaatgaatagcaccacagggcccagcctttcagcctacagcttgtctcggtttcacccttttttcatttctttacaatgaaaattctaaatagttgatcacagtgccagaccaataagaaagcattttagggaggagagaggagggaaggggttggcaggcacggagaggacttgacacacagaaagcattttgctatggagtcataaccatttgattctaagacacatgcagcctccagaagtcatgcggccccgccctctgcttccaggagggaatgaacttggccgtccttttgttgcacacgcccgggagctgcgccggcgcagcgcgccctgcagcctgggagcgcaagcgtgtgcgccactggtcctgggccaccaccgcgcgccgcgggcgggtgcagggcccctctgccgcagggaaaccggcgttccccgcgcaaagcagccgctgctcctaatgagctcatgggttcaccgcgctgagctagccagagcggacccggcttcgccaagggcctgctggctgtcctgacacctggcctacctcgggggtgcctgggtacgctcttcctttgcctgcgggatagaagcacaatgaaaatggggtggacgtggctgggagacagccctgctctctggcaggctctggggagtgtgtggtacgtggcatccgcactggtgggtgtcgtgcgatgatcgagacacggatactgggtgtctttcccactaggggagagagggctgcgtttagagggaaacgaaatagatccgagaaacacaaagatgtcacaaaggaaacgcttccccaccataagcaatctaaataaatgattcttagaagacatccagcaaaacacataaccttgtcatttagattcgctcgcccacagggggactggagggtactcaccgactagggcttcacagccgcatcaccgccggcggtgggcgcctgcctcggcaggggcagggtgggtgcccgcagggcacaggtgccgccgtggctgctcgcacaacccctgcagctgcgatcccgcccagttagcctcgggggctgcacagcccagccccctcgcccagggcccaggggttctcaggccgcgcggcgaggacggagggctgccccgggtgcctgcctacgcgggcgctccccgccgggactccgccggggctgcaggagcgcgcgctg

SEQ ID NO: 1383 - DNA, 18157 bp, Homo sapiens
cttccattttgacttttttatttatttatttatttattttaacagatagggtctcactctgtcacccaggctacagtacagtggtgcaatcatagcacactgcagcctcaagctcctgggctcaagtgatcctcccaccttggcctcccaaagtgttgagattacaggaatgaaccaccatgctcggcctcattttgaacattttaattagaaagttacaaaacatcatgggttctttatacaagatttgcattagaataatttaataaaatgcaaaccaatgtttatacgtatcttgtcatctttccatatctcattgccttatgtgaatttaaacaagaaactatttttcgtttagatcttaagaaaaaaatttaggcatataaaacagcctgaatattaaaaaaagacaagggggtcagtgttagggaattcctctgcttgaatacttcaaaatagctttgtttccaaaactgttttagtaagcctaaaggagcactaaaaacgacaactgatctccaaagtaaactgaggcacacactgaggggtgtgtttctgggtgggcatgaagcatggatcaccggggccatgtccttccagtggcaatgacctgcttgggatcaggaagcagctccatgtgttcttggaggagactgcccacatcctcaggaggtgaatgggctgaacaagccatcttccgtgtgcagaggccccttccagccatctctgctcctgcagacacttgcttagccacgagggtaatccactggactgcttggtattctgctagtggccaggctggactggcctgcccaggccagcatcctctttacactcttactgcttcttgtgtccttcccaaagctgcccgccccactctgatgggcaccctgttccttagtcaagggaaacgccagccgctgggcttcccgctagccttccaaataaacttgtggttgtcaggcagcgggagccaatcccaacaccaacccctgtcgcccctgtcctttgcaggaagggggagggctgtcaaggaggaggagggccaagtgcccaggctgttgggtgagggccagaaagaacctgttgtgacaatgctttcttcccccagtgctgctgagggggctgagaatgaaacagcccctctgacttcagcctgccatccaggggcacagacagagggaaaaatagggcaaagagcccagtcacagtacggcaaagatccagggctgctcagctgagctgatgacagatgactgactgttgggctggggcaggtggacggtccaagtgtccttcagcggccctccctgattgcctgtgctaatgcggcccttgcccttgggccctgcccctccaggtctccagttaaaggcctcagctctggaaatcaaagctgtgaatgggaaatggagaagcccaggggtgcaaagtgctagtgattggcatgtttgtcacaagagagccctgaaaagagtaagagtggctcacaacagaaggtagaaatgcacagtgtgttcctcagttcaacagaggaaaagtctctgcttgaccagagatgggactctttccaagatgtctgaactgactgcaattttctcctgaaattcaacgctaaggcaaagaaggaaaacccaaaaagctaattatagcctccaggaactctcagacctttccacaaactagtccctgacaattctgcaggagctctgaagatacggaactgtgtagagcaaaaccggaaagaaccgttgtctctgagggaaaagcacacaagcccgcaggtgtccgctgggctctttcaaaaggtcctaagatgttcccagaagatgacaatgaggcagccacggtcctgctgagtcttcagaaatggcctttctaggataagtgctccttacacaagtctccccggggcgtcactgtcacaggaatggtggtcaccacctgattctgaaacacgaagatcttgattctttcaaacacccagaggaagataagcaggatgctgacatactgcacccaggcgaactttaccatctcccagaatcctggctgataagtatggacagttaaggagtgaagggccacatggtgttaagtatgaagagaaaatccaagatggaattggctgtggcagaggtatctcgaaaggaggcaggacctctgtcatgtacacacccagatggaagctgacctgaacttggccaaatggtaaaaccagccacatttgatttgagctatttatataccaagcctgatgaccaacctcctaaacagacaactatgccaaactagattgatcatggactagagatatcctgagctgttaaccagccatccatccatcttctaaaatcttccagttgtgtaaacttggaacacccttagcccctgcctaattgcacctgtacggaacacaatttagctgcttcctaggtttgtgtctctggaattgtaattcctaagaccccagttaaaatgccttctcttttgtttgcttctctgcagtgttggtgttggtttcattttccattagtcgacctaagtcaaaattaaaccaaagtttaggtcagacagggactggcaagaatgtttcacataaccttagcataaaagggatatcatatgattattaagacataaatatggatgattcttacctagaagaattgcttggaaacaaataggaccaagacatgaattatttgttcctatatgaatagcagacatacagtcattttctgagacatgtagcctaagatgtcaaagacgcagccatttttatgaggctataaccctgtcatgatttccaagagaaaacctcccacgtctgttactacttgagacaactaaggaatcattcctctttgaaaactgagctaccattgattttttttaaattgttgtttgctttaagaggcagggtctcactctgtcaccgaggctggagtacagtggcacaatcatcgctcactgcaagcttgaattcctggactcaagcaatcctcctgcctcggcatcccaagtaactgggactacacatgtacgccactatgcctggctaatttttttttttttttttttggtagagacagggactcactatcttggccaggctggttgtgaactcctgggttcaaatgatcctcccaccttggcctcccaaagtgctgaaattataggcaggagccaccacatccagccttaacatggactctttaacagaaaggatatgaaatgacttccacagggtatcggatgatagcattaatcacaaatggagcatctgcggccctgcccaccagccagatggggttgggatcattcaggacggtggtaactgcaatgcaatcattaaccattaaccacgatggctgtttgactctggcagttgaaggctataaagattatttgatacctggaaattatcctgtgcttcagaactgaaagaaatcattcggaaggaaagagaaattgcatgtgcaaagctgatcacacattatttgttaaaataatagtcaaaatacttttgttaaaatacataaaaaacttggaaagagtttcttctacatgtgctgaatggctaactgaaggaatactatactgccactaaaagtagtatcacagctttgtagctgtgtggggaagtatttatattccaagtttaaataaataaaagtaacttggatcccaatgtgtttctacactacaatggctgtataaaaagatctgcagaaggctaaagaatgaaaggaatgaaaaaatagttgatttgtagggcaatgttttctacttttgttttaaaattccctctattattgcaataatgccactagtatatgccataaaatcagtaagcaatactggatttgcagtcatcccccttgtgagacgtctgtgtatagtctccatgatgtctgcttgccaagtaacactgtagatgcttttagagaaaacctcagccaccgaccagacaaacgtgccgagtccacacatgccatggcctagagctctgtaaggaataagcacactgtgccttctggcaggaaacaggggcactcctgttctcctgctggactgctaatgtggggagagtcacccacgttctctgtttttctctgaaaagcatgaacagcaatttgtctttggcatctgttataggtgtggataggtgtggtatggggaacaactcaattaggcttatattttttaaaagagaaacccactaagccagtggtgggataatgatggcatttaaccatcactagcctgctggaccatgggatgctggaggggtgggggcggtcccaggtctgaagatcaggacgaaaaagacaaatcctggacagcatatttgctcccatcgttgagcattcacgggttttgacattttcatcacaagggttccagttctgcttgtctctgttgcccccactaaccttgaaagtcctgagcagcggctgaatgggctctacctgtgactcaccgttcctctcctggtaggcagcaacaatatgggtgaggtcgtagtcataggcaaaggggctggtcccgttgatcacggatatctgggacacgggaggaggatgtggtgtgagcacctgggagactcctccccttttccttctacccttctgcccacccaggctggtcccacagagcaccctcttgttcttggtggcctactgcagtatcaataatcttttcttcaaagatgaataaaacaggctgctgcccacccaggctggtcccacagagcaccctcttgttcttggtggcctactgcagtatcaataatcttctcttcaaagatgaataaactctcttgcaacaatttaagcccatttactctcagtctttctttctgtggatggaaataaggggtcagtgtccatgttttacaggttttaaagctatttttaaaatacccctctttatctcagcgggagaaagaattccttaaattattttaacagaccgtattttcgccaggtgtggtggctcatgcctacaatcccagtgacttgggaggctgaggcaggaggaccacttgaggccatgagttcaaggccgtagtcaatgatgatcatgccactcactacactccagtttaggaaacagagaaagacttcatctctcaaaaaaaaataaaaataaaaaaaaataaaaagccaggcatggaagctcacgcctctaatcccaacactttgggaagcccaggcagatggatcacttgagaccaggagttcgagaccagtctggccaacatggtgaaaccccatctctactacaaagaaaacaaaaattagccaggcgtggtggcatatggctgtaatcccagctattcaggaggctgaaatcagaggatctcttaagcctgggagacagaggttgcagtgagccgagatcatgccactccactgtagcctgggtgacagagcaagactctgtctcaaaaataaaaataaaatacaaataaaaacccctacacaaagacaaaaaaaagaaaccatacttccaactcctttgtcattttcttggtcttttctgggtgctaagttctttatcacttttaaatatagagatatagataaaatgcaaaccataagcatataatcccttaaaggaggaaataattgcttgctgttaatgtaatctgatatatagacattcaaacaaaaagtgccatattcatttcatatgttgcagcttcctattctttacaacttatattgattatagtcagagcaacagtaaaacccactatatatctacaagtctgggtttatggctgtaataaccgataacatccctttttcattttcagaagtacctcagctcaacttctatggtccccattgtgataaaataaaagtgaggaatgagtgattagatgcatgagttctgcacacagacaggctctgttatctttcaagatttgagcctttgggaaaattaatcactttaagccccagttacgtcttctgcaaaatgagttcattatttaaacaagtatctctgtgagcttaccatctgccaggcagtgtgctaggcacggatgtgatagtatttgagatgccactgctgtcaaggctgagggagacagcaaataaacacacaaacacatatcctgagtaggccaggcggcaggagggagagtctggctgaggaatggtggaaggaggggctgctactgtagaagcaggtcagagaaggactgggcttggggatatctgaacagggacctgaatggcatggtccgataagccacatggatgcctggcagaggaaatggcaaaagcaaaagccctgaggtggcagctgcttcttgggtttgaggaacagcaaaaaggccaggggggctggaagggagcaagcgggggcagtgatgggacaagtggctggagtgcggggaaaggacaatgcaggcagctcagaggttgccatgatgattaaaggagatgatataggtaaacgcctgcactcaggggtggcatatgttatgagttcagtaaactatggctagtaatatttctgaaatactttacatgaacattttacatcatcattttacagtgtccttcggagtacatcctgcgtgtgaccaagcgtgtgtatggaagacacaatgtgtgtgtgtgcacccacgtggacctaaaagcaataagcaatttagttcttcgacaaacacagattttgtttctcttcccttctaggtgtaactatgcgtgtaccttctctgtagtttgaaaaaattcatggcaagaattctacagagaccctctttggtgccacccacaaagaaatgatatttctacttttcttttctttttcttttttttttttttttttttttttgagacagagtcttgctctgttgcccaggctggagtgcagtggcgagatctcagctcactgtaacctccacctcctgggttcaagcaattctcctgcctcagtctcccaagtagctaggattacaggcacgcaccacacgcctggctaattttttgtatttttagtagagacagggtttcaccaggttggccagactggtttcaaactccggacctcaagtgatccatccgcacatctccgcctcccaaagtgctgggattacaggtatgagccactgcgcctggcctgacatttctacttttcattcccctctttaaagaacttaatgaacagtaacacagagaaacaaaggagctggacaatgagaagcgctcttacgttgtatcgggcatctaggccaccacagctcagcggctgcttctgctgcagcctcaggtctccgttcacgtataactgggatcccgggacaggaaaggaggactggagaaacgccatgctctgcatcacgagggtcgccatcctctgaaatcattagaaggaccaacaataccaaccgccatcagatctgaagggctctgggtgctaagagtcacctgtcttggctgaaacctaagaggccctcacatacctagcgtagccatgcaggaaacactgcctagaaccttctgagctattaatagcccatgtcagttaatatgactagtgaaaaccattccattggcctaagttaaatcccaaactacatggggaagagggcccgctagagtgcgggtcttctagaaatcagaagaaggactctggtctactaaaaagacacaagggagaggacagcctcccagcggactgactcacgtgtaatcgataggagaaagtcaggatgagctgcacaccgagaacgtgctccgtggactgcaggggaagctccagcttaaaatgtaacatgtccgtcttcccatcctggttcctgtcttcttctctagtctaggaaacccaaacaggcccagcagccctggtcactaatgagtctgggaggaatccacatcacttctgtaaatacacaatgacccactgtcttgctgtacacaacaggcattatctcctccactaaaagagaaaagcagatagatgtaagtgcattaatactggggagagacacaaagtgcatggtccctgaacttcatatctgggcctttcaaatgttcactggccaaaataaatgggcaataacaaaaaacatctggatagtatttgtgcctttcagttgtctcatgtgatcttgcttattttgcactgatatttttttcttttttacaaatatgcctgaatttgtatggaaattttaagtagcatgtcagaatagtcttctatgtctctagaagtcaacttgttaaaatagaaaaacacctaatcctaatcattatgcattcctccaacaaactcaaactcaacagaaaatcaccaagctctatttttttttgtttttttttgagccggggtctaactctatcgcccaggctggagtgcagtgacgcaatcacggctcactacaacctccgcctcccagggtcaaggaattgtcctgcctcagcctcctgaggagctgggattacaagtgcccaccaccatgcccagctaatttttttatttttagtagagactgggtctcaccatgttggccaggctgatcttgaactcctgacctcgggtgatccgcccacctcaggctcccaaagtgctaggattataggcgtgagccaccgcacccggccttaccaaactctgtttatagattctgaaaccacgagtgtctttgcttcagattcttgatgttggatcttatctcatcattcgtgtgaggacctgaaagccttgtgcatcttttagtagcaatcaatgaaatgaaaaaggaagctatgtcaaatcagcaaagtattaaaaccatatctatttgataaattacgggcatgaaaggaaagaagacagaggtctgtagaggaaaaaagacaaaatacagcttatgaagcatatgtaggcagtgaaaaaaaactggtatccactcctaccatccacagtcttgccaaacagtgatgctaaaatgatgatcaggaaagcacggttactgaaaagtgatcactgctgacatggtccctctgcacaactctggatctttttgctacaactgatcctttcccactgtggattcccagaacaattctactatcgtgtagcagcattcccatctggatccaccatctatggattcattttgattcccaccattactattacgtaaggaagagattttttgtgtgtgtgctttttcaggctaataataaggtcatttgaaatgaagaaatctcaattttcagaaactttcaattatttctttctttctagacaataatgttccttctcttaggtcttgttttagagaaacctccctcccttttctcttggatacttcctctctgccctgtttcatcagcttcggggagggatatctgctaccagggctgatgatcaagttactgaggcaatgatggactagtcattataggtaggatgaaaagagcctgccttgcggatcatgaggtcagaagatcgagaccatcctggccaacatggtgaaaccccgtctctactaaaaatacaaaaattagctgggagtggtggcacgtgcctgtaatcccagctactcaggaggctgaggcaggagaatcgcttgaaccagggagttggaggttgcagtgagccaagatcttgccactgcactccagcctggtgacagagcgagactccatctcaaaaaaataaaataaaaaataaataaaagagcctgccttgtctcctgtggattttcttcaattgggatctgggtagaaaatcttatgtaactctctgtgatggatccacaccttctagatctttagggttggacaggaagaaaagagcacatttctcaacttgcaacagaggatagtggccaggagacaactgccagaagaatccagactccaacacactgtgggagggggaaaagctcatttcctttgatctttacaataaatgtaaagccccaggcaggcagaacaggtattttcccattacacagatgacaaaatcaaggatgagtgagattagggcatttatcagaggtacagcaagtaatggtgaagacaggatttgagatcaggtgacttcaaatctggtcctctttttaggaccaaaatgtctaaaattattttaaaaattccaaatgaagacagcaggttggacaaatcttcctgaaaaacagcagcaccaggcatctacgtctgtatacttgcctgtgcacatccttccattccaagttcgcgggggacagatttggcacaacaccatcaatagtgtctacttgttaaattcactcattgatctgttacgtactttttggaaacacgccaggcactatttcaaataatgagactataatggtaaacaaaatagacaaagtccccatcctaatggggcatacattcccgatggacaatgtagaaaacagtgacaagtgccgctgacagaaatgaagcaggctaaaattagagaataatgaaggtaaaatttaacagaaattggccaggcgtggtggcttatgcctataatcccagcactttgggaggcccaggtgggtggattgcttgggctcaggagttcgagagcagcctgggcaacatggcgataccctgcctctattaaaaatacaaaaattagctaggcatggtggcgtgcacctgtaatcccagctactagggaggctgaggcaggagaatcgcttgaacccagaaggtggaggttgcagtgagccgagatcgtgcctctgcactccagcctggtgacagagcaagactctatctcaaacaaacaacaaaaaaacccaaaaagaatttaacagaaatttttaaatattcaggatgacccaacttgttggagtcctgaaggaagtgaagtgatggggtgcaggaacatctcagagaggagggatccaggctaatcaggtacatgtgctctgggtacccgtgggatcaatgcatctggcagagtgggtgagaaggagagcagggtggagagaggggggagagaagtttcgatggaaaggatgtgtctcccacaaatgacctgtcaccaagctggactctcaccctcctggggctggcgaagtttggctgtgctcctctgttatcacttggaccactgaataaatcaattatttaattccatttagttgaaagtaagtttaacatatgtgcaatagctaacaaaggcaggcattcaaaggctactacttctttaacacaaattctaggtcgctatctaacctccaactggtacttagccaagagaattcacatatcacaccaccaccttatatctacaacgtatatacaggctttggaacaatttttatatccattcattgtcccacgtgattcctctgcatatcccaggagagatgtgggtactctcatgccctgtatatggatagataaattgagggtgaggttatgaaacccagtgacagaattgggactaggaccttgtgggacaaggatcttggtttgctgactcctgattcagggctcttctataatagctcataagaactctaactgaaaagatttctcatggttaaaggaggataaccctttagagatacacatgaaatccacacgcatgtactgagcagagtcagagggaatttttttgttttttttttgagacgaagtcttactctgttgcccaggctggagtgcagtggcacaatcgccactcaccgcaacctccacctcccaggttcgagtgattctcctgcctcagcttcctgactagctgggattacaggtgtgcgccactacgcccagctgatttttgcatttttagtagagatggggtttcaccgtgttggccaggctattctcaaactcctgaccttgggtgatctgcccgcctcagcctcccaaagtgctgggattacaggcatgagccaccgcacctggccagagggaatttaacatagggaataaatagtcccataggtattagaggactgaagacgtaaaaaggggatatcccagcaacacagagatagtagctgcagggaacatttcccacacctaggactagagaagaaggggaagcgggtgggactgatagaacttagaggttcagggaagaggcctcgaagagctgagcctcagacttcaagaagggaccgcggcccagatggggccaggacctctgagcttggaggaagcatgcactagagggaaccttgaagccggtaggagaggcgtcctgctccttcctgtttgctggttgtccctgtttgtggcatccacagtggttcttcaccctggcagtggtgactggtttcatttctttttttctgcactcccagaacaaggctcatcatgcctcctactggcagaacctaacaggaagctgcaggggaagaaggtggtttccagcatctcagcaggaacctggaagctgagcgtaggagggtgggtttggagctgagacaatacctcataaccagcacaccacctgactgcaggaattgccagaaattcaagtgccattgtttccagagtatcctgatgtgtgacttttttccccgtcaggaattcccagcatctgacggtttgttggaattttgtttggtttctgttttgtttgcgtacatttcattcatttaagtcgtattcttttttttttttttttgagatgcagtctggctctgttgcccaggttggagtatgggtggtgcaatctcagctcactgcaatctccgcctcccgggttcaagcaattctcgtgcctcagcctcccaaacagctgggattacaggaacctgccatcacacccggctaatttttgtgtttttagtagagacggggtttcaccatgttggccaggctggtctagaactccctacctcaggtgatccatccgcctcggcctcccaaagtgctgggattacaggcgtgagccactgcgcccggcccatattcttttattaaaggttaatttcctagtttataccagtgtctatttcaccatatacttgtcatcaccgggtgctcctttctttttaagctaaaaatactctttggcaccagttgtgggtctctagcaaagcagaaactgccacttcgtggttcctttccacctttctacctgtatttctttttttttctatttctttttttcttgatacagggtcaaaaaaggctagagtgcagtggcacgatcacagctcattgcagccttgacctctcaggctcaagtgatcctcccacctcagcctcctgagtagctgggactataggcattcaccactacccctggctaatttttaaattttttatagtagggcctcactatgttgcctaggcggtctggaactcctgagctcaaggggctagcctcccaaagtgctgagattataggcatgagccacagtgctcagccttgtatttcaatctaagataccattacttataaaatgaaccattattttatataccactgataaaagaaaaacatttccaattaaactatgacacttttctaatcacttactttttaaaaagttactaaaagagcttttagatttagacatatttacacagatatgtttatttacttagaaaaatataagcaaaataggtcggggcagtggctcacgcctgtaatcccagcactttgggaagccgaggtgggtggatcacctgaggtcaggagttcgagaccagcctgaccaacatgatgaaatcccgtctctactaaaaatacaaaaatcagccggccgtggtggtgcctgcctgtaatcccagctactcatgaggctgaggcaggagaatcgcttgaacccaggaggcggaggttgcagtgagaagagattgcgccactgcactccagcctgggcaacagagtgagacttcatctcaaaaaaaaaaaagaaaagaaaagaaagaaaaatataggcaaaataaattgattcagggattcctaaaacttctttacatcctcatccttttgagtaacactttaactcagtcaacaacccatacttttctatgcaactttgtcctttgtgccatcaaacatgttggtgatacagcattaaaagaaaaacaaaaacaaaaaacaaaaattcagctgggcatggtggctcatgcctatagtcccagcactttgggaggccgaggcaggcagatcacttgagctcaggagttcgagaccagcctggccaacatggtaaaacctcatctatactaaaaatacaaaaatgagccaggcgtagtggcaggagcctgtaatccagctccttcggaggctgaggcaggagaatctcttgaacctggggggcggaggctgcagtgagccaagattgcgccactgaactccagtctgggtgacagagtgagaccctgtctcaaaacaaacaaacaaacaaacaaacaattcataaaagaaactaaaagccattggtctgggcccttaagcagactttgaaattatggagagctttcctgtttttaaaagcctctcaaactttcccttacttgctctccattcaattcaggggttaaaaaaatgttctactactgtctctggggtttcctctgaggttgctgatgccccttctttttaattgcatttttatttttctaacacctacctcttacacagaaatgatgccccttctgcatgttttgatgccggcacaggtgtaagcaatgagaactatgccatacctgcctccttgccaacagttgataaccacagacaggaagacactgatttcagggatgagaagaaacaggtgtcttagaaacacggtactctccactcatcctctggaatccttctataaccttcagtccctgtattctctgggtccacacatgccttcaagagctatgtcagcctccttgaggcttgagggggaaaaagtcactctgcttttctcttctctcattaaaaacaacaaaaactagacttccaaagcattaaacatgtagggagcttagagacgctgtccaggatgagctgaccaaagcagaagcaaggctgtttgtgacttcagcatttcccccaattagccactgcaaagccacctcccagcacttggtccaaccttaatcaacaaccactgtttcctttgccttctggacagtttcctggatagactgacgtcagtctggctctatgttcaaagttagaaaataaaagtagtttgttgcaataagggctaagattttaagatatagcataagaaatactgagttccagtccagactctgttcacttcaaagcagtggctcacacctgtaatcacacctgtaatcccagctctttgaaaggctgaggtgagtgtattaccagagttgaggagttctagaccagcctggccaacatggtgaaaccctgtttccactaaaaaacacaaaaaagttagcccggagtggtggtgcatgcctgcagtcccagctacttggaaggctgaggcgagaggattgcttgaacccagaaggcagaggttgcagtgagctgagattgtgccactgcattccagcctggctgacagagtgaaactctgttgcaaaaaaaaaaaaaaaaaagaaaagaagaaaagctagggcaaattgtaccacttctctatttctttttaattttttatttttttgaaatgtggggtcttgctatgttgcccacactggccttgaactcctgggctcaagcaatcctcctgcctcagccttccaaagtgctaggattacaggtgtgagctatcatttctggcggcaaatatttttatctcatttacctgatcatttagaaatgtatctccaggtcttgagataacatttgcattgaaaattctcagtttctcagttttaggcattctctattgagttcccacaaggaaagatgatttagcttcttctctcccccaattcctcccaccatcccctatcacatacccaatacctttctcattacccccaatagagttaaaatctctttttagtaaacattcagtgttcatataattaagactatgtcaatcctattcacaactctgataacattttggttctcagttttccttacttttcatttccctgcagttaataattatttgcttagttttctatgtacttataccatttcatcaaagagctgctattccaattcctcaaaatttgatgtttaaaggcataagatttagtcaaaaccttgttcattgaaatattgtccctaggccgggcacagtggctgacacctatgatcccagcagtttgggagaccaaggcgggtggatcacctgaggtcaggagttcgagaccagcctggccaacatagtgaaaccccttctctactaaaaatccaaaaattagcctgtaatcccagctactcgggaggctaaggcacgagaattgcttgaacccaggaggcagagttgcagtgagcagagaattgcagcactgcactccagcctgggcaacagaacaagactgtgtctcaaaaaaaaaaaaaaaaaagaaaagaaaagaaaaaagaaaagaaaaaaagaaatgttgtccctaatagtgaaaaagtcaaagcaaacctcaaaaagaatacagctgattaataagtattgatacatatacaaaactgagccttcaatttctgtcattatatctacctgtaactctatcatattttagaatgagcatgcacttttgtaatcagaatataagaacatttataaagtaataggagaaaagtaacctgaatcatattaggttggtgcaaaagtaattccggttttttgtcattacttttaatggcaaaagccgcaatgacttttgcatcaacctattactattttttttgcagttatttatacgaccaatcggatttttaaaaacaattttatttagttgctgggaacaagtctgattttcttttctcctcagctatacaaggttggcttgtagggcaatcatcttagatatgtctgaagagattcgaatttgaaagaaggaaaaccagaagtttcatacttctaaaggaaaacgttttcagaaaatgagtgaaaaggagtgactacaaaggaagcattcgcttatctcaaagcaaatactaaattacagattcctctcagcgctctactggtgaaaaaatttaaaaataaataaataaattacagacagtaacatgcttccatttcatcccgacagcttcaggatggcgcagtctccaatgggacaaacccagggaggcgtgactcggccacagcgcgttctgggaaggccgcttaaccaatcagcgccttggtttccaggggtcaggtctgcataaaaatgctgccctttccgttcctatagtggtgtgatgcagaaacgccgcgacagaatggggttatctacattaacagcgcgcggccttccaggctcctaaatggactttcacaaacaccctccatcaggccaggcccgcgggtgtgacccgggcagacacaggctgcccccacacttctggactctgtgtcagggcgcacacgctgacagcatggctaactttctgggggccggggacatctgggagaagcagaatgaaacagaagatcgattccctaggtcctaggagatgaaacgccacctttgcgggttcgcgagtccttaggatcaaagctgggctccccagggccggggccgctcgccccacatcctcattccagtccccatccccaccctatccccgactctgccccaggcccaggcgggaaccacgcaccgaaacgagcgggacgcgcaggcgatccccttgcagccggttgaaggcggggaacgtgctccaggcgaggaacccgtcgctttcgggtccgagcagggccacgagcagcacctggtgttggaagcgcacggtcggctgctcctcgtagctgctccgcttcagccaaaaccctgagttaaagagggcggtagggaggcggttagggaggccggccctggccgagcgcgcccggggagcctcgtggcacagcggccggggcaggctcaccgtggctccggaaggccaccagcagcggcgggatgtacgtgagcgcagcggccagcagcaggaacagcgcggctttggagcagagccccgcgcggtaactgcgctcgaccgggtgagagaagagctcatagagcgccatgagcaccgctcgcaggcactccgcgagccgggggaccaagtttggcttctcctggttgccatc

SEQ ID NO: 1384 - DNA, 6642 bp, Homo sapiens
attgcaggacttttgaacaaatttattacttatttttttgatagagtcttgctctgccacccaagctagggtgcagtggcatgatctcagcttactgcaacctccacctctggagtccaagtgattctcccacctcagcctcctaagtagctgggattacaggagtgtgccaccacgccggactaatttttgcatttttagtagagagggggtttcactatgttggccaggctggtttcgaactcctgacctcaggtgatccacccgcctcagcctctcaaaatgctgggattacaggcatgagccaccgcacccggcctggcacacatttaatttaatttagcagtaacttactccctgcgcccagaagaggtaggggcaagagttgctttccatgaagagtgcacctgatgagaaggcagctccagaagactcaaaggaaaaccgagaatcaggagagaaagaaacgtgcagtccttgcctacttcaggggaggaccccaaactcccggttgatagtagggacctgcttccccatgcgccccagctccctctccaccatgcagtcgcctcctgggcctggcgaccacagttcggggcctgctctaaggcccagagttctcagtcaggcgatgcccagctgaagtggtctgggcctcgtggcagcaccagatccagggtgaggtcacgctgctggtccgcagagtacacaggccggtagcccagcagctgcagcgcgccggcgcacacctcctgcacgcgcaggatcttagtgaagggcaacgcgtggcgccaggcctgggagacgttgcgcgcattcctagacgaagtatggaaggcctcgattggcttgccgatccccgacccgtgggtgatgttgtggatccaggcctcgagctgtggcgtgagggtcaggccggtgaaggcgtagagtgcgcggatctctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggagccctgtgggtttgcaagaagatcagttgatggggagctgggatggagcccaagaagcagagaggtgagagcagagtactgtcctggccagctgaggggactcaccaccgtccagggctgctgggagagctgcaacgctgatcacaaatccatgggagatgtctcgacatctggcaaagcaggaaggagaggagatcagagccctacagagagacagccctgtacatagaaagctccccagggtgggaacagagctgtcctgcctgccttttgcttcaggataactcgtagagagacccttttgggttgtggagctaaagggcttgatgacggtttaggcggatgtcacaccaccaccaggcttgctgaggttgaataagtctgagtagggcatttctccaaatggctgggaactggcggggtctcctgatggatggaagcgagagagctggctccaaatcccagcactgccaatggggagctatgagacctggggcaagtgacttaacttctctgaggctcaatttgcacctctgtagaatgggatttgcaatatttaacctcttagagctgttgtgatggatgctgctgcaaacacctatgaggggagggcctggggaagcattccttacacacatgcccctgttactgttactgtccctgtgctgagctacatctggagagaaagaaccccctccacctggtgagtctccccacagaggagacacccacaggccacctacccttccaatccctgtatctcccaggccatcctctggcgtccaaccaccctgagcctttagtggaccttaagaatgtcacgcatttctcacagggtggaaggaacactgagccagcctcccgcattccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggaaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcacttctgatcccaggctgtgggcctctcccacctgtgattgccccctgcagagtgcaggaccctgctgctctggcccaaacacagttgtcctggccagcccagcccttccctgggtagggaggatcttgatcccaagctaaggtgtttgttacctgtgttccaggaaagccagaggtcttcttaaggtggttgaatcactctatgccacacagagtctccagaagaccagttcctcactgggagctttctgataaggagacttacattcagcacagtggacaattggccaagggtgcaaagttagggagaaccagtcagccaggccctgtgatatgcactttcatcttcatgattgaatgttatcctcccaagtcccttggaggtagaaataaccatccctatctgttttaattgaagcagtggggctcagagacattaatacccagtaagaaagaggcagggcaggggcttaagtccaagagccagactcccagtgcagggccctgtggtgggtcacactcctaagcctttgtccagtgaactcttccatcctggaaggactgtccccttcccctctaaattcttccgttttttgattcttttctgggggcacatatttattacatgtttaatttttagaaaaataatacaaacaggtcacacgaaattaaaaaagtagagatgagggcatcgcagacttggcctcccaaagtgttgggattacaggcgtgagccatagcgcctggccaaaatgcaattcttgactgccttgcctctgtgtaaaaggagagagaaaggaagtcaacatttgcatttgctagacattggacacagtggcttacgcccgtaatcccagcactttgggaggcctaggtgggtggtcaccagacgccaggagttcaagaccagcctggccaacaaggcaaaacctatctctactaaaaatacaaaaattaggccaggtctggtggcaggtgcctgtaatctcagctacttggaggctgaggcaggagagtagcttgaacccaggagacacaggttacagtggccgagattgtgccattgcactctagcctgggcaacaggagcaaaactccatatcaaaaaaaaaaaaaaaaaaaaaaaaattaggccaggtgcggtgactcatgcctgtaatcccagtgttttgggaggccaagatgggtagatcacctgaggtcaggagttcaagaccagcctggccaacatggtgaaaccccatcgctaaaattagctgggcagagtggctcatgcctataatcccagctactcgggaggctgaggcaggagaatcacttgaacccaggaggtggagattacagtgagccgagatggcacaattgcactccaggctctgtgacagagtgagaccccatctgaaaaaacaaaaacaaaaacaaaaatttgggcccagtgccatggctcacgcctgtgatcccagcactttgggagcctcagcggggcggatcacctgaggtcaggaattggacagcctggccaacatggtgaaacaccgtctctagtaaaaatacaaaaattagctgggtgtggtggcgggcgtctgtaatcccacctactccagaggctgaggcaggaaatcacctgagcccaggagacaggttgcagtgagccaagatcaggccactgcacttcagcctgggtgacagagcgagactccgtctcgaaacaaacaaacaaacaaacaaacaaaaaaacatttcctaggcacctgtactgtcctggggcccagagggcctttcctaaagcctaacatcaaggccctagaggcagtgaggcacgactccacttcccctgagtctggttgcaaattaactcaccaagctattttttctcaagaatttcatggagagcttttgaaagccacaccctttgagacccaagtatggaataagaacccgcaccccgacccctgccctgcgcagtgaggattcccgcgtgcagccgaagccccagcaagacacttccaaaccagcgctagcaggggagatgaactttccacgttgctgatggaaaagccacccccagctcttcccgccaacccaggtctctggtgcaggacagaggagcgtcacagctgggccactggcccggcccccagcccaaccgagtgtggggacacctccggtggagaatgaagaaccaaagtacctcaaagcttggcgtgtctgccagagctggagcagcagccagag

SEQ ID NO: 1385 - DNA, 18123 bp, Homo sapiens
cttccattttgacttttttatttatttatttatttattttaacagatagggtctcactctgtcacccaggctacagtacagtggtgcaatcatagcacactgcagcctcaagctcctgggctcaagtgatcctcccaccttggcctcccaaagtgttgagattacaggaatgaaccaccatgctcggcctcattttgaacattttaattagaaagttacaaaacatcatgggttctttatacaagatttgcattagaataatttaataaaatgcaaaccaatgtttatacgtatcttgtcatctttccatatctcattgccttatgtgaatttaaacaagaaactatttttcgtttagatcttaagaaaaaaatttaggcatataaaacagcctgaatattaaaaaaagacaagggggtcagtgttagggaattcctctgcttgaatacttcaaaatagctttgtttccaaaactgttttagtaagcctaaaggagcactaaaaacgacaactgatctccaaagtaaactgaggcacacactgaggggtgtgtttctgggtgggcatgaagcatggatcaccggggccatgtccttccagtggcaatgacctgcttgggatcaggaagcagctccatgtgttcttggaggagactgcccacatcctcaggaggtgaatgggctgaacaagccatcttccgtgtgcagaggccccttccagccatctctgctcctgcagacacttgcttagccacgagggtaatccactggactgcttggtattctgctagtggccaggctggactggcctgcccaggccagcatcctctttacactcttactgcttcttgtgtccttcccaaagctgcccgccccactctgatgggcaccctgttccttagtcaagggaaacgccagccgctgggcttcccgctagccttccaaataaacttgtggttgtcaggcagcgggagccaatcccaacaccaacccctgtcgcccctgtcctttgcaggaagggggagggctgtcaaggaggaggagggccaagtgcccaggctgttgggtgagggccagaaagaacctgttgtgacaatgctttcttcccccagtgctgctgagggggctgagaatgaaacagcccctctgacttcagcctgccatccaggggcacagacagagggaaaaatagggcaaagagcccagtcacagtacggcaaagatccagggctgctcagctgagctgatgacagatgactgactgttgggctggggcaggtggacggtccaagtgtccttcagcggccctccctgattgcctgtgctaatgcggcccttgcccttgggccctgcccctccaggtctccagttaaaggcctcagctctggaaatcaaagctgtgaatgggaaatggagaagcccaggggtgcaaagtgctagtgattggcatgtttgtcacaagagagccctgaaaagagtaagagtggctcacaacagaaggtagaaatgcacagtgtgttcctcagttcaacagaggaaaagtctctgcttgaccagagatgggactctttccaagatgtctgaactgactgcaattttctcctgaaattcaacgctaaggcaaagaaggaaaacccaaaaagctaattatagcctccaggaactctcagacctttccacaaactagtccctgacaattctgcaggagctctgaagatacggaactgtgtagagcaaaaccggaaagaaccgttgtctctgagggaaaagcacacaagcccgcaggtgtccgctgggctctttcaaaaggtcctaagatgttcccagaagatgacaatgaggcagccacggtcctgctgagtcttcagaaatggcctttctaggataagtgctccttacacaagtctccccggggcgtcactgtcacaggaatggtggtcaccacctgattctgaaacacgaagatcttgattctttcaaacacccagaggaagataagcaggatgctgacatactgcacccaggcgaactttaccatctcccagaatcctggctgataagtatggacagttaaggagtgaagggccacatggtgttaagtatgaagagaaaatccaagatggaattggctgtggcagaggtatctcgaaaggaggcaggacctctgtcatgtacacacccagatggaagctgacctgaacttggccaaatggtaaaaccagccacatttgatttgagctatttatataccaagcctgatgaccaacctcctaaacagacaactatgccaaactagattgatcatggactagagatatcctgagctgttaaccagccatccatccatcttctaaaatcttccagttgtgtaaacttggaacacccttagcccctgcctaattgcacctgtacggaacacaatttagctgcttcctaggtttgtgtctctggaattgtaattcctaagaccccagttaaaatgccttctcttttgtttgcttctctgcagtgttggtgttggtttcattttccattagtcgacctaagtcaaaattaaaccaaagtttaggtcagacagggactggcaagaatgtttcacataaccttagcataaaagggatatcatatgattattaagacataaatatggatgattcttacctagaagaattgcttggaaacaaataggaccaagacatgaattatttgttcctatatgaatagcagacatacagtcattttctgagacatgtagcctaagatgtcaaagacgcagccatttttatgaggctataaccctgtcatgatttccaagagaaaacctcccacgtctgttactacttgagacaactaaggaatcattcctctttgaaaactgagctaccattgattttttttaaattgttgtttgctttaagaggcagggtctcactctgtcaccgaggctggagtacagtggcacaatcatcgctcactgcaagcttgaattcctggactcaagcaatcctcctgcctcggcatcccaagtaactgggactacacatgtacgccactatgcctggctaatttttttttttttttttttggtagagacagggactcactatcttggccaggctggttgtgaactcctgggttcaaatgatcctcccaccttggcctcccaaagtgctgaaattataggcaggagccaccacatccagccttaacatggactctttaacagaaaggatatgaaatgacttccacagggtatcggatgatagcattaatcacaaatggagcatctgcggccctgcccaccagccagatggggttgggatcattcaggacggtggtaactgcaatgcaatcattaaccattaaccacgatggctgtttgactctggcagttgaaggctataaagattatttgatacctggaaattatcctgtgcttcagaactgaaagaaatcattcggaaggaaagagaaattgcatgtgcaaagctgatcacacattatttgttaaaataatagtcaaaatacttttgttaaaatacataaaaaacttggaaagagtttcttctacatgtgctgaatggctaactgaaggaatactatactgccactaaaagtagtatcacagctttgtagctgtgtggggaagtatttatattccaagtttaaataaataaaagtaacttggatcccaatgtgtttctacactacaatggctgtataaaaagatctgcagaaggctaaagaatgaaaggaatgaaaaaatagttgatttgtagggcaatgttttctacttttgttttaaaattccctctattattgcaataatgccactagtatatgccataaaatcagtaagcaatactggatttgcagtcatcccccttgtgagacgtctgtgtatagtctccatgatgtctgcttgccaagtaacactgtagatgcttttagagaaaacctcagccaccgaccagacaaacgtgccgagtccacacatgccatggcctagagctctgtaaggaataagcacactgtgccttctggcaggaaacaggggcactcctgttctcctgctggactgctaatgtggggagagtcacccacgttctctgtttttctctgaaaagcatgaacagcaatttgtctttggcatctgttataggtgtggataggtgtggtatggggaacaactcaattaggcttatattttttaaaagagaaacccactaagccagtggtgggataatgatggcatttaaccatcactagcctgctggaccatgggatgctggaggggtgggggcggtcccaggtctgaagatcaggacgaaaaagacaaatcctggacagcatatttgctcccatcgttgagcattcacgggttttgacattttcatcacaagggttccagttctgcttgtctctgttgcccccactaaccttgaaagtcctgagcagcggctgaatgggctctacctgtgactcaccgttcctctcctggtaggcagcaacaatatgggtgaggtcgtagtcataggcaaaggggctggtcccgttgatcacggatatctgggacacgggaggaggatgtggtgtgagcacctgggagactcctccccttttccttctacccttctgcccacccaggctggtcccacagagcaccctcttgttcttggtggcctactgcagtatcaataatcttttcttcaaagatgaataaaacaggctgctgcccacccaggctggtcccacagagcaccctcttgttcttggtggcctactgcagtatcaataatcttctcttcaaagatgaataaactctcttgcaacaatttaagcccatttactctcagtctttctttctgtggatggaaataaggggtcagtgtccatgttttacaggttttaaagctatttttaaaatacccctctttatctcagcgggagaaagaattccttaaattattttaacagaccgtattttcgccaggtgtggtggctcatgcctacaatcccagtgacttgggaggctgaggcaggaggaccacttgaggccatgagttcaaggccgtagtcaatgatgatcatgccactcactacactccagtttaggaaacagagaaagacttcatctctcaaaaaaaaataaaaataaaaaaaaataaaaagccaggcatggaagctcacgcctctaatcccaacactttgggaagcccaggcagatggatcacttgagaccaggagttcgagaccagtctggccaacatggtgaaaccccatctctactacaaagaaaacaaaaattagccaggcgtggtggcatatggctgtaatcccagctattcaggaggctgaaatcagaggatctcttaagcctgggagacagaggttgcagtgagccgagatcatgccactccactgtagcctgggtgacagagcaagactctgtctcaaaaataaaaataaaatacaaataaaaacccctacacaaagacaaaaaaaagaaaccatacttccaactcctttgtcattttcttggtcttttctgggtgctaagttctttatcacttttaaatatagagatatagataaaatgcaaaccataagcatataatcccttaaaggaggaaataattgcttgctgttaatgtaatctgatatatagacattcaaacaaaaagtgccatattcatttcatatgttgcagcttcctattctttacaacttatattgattatagtcagagcaacagtaaaacccactatatatctacaagtctgggtttatggctgtaataaccgataacatccctttttcattttcagaagtacctcagctcaacttctatggtccccattgtgataaaataaaagtgaggaatgagtgattagatgcatgagttctgcacacagacaggctctgttatctttcaagatttgagcctttgggaaaattaatcactttaagccccagttacgtcttctgcaaaatgagttcattatttaaacaagtatctctgtgagcttaccatctgccaggcagtgtgctaggcacggatgtgatagtatttgagatgccactgctgtcaaggctgagggagacagcaaataaacacacaaacacatatcctgagtaggccaggcggcaggagggagagtctggctgaggaatggtggaaggaggggctgctactgtagaagcaggtcagagaaggactgggcttggggatatctgaacagggacctgaatggcatggtccgataagccacatggatgcctggcagaggaaatggcaaaagcaaaagccctgaggtggcagctgcttcttgggtttgaggaacagcaaaaaggccaggggggctggaagggagcaagcgggggcagtgatgggacaagtggctggagtgcggggaaaggacaatgcaggcagctcagaggttgccatgatgattaaaggagatgatataggtaaacgcctgcactcaggggtggcatatgttatgagttcagtaaactatggctagtaatatttctgaaatactttacatgaacattttacatcatcattttacagtgtccttcggagtacatcctgcgtgtgaccaagcgtgtgtatggaagacacaatgtgtgtgtgtgcacccacgtggacctaaaagcaataagcaatttagttcttcgacaaacacagattttgtttctcttcccttctaggtgtaactatgcgtgtaccttctctgtagtttgaaaaaattcatggcaagaattctacagagaccctctttggtgccacccacaaagaaatgatatttctacttttcttttctttttcttttttttttttttttttttttttgagacagagtcttgctctgttgcccaggctggagtgcagtggcgagatctcagctcactgtaacctccacctcctgggttcaagcaattctcctgcctcagtctcccaagtagctaggattacaggcacgcaccacacgcctggctaattttttgtatttttagtagagacagggtttcaccaggttggccagactggtttcaaactccggacctcaagtgatccatccgcacatctccgcctcccaaagtgctgggattacaggtatgagccactgcgcctggcctgacatttctacttttcattcccctctttaaagaacttaatgaacagtaacacagagaaacaaaggagctggacaatgagaagcgctcttacgttgtatcgggcatctaggccaccacagctcagcggctgcttctgctgcagcctcaggtctccgttcacgtataactgggatcccgggacaggaaaggaggactggagaaacgccatgctctgcatcacgagggtcgccatcctctgaaatcattagaaggaccaacaataccaaccgccatcagatctgaagggctctgggtgctaagagtcacctgtcttggctgaaacctaagaggccctcacatacctagcgtagccatgcaggaaacactgcctagaaccttctgagctattaatagcccatgtcagttaatatgactagtgaaaaccattccattggcctaagttaaatcccaaactacatggggaagagggcccgctagagtgcgggtcttctagaaatcagaagaaggactctggtctactaaaaagacacaagggagaggacagcctcccagcggactgactcacgtgtaatcgataggagaaagtcaggatgagctgcacaccgagaacgtgctccgtggactgcaggggaagctccagcttaaaatgtaacatgtccgtcttcccatcctggttcctgtcttcttctctagtctaggaaacccaaacaggcccagcagccctggtcactaatgagtctgggaggaatccacatcacttctgtaaatacacaatgacccactgtcttgctgtacacaacaggcattatctcctccactaaaagagaaaagcagatagatgtaagtgcattaatactggggagagacacaaagtgcatggtccctgaacttcatatctgggcctttcaaatgttcactggccaaaataaatgggcaataacaaaaaacatctggatagtatttgtgcctttcagttgtctcatgtgatcttgcttattttgcactgatatttttttcttttttacaaatatgcctgaatttgtatggaaattttaagtagcatgtcagaatagtcttctatgtctctagaagtcaacttgttaaaatagaaaaacacctaatcctaatcattatgcattcctccaacaaactcaaactcaacagaaaatcaccaagctctatttttttttgtttttttttgagccggggtctaactctatcgcccaggctggagtgcagtgacgcaatcacggctcactacaacctccgcctcccagggtcaaggaattgtcctgcctcagcctcctgaggagctgggattacaagtgcccaccaccatgcccagctaatttttttatttttagtagagactgggtctcaccatgttggccaggctgatcttgaactcctgacctcgggtgatccgcccacctcaggctcccaaagtgctaggattataggcgtgagccaccgcacccggccttaccaaactctgtttatagattctgaaaccacgagtgtctttgcttcagattcttgatgttggatcttatctcatcattcgtgtgaggacctgaaagccttgtgcatcttttagtagcaatcaatgaaatgaaaaaggaagctatgtcaaatcagcaaagtattaaaaccatatctatttgataaattacgggcatgaaaggaaagaagacagaggtctgtagaggaaaaaagacaaaatacagcttatgaagcatatgtaggcagtgaaaaaaaactggtatccactcctaccatccacagtcttgccaaacagtgatgctaaaatgatgatcaggaaagcacggttactgaaaagtgatcactgctgacatggtccctctgcacaactctggatctttttgctacaactgatcctttcccactgtggattcccagaacaattctactatcgtgtagcagcattcccatctggatccaccatctatggattcattttgattcccaccattactattacgtaaggaagagattttttgtgtgtgtgctttttcaggctaataataaggtcatttgaaatgaagaaatctcaattttcagaaactttcaattatttctttctttctagacaataatgttccttctcttaggtcttgttttagagaaacctccctcccttttctcttggatacttcctctctgccctgtttcatcagcttcggggagggatatctgctaccagggctgatgatcaagttactgaggcaatgatggactagtcattataggtaggatgaaaagagcctgccttgcggatcatgaggtcagaagatcgagaccatcctggccaacatggtgaaaccccgtctctactaaaaatacaaaaattagctgggagtggtggcacgtgcctgtaatcccagctactcaggaggctgaggcaggagaatcgcttgaaccagggagttggaggttgcagtgagccaagatcttgccactgcactccagcctggtgacagagcgagactccatctcaaaaaaataaaataaaaaataaataaaagagcctgccttgtctcctgtggattttcttcaattgggatctgggtagaaaatcttatgtaactctctgtgatggatccacaccttctagatctttagggttggacaggaagaaaagagcacatttctcaacttgcaacagaggatagtggccaggagacaactgccagaagaatccagactccaacacactgtgggagggggaaaagctcatttcctttgatctttacaataaatgtaaagccccaggcaggcagaacaggtattttcccattacacagatgacaaaatcaaggatgagtgagattagggcatttatcagaggtacagcaagtaatggtgaagacaggatttgagatcaggtgacttcaaatctggtcctctttttaggaccaaaatgtctaaaattattttaaaaattccaaatgaagacagcaggttggacaaatcttcctgaaaaacagcagcaccaggcatctacgtctgtatacttgcctgtgcacatccttccattccaagttcgcgggggacagatttggcacaacaccatcaatagtgtctacttgttaaattcactcattgatctgttacgtactttttggaaacacgccaggcactatttcaaataatgagactataatggtaaacaaaatagacaaagtccccatcctaatggggcatacattcccgatggacaatgtagaaaacagtgacaagtgccgctgacagaaatgaagcaggctaaaattagagaataatgaaggtaaaatttaacagaaattggccaggcgtggtggcttatgcctataatcccagcactttgggaggcccaggtgggtggattgcttgggctcaggagttcgagagcagcctgggcaacatggcgataccctgcctctattaaaaatacaaaaattagctaggcatggtggcgtgcacctgtaatcccagctactagggaggctgaggcaggagaatcgcttgaacccagaaggtggaggttgcagtgagccgagatcgtgcctctgcactccagcctggtgacagagcaagactctatctcaaacaaacaacaaaaaaacccaaaaagaatttaacagaaatttttaaatattcaggatgacccaacttgttggagtcctgaaggaagtgaagtgatggggtgcaggaacatctcagagaggagggatccaggctaatcaggtacatgtgctctgggtacccgtgggatcaatgcatctggcagagtgggtgagaaggagagcagggtggagagaggggggagagaagtttcgatggaaaggatgtgtctcccacaaatgacctgtcaccaagctggactctcaccctcctggggctggcgaagtttggctgtgctcctctgttatcacttggaccactgaataaatcaattatttaattccatttagttgaaagtaagtttaacatatgtgcaatagctaacaaaggcaggcattcaaaggctactacttctttaacacaaattctaggtcgctatctaacctccaactggtacttagccaagagaattcacatatcacaccaccaccttatatctacaacgtatatacaggctttggaacaatttttatatccattcattgtcccacgtgattcctctgcatatcccaggagagatgtgggtactctcatgccctgtatatggatagataaattgagggtgaggttatgaaacccagtgacagaattgggactaggaccttgtgggacaaggatcttggtttgctgactcctgattcagggctcttctataatagctcataagaactctaactgaaaagatttctcatggttaaaggaggataaccctttagagatacacatgaaatccacacgcatgtactgagcagagtcagagggaatttttttgttttttttttgagacgaagtcttactctgttgcccaggctggagtgcagtggcacaatcgccactcaccgcaacctccacctcccaggttcgagtgattctcctgcctcagcttcctgactagctgggattacaggtgtgcgccactacgcccagctgatttttgcatttttagtagagatggggtttcaccgtgttggccaggctattctcaaactcctgaccttgggtgatctgcccgcctcagcctcccaaagtgctgggattacaggcatgagccaccgcacctggccagagggaatttaacatagggaataaatagtcccataggtattagaggactgaagacgtaaaaaggggatatcccagcaacacagagatagtagctgcagggaacatttcccacacctaggactagagaagaaggggaagcgggtgggactgatagaacttagaggttcagggaagaggcctcgaagagctgagcctcagacttcaagaagggaccgcggcccagatggggccaggacctctgagcttggaggaagcatgcactagagggaaccttgaagccggtaggagaggcgtcctgctccttcctgtttgctggttgtccctgtttgtggcatccacagtggttcttcaccctggcagtggtgactggtttcatttctttttttctgcactcccagaacaaggctcatcatgcctcctactggcagaacctaacaggaagctgcaggggaagaaggtggtttccagcatctcagcaggaacctggaagctgagcgtaggagggtgggtttggagctgagacaatacctcataaccagcacaccacctgactgcaggaattgccagaaattcaagtgccattgtttccagagtatcctgatgtgtgacttttttccccgtcaggaattcccagcatctgacggtttgttggaattttgtttggtttctgttttgtttgcgtacatttcattcatttaagtcgtattcttttttttttttttttgagatgcagtctggctctgttgcccaggttggagtatgggtggtgcaatctcagctcactgcaatctccgcctcccgggttcaagcaattctcgtgcctcagcctcccaaacagctgggattacaggaacctgccatcacacccggctaatttttgtgtttttagtagagacggggtttcaccatgttggccaggctggtctagaactccctacctcaggtgatccatccgcctcggcctcccaaagtgctgggattacaggcgtgagccactgcgcccggcccatattcttttattaaaggttaatttcctagtttataccagtgtctatttcaccatatacttgtcatcaccgggtgctcctttctttttaagctaaaaatactctttggcaccagttgtgggtctctagcaaagcagaaactgccacttcgtggttcctttccacctttctacctgtatttctttttttttctatttctttttttcttgatacagggtcaaaaaaggctagagtgcagtggcacgatcacagctcattgcagccttgacctctcaggctcaagtgatcctcccacctcagcctcctgagtagctgggactataggcattcaccactacccctggctaatttttaaattttttatagtagggcctcactatgttgcctaggcggtctggaactcctgagctcaaggggctagcctcccaaagtgctgagattataggcatgagccacagtgctcagccttgtatttcaatctaagataccattacttataaaatgaaccattattttatataccactgataaaagaaaaacatttccaattaaactatgacacttttctaatcacttactttttaaaaagttactaaaagagcttttagatttagacatatttacacagatatgtttatttacttagaaaaatataagcaaaataggtcggggcagtggctcacgcctgtaatcccagcactttgggaagccgaggtgggtggatcacctgaggtcaggagttcgagaccagcctgaccaacatgatgaaatcccgtctctactaaaaatacaaaaatcagccggccgtggtggtgcctgcctgtaatcccagctactcatgaggctgaggcaggagaatcgcttgaacccaggaggcggaggttgcagtgagaagagattgcgccactgcactccagcctgggcaacagagtgagacttcatctcaaaaaaaaaaaagaaaagaaaagaaagaaaaatataggcaaaataaattgattcagggattcctaaaacttctttacatcctcatccttttgagtaacactttaactcagtcaacaacccatacttttctatgcaactttgtcctttgtgccatcaaacatgttggtgatacagcattaaaagaaaaacaaaaacaaaaaacaaaaattcagctgggcatggtggctcatgcctatagtcccagcactttgggaggccgaggcaggcagatcacttgagctcaggagttcgagaccagcctggccaacatggtaaaacctcatctatactaaaaatacaaaaatgagccaggcgtagtggcaggagcctgtaatccagctccttcggaggctgaggcaggagaatctcttgaacctggggggcggaggctgcagtgagccaagattgcgccactgaactccagtctgggtgacagagtgagaccctgtctcaaaacaaacaaacaaacaaacaaacaattcataaaagaaactaaaagccattggtctgggcccttaagcagactttgaaattatggagagctttcctgtttttaaaagcctctcaaactttcccttacttgctctccattcaattcaggggttaaaaaaatgttctactactgtctctggggtttcctctgaggttgctgatgccccttctttttaattgcatttttatttttctaacacctacctcttacacagaaatgatgccccttctgcatgttttgatgccggcacaggtgtaagcaatgagaactatgccatacctgcctccttgccaacagttgataaccacagacaggaagacactgatttcagggatgagaagaaacaggtgtcttagaaacacggtactctccactcatcctctggaatccttctataaccttcagtccctgtattctctgggtccacacatgccttcaagagctatgtcagcctccttgaggcttgagggggaaaaagtcactctgcttttctcttctctcattaaaaacaacaaaaactagacttccaaagcattaaacatgtagggagcttagagacgctgtccaggatgagctgaccaaagcagaagcaaggctgtttgtgacttcagcatttcccccaattagccactgcaaagccacctcccagcacttggtccaaccttaatcaacaaccactgtttcctttgccttctggacagtttcctggatagactgacgtcagtctggctctatgttcaaagttagaaaataaaagtagtttgttgcaataagggctaagattttaagatatagcataagaaatactgagttccagtccagactctgttcacttcaaagcagtggctcacacctgtaatcacacctgtaatcccagctctttgaaaggctgaggtgagtgtattaccagagttgaggagttctagaccagcctggccaacatggtgaaaccctgtttccactaaaaaacacaaaaaagttagcccggagtggtggtgcatgcctgcagtcccagctacttggaaggctgaggcgagaggattgcttgaacccagaaggcagaggttgcagtgagctgagattgtgccactgcattccagcctggctgacagagtgaaactctgttgcaaaaaaaaaaaaaaaaaagaaaagaagaaaagctagggcaaattgtaccacttctctatttctttttaattttttatttttttgaaatgtggggtcttgctatgttgcccacactggccttgaactcctgggctcaagcaatcctcctgcctcagccttccaaagtgctaggattacaggtgtgagctatcatttctggcggcaaatatttttatctcatttacctgatcatttagaaatgtatctccaggtcttgagataacatttgcattgaaaattctcagtttctcagttttaggcattctctattgagttcccacaaggaaagatgatttagcttcttctctcccccaattcctcccaccatcccctatcacatacccaatacctttctcattacccccaatagagttaaaatctctttttagtaaacattcagtgttcatataattaagactatgtcaatcctattcacaactctgataacattttggttctcagttttccttacttttcatttccctgcagttaataattatttgcttagttttctatgtacttataccatttcatcaaagagctgctattccaattcctcaaaatttgatgtttaaaggcataagatttagtcaaaaccttgttcattgaaatattgtccctaggccgggcacagtggctgacacctatgatcccagcagtttgggagaccaaggcgggtggatcacctgaggtcaggagttcgagaccagcctggccaacatagtgaaaccccttctctactaaaaatccaaaaattagcctgtaatcccagctactcgggaggctaaggcacgagaattgcttgaacccaggaggcagagttgcagtgagcagagaattgcagcactgcactccagcctgggcaacagaacaagactgtgtctcaaaaaaaaaaaaaaaaaagaaaagaaaagaaaaaagaaaagaaaaaaagaaatgttgtccctaatagtgaaaaagtcaaagcaaacctcaaaaagaatacagctgattaataagtattgatacatatacaaaactgagccttcaatttctgtcattatatctacctgtaactctatcatattttagaatgagcatgcacttttgtaatcagaatataagaacatttataaagtaataggagaaaagtaacctgaatcatattaggttggtgcaaaagtaattccggttttttgtcattacttttaatggcaaaagccgcaatgacttttgcatcaacctattactattttttttgcagttatttatacgaccaatcggatttttaaaaacaattttatttagttgctgggaacaagtctgattttcttttctcctcagctatacaaggttggcttgtagggcaatcatcttagatatgtctgaagagattcgaatttgaaagaaggaaaaccagaagtttcatacttctaaaggaaaacgttttcagaaaatgagtgaaaaggagtgactacaaaggaagcattcgcttatctcaaagcaaatactaaattacagattcctctcagcgctctactggtgaaaaaatttaaaaataaataaataaattacagacagtaacatgcttccatttcatcccgacagcttcaggatggcgcagtctccaatgggacaaacccagggaggcgtgactcggccacagcgcgttctgggaaggccgcttaaccaatcagcgccttggtttccaggggtcaggtctgcataaaaatgctgccctttccgttcctatagtggtgtgatgcagaaacgccgcgacagaatggggttatctacattaacagcgcgcggccttccaggctcctaaatggactttcacaaacaccctccatcaggccaggcccgcgggtgtgacccgggcagacacaggctgcccccacacttctggactctgtgtcagggcgcacacgctgacagcatggctaactttctgggggccggggacatctgggagaagcagaatgaaacagaagatcgattccctaggtcctaggagatgaaacgccacctttgcgggttcgcgagtccttaggatcaaagctgggctccccagggccggggccgctcgccccacatcctcattccagtccccatccccaccctatccccgactctgccccaggcccaggcgggaaccacgcaccgaaacgagcgggacgcgcaggcgatccccttgcagccggttgaaggcggggaacgtgctccaggcgaggaacccgtcgctttcgggtccgagcagggccacgagcagcacctggtgttggaagcgcacggtcggctgctcctcgtagctgctccgcttcagccaaaaccctgagttaaagagggcggtagggaggcggttagggaggccggccctggccgagcgcgcccggggagcctcgtggcacagcggccggggcaggctcaccgtggctccggaaggccaccagcagcggcgggatgtacgtgagcgcagcggccagcagcaggaacagcgcggctttggagcagagccccgcgcggtaactgcgctcgaccgggtgagagaagagctcatagagcgccatgagcaccgctcgcaggcactccgcgagcc

SEQ ID NO: 1386 - DNA, 18157 bp, Homo sapiens; identical to SEQ ID NO: 1383

SEQ ID NO: 1387 - DNA, 9105 bp, Homo sapiens
gccaaagaaaccaaaccttttattcactttaattcaattaaatttactgagcaagggcttactcaataaaatcaacaatgaaaaggccagctggccaggcaccgtagctcaggcctgtagtcccagcactttgggatgccaaggcaggcagatcgcctgatgttaggagttcgagacagcctggccaacatggtgaaaccctgcctctactaaaaatacaaaaattaggctgggcgcggtggctcatgcctgtaatcccagcactttgggaggccgaggcgggtggataacgaagtcaggagatcgagaccatcctagccaacatggtgaaaccccgcctctactaaaatacaaaaaaactagtccgggtgtggtggccgggcgcctgtagtcccagctactcgggaggctgaggtaggggaatcacttgaacccgggaggcggaggttgcagtgagccgagattgcatcactgcactccagcctgggcgacagagcaagactccgtctcagaaaaaaaaaaaaaaaaaaattagccagactcctgtaattttaactactcgggaggttgaggcaggagaatcacttgtacccgggaggcagaagtttcagtgagccgagatcgctccactgcactctagcctgggtgacagagagagacactgtctcaaagaaaaaaagaaagaaattaaaggccagccataggtgtttctgcaggtctacttgcccgtgccccatttataattttgcaccaggaagaccgcaggggagtctggcagatgtgaggtacagtcttagccctgtgtcttccccactgtgtgccctcaggcaagttaacaagcttctctgagcctcggtttcctcacaggaagcgtcggggataacacagtatctcccccatagcattgtgaggttggaaaggaggccctcagctcttaatcttctgctggtccacgcgggtttctgccagggcacccctgttgacaggtttctcctccctgtgagagcccaggtgttgagtcaggcgtgggagctgggcaaaggcgtcccgaactgtctgcatgcgtcctctggtgtcggatgagcgcggaggagaagctgaaggccttcccgcagccgctgcactcgtagggcttctccccggtgtgcacgatgtggtgctggatcaggtaggagcggttgctgaaggccttgccgcactcggggcaggtgtagggccgctcgcccgtgtgcgtgcgctggtgcagggcgagcgaggagccctggctgaaagctttgccgcactcgccgcacttgtagggccgctctccggtgtggatcttctggtgctctataagcgaggacacgtggctgaaggcggccccgcattgcaggcacctgtagggccgctcaccggtgtgcacgaggcggtgctggaggaggtgggagcggttgctgaagcgcttgccgcagtcgtggcaggggtaaggccgctctccggtgtgcgtgcgctggtgctgcgtcaggtgcgacacctgggtgaaggccttggcgcactggccgcacgcgtagggcttctcgcctgtgtggatgcgccggtgctcggccagagaggcgctctggctgaagagcgcgccgcagtcctggcacgtgtagggcttctcgcccgtgtgcacgcgccggtgctgggtcaggtgcgcgatctgcgcgaaggccttggcgcactggccgcagcggtagggcttctcctccgtgtggatgcgctggtggcggatgagcgctgaggagaagcggaaggccttggcgcacgcggagcactcgtagggcttctcaccggtgtggatgcgctggtgctctatcagggacgagcggttgcggaacgccttggcgcactgggcgcacgcgtagggccgctcgcccgtgtgcacgcgccggtgctgggtcaggtgcgtgacgcgcgtgaaggccttgccgcagtcggcgcagcggtgcggcttctcgcccgtgtgcgtgcgccagtgggacgccaggtacgagccctggctgaaggccttgccgcactcgtggcaggcgtagggcttctcgcccgtgtgcgtgcgctggtgcagggtcaggtgcacgctctggctgaaggccttgccgcactcggggcacgcaaatggcttctccccggtgtggattctctggtgtaagatgaacgctgaacagtagctgaaggccttcccgcagtccccgcatttccacggcttcttggggcctccacctctctcccgctggcggctgtcaggatgcctctccttcgggctctccccaggcgcgctgcacctccgggaactgctgtcgtcggggacactggcttgggtagcagcagggctcgatatggttcttgggattcggctgaattcatcgcgttcctgcatgctgtccccagcagggtctcccttgcaggccacggcctctggctctggacagctttcctggttttcctgcaggtcctcaacctggccctcgtgtttccagtttccttccaactctgcgccctggagggcgacgctcaagagtccctccatcctcgatccctgggctgctgtcttgatctcacatcttttctctgggtctgaaaagaaaaagatagaaaaaaaaattaaatgttgccacttgtcctgagctggaaaaatggctaacagctgaactggtaagaacttagcatggggtccctggacctctgtgccaatgacattttgggtccaataatttggtgtggtgggacccatcctgtgtgttgtgagatgttgagcagcgtccctggtctctccacactggctgccagggacactacccctcaacccctgagttgtaacaatgaaaaatgtctccaggccggacgtggtggctcatgcctgcaatcccagcactttgggaggccaaggcaggtggttgcttgagcccaggagtttgagaccagcaaactgtctgctgcctgggcaacacagcaagatctcatttctacaaatgaaaaaaaaaattagccaggcatgatgttgtgcacccgtggtcccagctactcaggaggctgaggcaagaggatcagctgagctcagaaggttgaagctgcagtgagtagtgatcacactactgcactctagcctgggtgacagtgtgagaccctgtctgaattttctttaaaaagtctccagacactgccaggtgtcccctcccctggggacaaaattgcccccagttgggaatcactgacttaatggaactaaaaacaaatttaaaagatccctgaaaaagaaaaaaaaagcatgaatctgtcagctcttaaaatatggccctgtaatctggtgctgtgaactgaattgtgccccctcaaaatttatacatggaagccctaactcccaaggtgatgctttgtggagatggagcctttgggaggtgattagctttagagggggtcatgagggtggggcccccacaatgggactgttttattttttttttgacatggagtcttgctctgttgcccaggctggagcacagtcttggctcactgcaacctccgcctcccgggttcaagcaattcttctgcctcagcctcctgagtagttgggactacaggtgcacgccaccatgcccggctaatttttgtatttttagtagagagggggtttcaccatattggccaggctggtctcaaactcctgacctcaggtgacccacccaccttggcctcccaaagtgctgggattacaggcgtgagccaccgcgcttggctgggactaatgttttgataagaagaggaagcgacaccagagctcgctgtctgtcaggtgaacacatggcaagaaggcagccgtctgcaagccaggaagtgagtcctcagtgtggtctgaccatgctggcactctgatctcagactcccagcctctagcactgtgaagaaataagtgtttattgcttcagccacctaatctgtgattttttttgtaagctggagctaagataactggaaagacagttttcttttctggggaaaaatcagttgaaactttaattcccagtgtgacagcgtttgatgtggggcctttggaggatgattaggtcatgagggcatcctccttaataggattagcgtccttataagaggagacaccagggggctcacttactctctgctctctctgtcctctctgcgtgtgaggacacagggagaaggcggccatctgtaaaccaggaagagagccctcaccagacagaatcagccaacagtgatcccagatttcacattatggggacactattcaactcactatgctccccttctacagggctccatcagtgaaggagctgcccagggtctcccaggctcagaggttcatgctggctcgtgggcccagggtcgttagagatggtgatctcaagctattgcaggttaccctgtctgctttgcacattttcagtggaaagcagggatctgtttttatatgagcccaggaagtcactgttttttagaaagccataacagaagccatacatatagttacttctagtggggctgtgatgctgaaggatttataccaattgcctggtgtacactggacctgcacgctggcgagaaactcaccactgacttctgatgctttagttctaacagaatgggaagacagatggacaaatgacctcctggtgctgagagagggaaggaggcagctgcctgtggatccactgtgctggggctagccccagaggagggggctcacactgctgggaggtcctttccaggctgtgtggctgcaggtaagtggctacctgctctgaggctctgcctggttttctctctctaaacagggctccagcctccccttctcccgagggacatggcaggtctctcagcaagcttggcctcatgttatgtgtgggctcagcccctcacacacaggcattccctgaaccaactagtaggctgtgtgcatacagcagagagtgctcggcctttggctcctccgggtacactcctgctgctgctggacaggctacgtctgaagcttgtcctccccacttcctgtgtgagatcctaaccctttgtggtggtgctaggaggtggggcctctgggaggtgatgatgacatgaggctggagccctcaggcgttggattcctgcccttataaaagaggacccagaaggctcccttgccccttcctccaaatgaagacacaacaagagggcccggtctatgaactaggaagcagccctcaccagacaccaaacctgccggcaccttgaccttggacttccagcccctagaactgtgtggaaataaatgctgtttctttctttctttctttttttgtttttttgtttgtttgttttgttttgtttttgagataagagtttcgctcttggtgcccaggctggagtgcagtggcacaatgttggctcactgcaaccttcaccttccgggttcaagcgattctcctgcctcagcctcctgcatagctgggattacaggcatgcgctaccatgttcagctaattttttgtatttagtagagatgaggtttcaccatattagtcaggctggtctcaaactcctgtcctcagatgatccacccaccttggcctcccaaagtgctgggattacaggcatgtgccactgtgcccggccaataaatgctgtttctaagccaccagagtatggcattccgtcacaccccaaaggacctaaaatagggctttttttttttttttttttgagacagggtcttgctctgttgctcaggctggagtgcagtgttgcaatcatagctcgctgcagcctgggaatcctggctcaagtgatcctctcacctcagcctcccaaagggcttggatcacaggcaggcaccaccaaccacacctggtcaagacagggcttttgtgtgggctattctttctgcctgacatgctcttcccgcagcgtgtgcctcagcaagaggacaagaggagaccctgagggagtgatgatgtttgtgttcagggtggagaacacagcaagtgcaaaggtcccagggcaggatggtgacaagggtggcagaggaaaggtaaagggggtggggctggacagagcaactgaggtgcaaggcaggggagatgcggtagagtggggtgggggtcagctcacacaggaagtcacgtgtgctggtaagaacttgctggtgggggccaggctgggtcggctcaggtgccacgtccaccggcatccccggagtgtgcaggggtacccacctcgtgtgtagggggagggcaggtgggttcacagcggggttgggtaaacctgggtgttgtgcacacacaaaggagcccaaggggagacacaggcttgcttgggggcagtagaagaaagctgtctactcccagcacttctgacacgtgggctttctccacaccaacaaccaagtctccaatctgctctgactgggaggcacaggcagctaccaaccataaaactgcctcaacccctccttgggtttggtgatttgctcacatagctcattgaactcagggacatgctttatttacggttactggtttccaataaaggatacaactcaggaacagccagatggaagacacacagggtaaggtataaggaggagctcagagcaccatgccctctctgggtgctcgacagccccagagctcggcaaaccctaagtttagggtggttatgggggttccatgacacgggcgtgactgacataggtgtgatgacactggccatcggtgatgaactcaacttccagccctctcccctcccaggaggtaggggctggctgaaggctggaatgctcatcagggctagctcccgtggcaaccagcccatcctaggggcctatcaggagtcctccattagcataaatgtacttgggggtctaccaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggtctaccaggagtcctccattagcataaatgtacttgggggcctatcaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggcctatcaggagtcctccattagcataaacacaggtgtggttgcagggggcttattaagagttgcagaagacactccttctacccctgtcactcaggaaattccaagggttttaggggctctggtaccaggagctggggataaagattaaacatatatttcttattatatcacaagatcacaggaagacacatgcattacatcacactctgacacacacagggtcatacacaatcatacctgcccagacacacacagacatgcagagacacccaaacccatatccagggacacacagtcgccctcctaacccccatgcaaggaggcaggtgggaagccatcacctgcagccacactcacacatgcacacagggtcccgggcacacgtagctacacacacacccagccccacacgtagctccctgtgtgaagaggtgcacagagacgcacaaggtcacacatgccacctgctccacacaggccggccattactgggacacacccacaggggatggctggacacatgtgcagtcacactcggtggatagagctccagcatagccaaagcccacatgtgcagcgtctccatcatgtgcagatgcacacacttcagacagcacggcactctacaggctcgcacagccaggtcacccatcattgtgctggcaggcacacgggccgagccagcctacacggcggcacacccagacatgcacacgtggggtcacacacctcacatccaggagaactttcagacttgcccaaaggcagccacacgtgtatgtgacatgctgtgatatgcagacaccgcttcacatgaacgagcacataacacaccgataaagtgttacatgcctttacctgcagtcacctgcctgggctggcaccactgagtgagcaggtgcagacacagtgacactcggggacgggctcacaggcagtcacacacctgcaaggcctggcaccgccgagtgagcaggtacagacacagtgatgggctggcaccgccaagtgagcaggggcagacgctgtgacactcagggacgggctcacaggcagtcacacacctgcacctgctggtaccgtcgagtgagcaggtgcagacgctgtgacactcagggacaggctcacagccagtcacacacctgcacggcctggcaccgccaagtgagcaggtacagacacagtgacgggctggcaccgccgagtaagcaggtgcagatgcagtgacaggctcacaggcagtcacacacctgcacctgctggtaccgtcgagtgaccaggtgcagacgctgtgttactcagggacgggctcacaggcagtcacacacctatacgggctgacaccgctaagtgaacaggtgcagacacaatggcactcggggacgggctcacacgcggtcacacacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcacc

SEQ ID NO: 1388 - DNA, 66171 bp, Homo sapiens
tttaccacactttgatgaatgttcaagttgttaacaaggtggggctagtgaaaggccttctcacactcacaacactctaggaggaagccaataatgttgagaaaagtgtgtgctgtgactaaaggtttctcaacagtgatcgcactcaacagttttctcttgagaatggagttgataatgttgagtgaggtatgagggtcggccgaaacatttcccacatagctgacactggtaaggcctctcttgagtgtgagttctataatgctgaatgagatatgaattccgactgaagactctgccacagtcacaacactggcaggctctctctccaacgtagtcatgtttccgctgataacgaattaagtatgtcttgctgtgggacaacccaggaggaaggactcttgctgcctcatgggctttgagatgttgaagaagatgcacattctggagaaaagctttgccgcactgaaaacattcaaagtagtcctcctgactgtgaattcttacacgttcacagagattcgcacactggacggaaggctttctaccttcattgcagccagaagtcttcctaccagaatgggtcttctgatgtctgttgaggtgtggcatgagatagaaggcttcagcacactgtttacattcatagggtttcttcccagtatggatccgttcgtgtctcctaagggctacttgcgtactaaaggttcgtttgcaaaattcacatctgttgtgtttgttctcttgggatgctgactggggactcgtacatattccaggagcagtgccttcctggggatcctttcctagaggatcctttgattgtttactaagattagagcttctctcaaattcatcactgccatagcttctttccggagtgagggtcttggggtcattcattgttataggagtcaaaagtttctcttggttgccctggtgtggttccaatggatcatcatgagactctcctgcagagacaatgccagaagttacctaccgcccaattatccaatcctgccccccaataatgatatttctataggcaggctttgccctggagttagtgctttggtttcaggtctcttttcctaatctgaaaaaaaaaaagtaaaaattcctctattctttttactcagagagacataccaatataatagaaataaagagaccaaggataacaaacagatcttatggaggttgagagagttttctgaaaacctaaagagaaaatggaaaaaggatagaaaggacagtaagtggccgggcacagtggctcatacctgtaatcccagcaccttgggaggccgagatgggcggatcacaaggtcaagagattgagatcattctggccaacatggtgaaaccctgtctctactaaaaatacaaaaaattaactgggcatggtggcgcgtgcctgtagtcccaactactcaggaggatgaggcaggagaatcgcttgaacccgggaggtggaggttgcagtgagcagagatcgcaccactgcactgcagcctggatgacagagtgagactctgtctcaaaaaaaaaaaaaaaaaaaaaaggaaaagacagtaagcaaggaagagtgaggaagaaacagaaaaaatatcatctaggaggatggcgtgtcaaaaagatgccacaattgtacagagtagaatgagcagaaatcagagaaagagctggggttggggtttgtcagcattttccaaaccatgtttggcagatcgctaatattctgaaaaacaaatagctgttaccatgaagggggctccactgtcaagttaatttgggaaatgttgtatgacacaaatcaagcaggtttcattcctgtaggattcagaacttttaatatgcaccttgaaccctaaagagggaaggtacagaatgtggcatttcttaaagtgatcttgctatgaaacattttttttagaacatctattactatggttcttcaggactactgaggaaacactggagcaaacaggtcaacaacctcttgttcagaattaaacaaagattctcctttcttagctctgaatctcttgttttaccccaatctacactgtcaaccaatcctctttaattcaatatttattaaatgcctgttttgtgcaaggcattatctaaccagatgggtcagaggtctgtaaaagggactctaatcagactgtaagtgacgacaggagcagagatgggggaactgactccacttaggaacagaaaatgattagtggaggggacagcatttggcgtcagtaaacggggaaggggggcgagtttatataaaacagcctgagttaagctatagaactgtgaaaatatacagtcctggggagctagaaacacaggatcttagttgcaagatctgtagatgaggctgggatgcaaatttcaggccagaatgggaggaacttcagtgttttgctaaaagtttgaattttatcttgacggaggtaagaagctgataaaaagtctgtgctttataaaggcaactctctggttggaaaaatactgaagccaaggaagtcaagtataagactgtggtttggaagagaggtgatgaacacagtggttgcatcctggcagacacttgaagtatgtgaacagagtacaggtaaaacagcagagccagaacatggcttaggaagtcatcaggaaaagagggatagctgggcccatcacaatggattgactcttttaggaagtggtctttgaagagaacactcaagaacggaagagtaagagaacacctagtcctcactggctcttctgttttccttaccctgctgtatatccaatatttcagcatgttctgtcagttcttctttcagggaatacctccaacctgacccctctacaaccacggcctcagcctccatcatctttagcctggtggacttcaatggcctcttgaactggtttctctggcttttcctcttaaagcccgttctccataggacagccagatggatctttctagaatagcactgcccagtagaactcccagtgatgatggaaatggtctacatttttgctgtccagcacagtagccattagccacatgttgctatcaaatacttgcaatgtggcttgtgtgactgaggaactaaattttaaattttatgtaattcttactagtgtaaatgtaagtagccacatgtgcctactgtctagcatattggacagcaaagttctaaaatatcaataacactacttcatgcccctgctcaaaacctccccccatctttgcatctcacttataataaaattctttaacatattcctaagcgggctggcccttgactatctctgtgatctcatcttctatcttccacttaactcagaccatattgcccttcctactgtttttggaacacccaagctcattccaatctcagggccctggcacttgctgttcgctctgcctgtaacactcttcctcaagatttctacattggtcagccccccatctcattcaagtcttccacagtgaggccttctctgactattccatctcaagcaacctcccatatctcattctctatccactttacgctccgttattatttgtctattttttaaaactactgcccccattagaatgcaagctctatgaaggaagagatttgtctgtcttattcattattgtatccacagatactaggacagtatctggcccaccacagaagcctgataaatatctatgagatgactgaataatgaagaaaccagagtagggaaagaaaagaagacaatgaaagaaacagagaggagtcttcctggtaacttcttgaattttgtttggacatccacttttccactcacacagacaaacgtggaggagggctgtgtcaatcagcactgtactggacacagctgctagttcaggaaagggatataacccgatatggaacaatgaaaaatcaggagagctggaaaagatgcttcctctctcttgagaatgcttcttggacacaccagctctttcttgctccttttttgtacaggaacaaaaaaatgcatctaggatttattgtcagagtcgaaggcagagtagaaggagaaaatgaaactaggtcttcgatgacttcactgggtccctgaatacagcccagctgatcagtattataggctaataatccctctatgactttagccagtttgggtgtgggttttctgttaactacaactgaaggacaacagtgatccagccgctgcacatggtgacccatttcatgaagatggtaagcgttattagactgtagccatagagtttggaggaggtgaagtctatggttccagaactataaggacgctagtgggaaccttttgtggaagtttcagaaaagagcgtatatgtgtgtctgagttggcataagtagggggatggaaaccagagggtggggattaagaagaaaagggaagggagcgtctaggtgtcaacaagtctgaggagctgatgtgagggaaagtgggagggcagtgagaaagacaagtggtatcaggccaggattttttgtttgtctcagttaaagaggagagatgtatgatgtttagctgcaaggagaaaggcatgagtggacggaagggctggaacacgagggtgaaaggacactggcctccctggagctaagcaggagaggagctcatgctgcatgaagagatgggcttcagaaaggagaccaaggggagtactgaggagaaagggcacctaccagacttctcctggcccaggggactttgaggaaagctctctgactagcatttactggttccccctcctacaccccgggcttccccctcactactcaccttgacaaatcactgtatgtctgctgtctgtctccattgcatatgattcctcctcttccaggcgtgagataatgtcaggtttagagaactggtgccctgttggagaggaagactgagaactcagggtttcagtaactcccaaccttaggtcccaaagactctggaataataaggaaggaacaaactctcgcaggagtaaaatgaagcctgtttccagcctacagagattttaccccctaagggacatctaaaatgtatggagatatctttggttgtcataactgtgggagcagagggaggggttcctagtgtctagtatggctggaggcagggacactgctcaacattctgcaagacagccccacaacccgggacgatctggttccatgtcaagagtgccaaggttgaacaaccctgctatgaagactaaaaagggggcatgagggcagtgtgctgagctctacacttcagcaccaagaatctgacatagctgctcaaaaagtcaacattatggttcttttccctcctgggataacgtccactgcccctttgtcttgaagtgctgctcctccccctcccttagttccttgtttcccaaacttttatcatttgcataccaaattattatctatttgtttactgtctgactccactgaaatgtaacatccatgagaaggggaaatgtcatctattttgtaaccaaaatgcctataccaggccttgtatgtctgaattcactgacgagttaatgaatgacccttgcattttggcatttctacgtgccatttatagtcatattcagtatttatttaatgtttttctttagatcacctttctttttaacttagatatgcttattttcttttttctttttttttttttttgagacagagtctcactctgtctcccaggctagagtgcagtggcacgatcttggcttactgcagcctctgcctcccagatgcaagtgattcttctgcctcagcctcctgagtagctgggaatacaggcgcccgccaccatacccagctaatttttcgtagttttagtagagacggggtttcaccatgttggccaggctggtctcaaactcctgacctcaaatgaaccacctgcctcagcctcccaaagtgttgggattacaggcgtgagccactgcgcctggccaatacgcttattttcaatggaagctttatatcaaccctataaatggaaaccaatgtcactcacacacacacacaaaaatggaaggtaacatcatgataaatataacagaaactaaggttattgagtgctagctagcttctgttgcctatctaacattcagggtttgatgtctgctctcactttactaaaatggaagaataacaagatagacatgctaacaccaaactgatattctctacgtgataccatcagaaggcttaaaggaaaattgaagaacttctttttcaccaacagattgaaggattatgtcatgctgtccatgtactgcctaaaataatcttctatttagcccactgtactcattccacacttaggaagacaatgtcccaggtgatatataagatctctattaacacaaaaccttcagtgttaaagaagccaagggctcacaagatagaaatgctccaggtcactgcatgagagctggaatgatacaattaatttatttcctctattttgatactattccctctattttaagtcataaaatgtggtaagctagagaagagtgtaaaatatgctggaaaatgtacttccttgtaaccgataagaaccagagttaaacatatgcatccctgtgctaggtttggggtaggatgtgtgttttcccactaggtccctgacttgccagtggaacagtgtttgttttggattctgtttttcaggagacctcaagcccccaaaaaagccactgaaaaaggagcttggcactggcaacgtaaacttttcacttttcactttcaactttacctgtgagaacaggtaaaacaattttgcctccgcacgtaaagagagattggcaatctctgtttcttcaaactcaagccagtagaagtctttggagctcctggaatttttagcaattccttcgctcattcagtaaacatcattttgagccttccattgtgctgagaactggtggagcaaacccctgtctggtagcacatcagagtttaaaagagcagattctggagtctgcttggggttaaatcccagctttcgacaagtactttagcctttcaatgactcaggttcctcaaagttaaaaatgtcaataataacaacaacaataagtatacctccccctcacaggcctagtgtgaggattaaaggagttgaaatatgctaaacacttacacaagtgcctgacacatatgtcgtgctcaagaaatgttagctatgttataattaacagtgaatttgatattcaaatattaaaatattgcctctgacctgggttgagactcactgacatggtgaaccaccattactgatgagaggacacgaaggagttgagagctactgccctagtgggaagaaaccaagtcctgtggagaaggcatacttacccagggagaccaggttccggtaattctccagcatcacctccctgtagaggtttctctgagcagcactaagggaactaagttcctctgggctgaagtccacaagcacatcctcgaaggtcaccaactcctcaaacaccagaaatgttcctaagtgtttgaagtccgggaactatcccagagagaggagaagggacgtgattagagaggactgaacatgatgcaggcattcagaccagcagagagcttccacgtgctctaatccagagccacaggcacctggcattgcatctttctttgtcttatcgagtctgagagaagtgggaacattactgaaacagttcctattgctaattactacagatttgggttgagggggaaatatccttttaagccactttataaagacagaatgcaagcatgcaaatacttaaaagctcagcagtatacctcagcctcaggaatcagagtcctggctctggttctttgtgagtttgggtaggttaagcctcagggtcccacctgtaaaacaaagtgctcataacatgaagaaatattcaatcttgttaataaacaaggagatgaaaatcaaaatgacaaaataccattttatacccattcaattaagtattgggtaaaaattaagtaattgagtgaaaattaagaagtgggacaataccaactattatataaaacatggatccactggcgatgctaagggaaatgtaaattagaaaatcacttttgatccagaaattctttttttaatttttaaaaatttttgtgggtacatagtacttgtatatacttacggggtacatgagatgctttgatacaggcaggcaatgtggaataagcacatcgtggggaatggggtatccatccccttaggcatttatcctttgagttacaaaggataataaagagttacactctttattttaaaatgtacaattaagttattattgactatagactccctattgtgctatcaatagtaggtcttattcattctttctactttttttttgtacttgctaaccatctccacctccctccagccccccaactacccttcccagcctctgagaaccacccttctaatctctatttgaccccaaaattctattcctaggtatatttactcatgtgtacttaaagacatggatgggcatgtttattatagcatgtttggaacatccaaaatctggaaataacccaaacattcattaacagtagaagagataaatatagtatagccatacaatgaaatagtattctagcaatagaaatcaattaactacagttatatacaacaatcttagtagcctaaggttgaatttaaaaggcagataccatatacccaaaggaaaataagctgtcctaccaaaaagacacatgcactcatatgttcatcacagcactgttcacagaagcaaagacatggaatcaacccaagtgcccatctacagtgaactggataaagaaaatgaggtgtgtatacaccattgaatactatgcagccaaaaaaagaacaaaatcgtgtcctctgcagcaaccggaatgcaaccggaaacctcagatgcaacgggaaaccattatcctaagcgaactaacgcagaaacagaaaaccaaataccacgtgttctcacttattagtgggagctaaacactgggtatacatggtcattaaaatgggacaacagacactagggaatacaagaggaggcagggagggaggagaataaggattggaaaaggccatttattgggtactatgcttactatctgaggtgacatactcattcatgctccaaatcttagcattgtgcaatacacctttgtaacaaacctgcacatgtgtgccctgattctaaaataaaagtgaaaaaaaaagatagactgacctcttcaaatctaacattatcctgaggcaataggatacttaccttccttagcaaatctgaatatagaaaattgtaacacgtgtaagaaaatgcataggatctccccactcaaatatgctaatccaataagtctttataaacagttaatgacaaaaattgaaaattaaaacttactagccattttgctcaaaatgttgtagcagttaatgatttttctgtctgtttccagtcatactttggcaataaaaaaaatgattcaaaaccaaaggtacattgttgttaggctgaggtcttaacctggcaatcacagattcttaaggctgagctttgtagtgcatgtgcacctttctggaagataaaaattccgtttctcaaaggagtctgtgactcaaaatatttagcatagagagcaatctcagtttttcataaccttttttcttgtgctttattttacttaatacagttaatatgctacaataccttgaatataatggataatcaatattattatattaaaaaaagattgttaaaagagaaatgttacctgattcagtataagaaaattgaatttagttgtagaaaaggtatctatttcaagtaagaatcactgtatggtaggtcatgatttctcagtcacagtgtcatatttaaacgatggtggtcatgtggtagtcagagcatttttaagactgctatcttactgttcccaaatgttttcctactgttaactgtccattgaccctcctttcttttttccatctcatactctgtaactattagagaaaatcatgggaacaaacctacactggaataaggagttttgagttctgctattagctagttgtaaggcatgggttaattaatctctttgattctcattgtctcatctttaaaataaagagatccattacattatctctaaagtcatttacactctaaaattttataataaaacacataagatcccttgatactataaaaataaaaaggcagataccagaacattacataagactctgatatccattttattaatatacatcttttgtgttttaagtgaaactttctaaaactttttatgcaaatcaacaaacactggattaaattagggatcatatactggctgcccagctccttcagatgggtttatttggctcacgtggtcctattgttttttaaaaatttgtattagctgccaataccaaaaaaaaaaattaggaaatgtcattcttaactggttttgtggcttctgattaaaagcattagaaaatctggggactgggtccacattctcacatggcaccatcagcaaaagctgagtcacagctgcccctatatatgggacaggcactccccctgtttctcataatccacccagaccaattccttatttatattcccttggtagtccctccagggcatctttgcttggaatccctggcacagacaaggtagggacagagggctactctcaggagcagatattctagaacagtgtttctcaaccttttttccttacctcgctccccccaccccagtaatctttatacgtcattttttctaatcacaacccccatgaatttttttctggttctaaagaaagcagagtatattaatttcattattgtcttttaggtttctaaaacatgacttaacaagaacactggagaacatttttgaaacaaaaaatcagaaaacctcataacagtatcatgtccctataagagctgccatttgttaaaggcctacaataagccacaccctttgtgtgggtagaaggggttgtcttcatttacactattttcattgttgcaaagtacattccagcccttgacatggatatactttttcaaacaattataaattagcattgattcacatacacaggtattggatggttccaattttaatgtgcacacaaatcacctggggatcttgttaaacacagattctaattcagttggtggaagtggggccacagatgctgtatgtctatttttttaaataacagctttattgagatttaatttacgtattataaaagtcacctaaagtatacaatttaatgagtttttaagcatattcacagagttgtgcaaccatcaccccaataaatttcagaacatttcatcgccccaaaagaaaccctgcaccttctagcagtcactctccatttccctccaacatcttcccacgccctaccccaagccctaggcaaccactaacatactttatgtctccatggatttgctgattctggatatttcataaaaatggaatcgcacggtaccccatacattttaatatcgcaaatatactgtgtatgtactgtatgtatgtctgtgctgtacacataagaagaatagtatgtgttcaccctcaagaaccaattttcttccccttgaaggcaatatcctccttaagaatgcgtgttccaggacatgactttcaaggaaaaggcccttttcaattgctctgtgactttttggcacccccatatggttctaagaacacttttttccctcaaacagagcctgacaccggtagacgttggtgaataaacaaacagatgatgacactaccagaatcatttgtataatcttgtacaacctgaaaaaagttttatgtttgatgatttcattaaactattattcattattttggaggaaatacatggtaggacataactacctttcctttttttaaaattctggactattctagcctatccatgcttcccagtggaccccattgtctcaaatccccaaatccaaaaatttagttgaaataggacggccagataaaattcagcatgcccagttaaatttgaatttcactaagttttaaggggctgagtttttttaaatctttgacaatttcattcatggatagtgtgttgggtgggaagagcactgggctggcagttcagagacctgggttcaagtactgtactgttttattgttttttgttttgttttgtttttcttgtttgttttttgagatagagtctcactctgttgcccaggctggagtgcagtggtgcaatctcagctccctgcaacctccacctcctgggttcaagcaattctcgtgcctcagcctcccaagtagctgggattacaggtgtgtgtcaccacgcccagctaatttttgtatttttagtagagatgcggtttcgcatgttggccaggctcgtcttcaactcctgacctaaggtgatccgcctgccttggcctcccaaagtgctggggttacaggtatgagccactgcacccggtctgtactgttatttaatttcattggacaagacaggtaacatctctgatctggaccttgatctataaatggtcattgtactttttgtatcatagggttttgtgaagaacaaattttgttatgtgtctattaaaaatcttttttggttttgtttttgttttttgagatggagtctcactctcactcaggctggagtgcagcgacatgatcttggctcactgcaacctctgcctcccaggttcaagtgagtctcccacctcagcctcccaagtagctgggattacaggcatgtgccaccacgcccagctaatttttgtatttttagtagagacggggtttcaccatgttggtcaggctggtctcgaactcctgacctcaggtgatcctcccaccttgggagggatattggcctgaaattttctttttttgttgtctctgccaggttttgctatcaggatgatgctggcctcataaaatgagcctctttttctattgtttggaatagtttcagaaggaatggtacaagctcctctttgtacctctggtagaattcggctgtcaatctgtctggtcctgggtttttttttttttttttttggttggtaggctattaattactgcctcaatttcagaacttgttattggtctattcagggattcgacttcttcctggtttagtcttgggagggtgtatgtgtccaggaatttatccatttcttctagattttctagtttatttgtgtagaggtgtttatagtattctctcatggtagtttgtatttctgtgggatcagtgatgatatcattttttattgtgtctttttgattttttattgtgtctatttgattcttctctcttttctcctttattagtctggtaagcagtctatctgttttgctgatcttttcaaaaaaccagctcctggagtcattgattttttttgaagggtttttttttttgtctgtatctccttcagttctgctctgatcttagttatttcttgtcttctgttaacttttgaatttgtttgctcttgcttctctagttattttaattgtgatgttagggtgtcaattttagatctttcctgctttctcctgtgggcatttagtgctataaatttccctgtaaacactgctttagctgtgtcccagagattctggtacgttgtgtctttgttctcattggtttcaaagaatttatttatttctgccttaatttcgttatttactgagtcattcgggagcaggttgttcagtttccatataatcgtgcggttttgagtgagtttcttaatcctgagttctaaattcttttccttaagaatgttgatattgacctccactctcttctggcttgtagggtttctgcagagagatctgctgttagtctgatgggcttccctttgtgggtaacccgacctttctctctgactgcacttaacattttttccttcattttaaccttggtgaatctgatgattatatgtgtcttggagttgctcttctcaaggagtatttttgtggtggtctctgtatttcctgaatttgcatgttggcctgtcttgctaggttggggaagttctcctggataatatcctgaagagtgttttccaacttgttttattctccccgtcactttcaggtacaccaatcaaacgtaggttttggtcttttcacatagtcccatatttcttggaggctttgttcatttcttttcattcttttctctctaatcttgttttcatgctttatttcattaaattgatctccagtctctgatatcctttcttctgcttgatcgattcgctattgatacttatgtatgcttcatgaagttctcatgctgtgtttttcagctccatcaggtcatttatgttcgtctctaaactggttattctagttagcaattcctctaaccttttttcaaggttcttagcttccttgcattgggttaaaacatgctcctttagcttggaggagtttggataaacaacagttttttacataagtatgtcttaaatatgaaacattgcatccttatgcaaaaaattgtctatctgaaattcaaacttcatagttatgctaaaaatttatttatacttatgctaaaaatttatttgtagttcatctaaaattcaaatttaatttggatgttgtgtatatttacttgctaaatccggccagccgaagttgcagtaactgcactaccttaggcagcaataactaagtggttatgaatgtggactctaaagccagactgcctgggttcatatctcaatcgtattatttaacagctgtgttacccttcagcatattatttagtctttctgcctccactccctcatatataaaaaggggaacaataataatgcaaaccacacaagggtttttctgaataaaatagaatactaaaaaaataagtaaacaattaattcaaaagacagaaaaaaaggaaaaatattaaatatatagtatgtgggatggtgataagtacaacagagaaaagtaaagcacggaaggaggataaaagagtcagaaggatttttcttggagaaataagaaaaaaaagaatcataagcaaatgtcagattagtcagaaaaaaggctcagtaaagtgatatttatataaaaacttaatggaaatgagtatgtggtttaattaaataaggaagtccacaaattaggaagataagatccccatatttgataaccatgtcagaggaaagcctgactcacctgggacccagcagatggcagattgtctaacatctctgtgttcctcttttctgcagggacagagtcctgagcaaggaaacctagaagggagagaggaataccatggaattgagtcctgtctggtagcactgacagacacagtggccagccaccctcatgccaccctgtcctgccatgggaaggaacagcagctctagagttcctatggtgagaaagtcagatatcatttctcaactcaaaataacaagttccaaaagagagctctggttatttcccagctctaaatgcttcaatggctcccactgccttccaaataaagtgaaagttccctccatatcagtcatttcgggcctcactgtccagtcaagatcaccacagaacctctgtttctcaactgtaaagcagaaataatgacaatacctatacagtagtccccacttatctgaggttttgttttctgcagtttcagttacccatggtcaattgggggtcaaaaatatttaatggaaaattccagaaataaataattcatatgttataaattgtgtgccattctggtgatgaaatctcacactttcctgctctgtcccacctgggacatgaatcatccctttgtccagtgtatccactctgtatacactaccccttagtcacttattagctgtcttggtcatcagatcaactatcacggtatcacagtgcttgtgttcatgtagaccttattttacttaataatgcccccaaagcacatgagtagtgatgctaacctactgttataattgttccattttataactagttgttaatatcgtactgtgcctaattaataaacttcgtcacagatatgtatgtagaggaaaagacatagtatatatagggtttgataatatccacactttcaagtgtgttagaatgtatgcccctcagataaggggagtatactatacctctaagggctcttgtgagaattaaacattacatatgtaaggcacacagtaggtatttttttggtaaatggcagctcttatgattaagcctttcctacatatttttcactcgttgatctaaaagacaaccacccctttccctccaggagccttaaccttgatggccttccttgcctatatattctcttttctcggtaaacccttcattaatctgttttttctttctggtaccctagggaactctctttccttctcactgaactctagcttcatcaataactcagtgcctctggccaagtttttagcctctgggacaacatccactatatccatatgaggcactcatgtaacacggtgattaagagtacagatgctgaagccagcagcctaagtctgaatcctgactgccaattattaatataagttgtggaaccatggtcaagttactcaacctctttatgcctctgtctcctggtctacgaaatgaaggtaatacctatttcacagagctattaatagaagaaaatgaattaacatgaaagaacacctatgataatacattaaaacattctaagtgctcaagtgttcactattagcattttaaaaattcttttaagtaatgtgggagcacagaatgggattaatcataatccttagttcatgatatgctatctttattgagccatgcatggctctcatggttattttaaattcatttgtttatatttttaagtataattaaggcctgtgaatgtactatccaacccaaaagtataacattcccaataacttacatctgcctgtgtgcttctttcatgtccatactcgagccttccctctagagataagtatgccctgaggtctggtgttagtattcattgttcccttgctatatatatgccccaaacaatactttgcttttagttagtattatttgtttcaaagcactataaggacccagtggctttcttctctcattcttgaaatgcctccttagctctaatctaataacttgagtttctaagataccagtcaaattttggcagaagttgaacttccagtctttgtatctcccacattttatgcccccttgcatctaaaatttagctaatcattcttgttcttgaatagaaagactaaataatgtaaagaccaattttcccaaatttacacttaatatattaatgccacaagcaatcccaggagttttttttttttttttgtagtgtgtctgtcttgttttatgttgcaactaaggtttacactggataagaaatgtgaggcaaggtgaacaaagctgatacactcagagaaatagtatatgttaaaagcaaaagccaaacccacataggcataaaaaggaatgaaatcatgtcctctgcagcaacatgggtgcagctgaagccattaacctaagcaaattaacacagaatctgcggtggctcttgtctataattccagcattttgggaggctgaggtgatccacccggatcacaaggtcaggagttcgagaccagccctaccaacatggtgaaaccccgtctttactaaaaatacaaaaattagccaggcgtggtggtgggcccctggaattctagctactcgggaggctgaggcaggagaattgcttgaacccgggaggtggaggttgcagtgagctgagatcatgccactgcactctaccctgggcgacagagcaagactctgtctcaaaaaaaaaaaaaaaaaaaaaaaaaaagagaaaaccaaatactacatgtttccgcctttaagtgggagctaaacactgggtatacatggactctaagacgggaacaataaacacggaaaattccaaaagggggtaatgaggaaggagggcaaaggttgaaaaactgcctatccagtactatgttcactacttgggtgacagaatcattagaagcccaaacttcagcagcatccaatatacccatgtaataaacttgcaaatgcacccctgaacttaaaataaaaattttaaaataacccaaacaccaaatttctttcatctcacatgagattaggcagatcagactgaatgtataaaatgcattctttcattcattcactcaacaaaatttctatttagctcctattacgtgccaggcatacagcagatattcaataaacagaagcagccagttgcttcctccttctcaccttccttctcacatgcctgaataaagtttgccaccatggttcctgcctctttgctgttcttgggctgttttgacctcacccatgtctgaatctcctctggcagggtgctcagaaactgtgtcagcactagttgctctatcatctgctccttggtgaggatctctggctgcagccattgcaaacagagctcctggatttggctcacagcttgatgaggcccattcactgacaggtactgaaaatccccaaacttttgatgagaaactttcagtgtctctgtttctagtttcttctcttgaccacacacacaaaagatgtagggattcctcaagatatctgaaacccctgtcacatccagcatctctacaccttggccctttacaggacagagctactcttaaaggcaggctgctccagtacacaatgttgtggaagacggtaggcagggctgtatcagctgaaaggatacagaaacctcaggacctgcagaaattacatacagacttacaactagcctgcatagttatgattggacagtggagtgaaggtgatctgaacaagtattacacaaaagatgacagctataaatagccaatcaacataaaacaaggctaaacttcattagttatcagagatataggaattaaaaccccaataggataacactatgcaccctccaaaatgtccaaaatgaaaaagtcagacaataccaagtgttgacaaggataatagagccacagtaggatgatatatttgtatattggaatgctaaacagaaaatatgaatgttaagttgctgttgaatgaaagaaaccaggctcaaaaaaaaaaggtctgtattatatgattccatttatataaaggtcaaaaacaggcaaaataaacctaaagtgtttgaagtcagaatagtggctgctgttggggggaagggtggtaatgactggaaccaggcattagggcttctggaaagctaggaatgatgtggacacagtgtattcactttctgaaaactgagctacacatttgtggtttgtgcccttttccatatgtatattttgctaaacatttattagctgtattatagttgtaggaaaacatctagtcataatatcaagcggaaaaaggaaacctgtacataacaatatatgcttacccatataaagcagagaaaaggtggtaaaccaaaatactgtgccagtgggttaagtacgaacggtaatattataagtgatttttataggtgattttgtactttctctcaaaactattttctagcttcaagatgttctacaacaaaccttcatttcttctgtaatcacagaaataaaacataccttccataaaggctacactcactctaagaaaccatgaacaaagatgccacttggggaaaacatttttttcttttcttatccccactaaaacttacgccttttatttctataatttaacagtttttccatttgaaagcatttatttttgttttccattagaaatcataacgtaatgaacatcactgaaactaagtatttgctcccaaattacatagacaaaagggataaactgtttttaaaagttcttgacacaatctgccaaattttcctttcaacggctaccaacttcttcttccaaactcaatgtataagattacatgtctcactcagtccaccttacaagccaatagtgccatcttcatgggcttgtaatcagggcagtcacaagagccccattctcataaagcccacaggcctagtttaatgctttactgtcactctcttgaaatttttcacaattttttggacaaggagccccacattttcattttgccctaggccctgcaaattatgtaactggttctgccaatcaagagcattatcatccctcaaaatctgttgtcaattagacagattgaaaaatatatcattttattctttaattttacatttcttttgattaataatacggctttctctttgtttcagatttacaagccaattataaattgttcacgccctttgtgcttctttacattggggtgtttcttttttttcttttcttttttttctttttttgaggcagagtctcgctcagtcgcccaggctggagtgcagtggcgcaatcttggctcactgcaacccctgcctcctgggctcaagtgattctcaagcctcagcctccggccttggggtgggctccaggcccaccagcgcagagccgtcctgggtccctccctgcaggggcaccgattttagggcagtcagacgcagccctcgcctctggggtggcttttccaccacaaggccccagtagggcccgccgcggagtcttcctcacgaagccgcgcgctgccccgcgctggatgcctcttgcgccctcaagtccactggggccccagccccgcccaggcccctggctgggctacccgctcgccggccgctatcctaccccgggcccagcgaacttacctcgcacgcctcacgccctggcctggctgaacgtctccacgccctgaccaaaaccagcagcgcatgcgccgtggctggcttgcgcgtgcgctctgcggtggacgggctgaggaaccacagccgctcctggccaagtgccctgtgagacacgaggatagggttggtacggcgaggagaagggcggcgacgtaggagggcgctcctgtgaccttccttcttaaaactaacgccttctgttggtggtgggcgcctgtaaccccagctactcgagaggctgaggcaggagaattgcttgaacctgggaggcagaggttacagtgagccgagatcgcgccactgcactccagcctgggcgacagagcgagactccacctcaaaaaaacaaaaacaaaacaaaacaacaaaaaaactaatgccttatgtaagttttggagagttaatatgttacttagaacttgaggataagtggtaaaaataaaaaataacaaactaatttcaaaaatttgaaaataagcggtagtcagtgaaaacccttcctcacaccacgtgtgcaccattcaccaaaattttacccccaaaacatacgtaaccactgtaactgatctgaagtgccccaccaatgtttctttatacttgtagaagaaatgtatatgtatatgtgtgtaaggcttccctcagtattcctgggggatttgttttaggaccccccagggtatcaaattttgtggacgctgaagcctcatgtaaaatggcatagtatttgcatataatctatgcacatgcttaggcatactttaaatcatctctagattacttacattacctagtacagtacctacacatcattcttgcggatttgacagtacgcagcacacatggcaaatttaagttgtggtttttggaacttggtggaattttcttccaaatttttctttttctttttttttaactttgttagagatgatgtctcactctgtcacccaggctagagtgacagaacagtggcatccccgaagctggatgccactgctgcaggttggctccactcatgcccgaacctctaagctggaggctgatccccgctggagagcgggtcagtcctctaggcccagaaatgaccaagcaaagcttaccctctggctgctcacccatggacaactggggtgagcttgctcagtgagtccactaaaggtcccccaggcagtggggggtggggaggctgaccatatgcccagaatgagtgggacaaagagcaggcaaatgaaagcgttgccagaaaagggtcttgatccaaaccccaaaagagggttcttggatctcacacaggaaggaattcaaggcaagtcacagagcatggtgaaaaaggcaagtttattagaagctattccattacagagtagggtgtcgtcagaaagcaagcagacaaacacaccatctttgttttaagtttttaggggtcttgtctacgtaaagactaaactaagctgtgactacgtgagggtgagctgaaagcatgacaaaatttattattctattgatttaaagaggccaggcacggtggctcagccaggcttggtggttcacacctgtaatcccagcactttgggaggctgaggcaggcagatgacctgaggtcaagagtttgagaccagcctaatcaacatggtgagaccccctctctactaaaaatatttttaaaaaatagctgggtgtggtggtgcacacttgtagtcctagctactcaggaggctgaggcatgagaatggcttgaactcgtgaagtgcagtgagctgcccactgcactccagcctgggcaacagagtgagactatgtctcaaataaataaataaacaaataaataaataaataagctgtgactatgtgagggtgagctgaaagcatgacaaaatttattattatattgatttaaagaaaaccatccttagaaaggtgagagaggaattgaagggttgacagtgtagactacagaaccaggaaatgacctaccagcaagtcttttatgtgtgtgtgttcttttctatttctttctgtttattcctgttagtgtttgttctcttatgcctgtgaaaacctcctacatgtcaatttccatgcactggaggaacttggatttctccccgtcttaaaagtacctctttcttcttctcctccttcttcccctcctcctcctcctcttcctcctccctgaggccctaaaaacaaggtggccttggctgctctaccaaaaggaggatgattcagaggctgtgagtttaagggaccacttttgggggattggaagaaatctccattatgaggttaaggtacctatgggagactacctgagacagggtgccagtgatgcccactagcctcaataagacaccagggatgcctgagtgcaatggccaatatcggttttgtgcacagtaaggaaaatttagagcttaaatggttaatctgctgctacagagttaagtagaatcctctaaagctccatatcttcctttcttttcttctctgccagctttgaatctgctgttattaagttgctggtgctgaaataacacttattatttatgatctaactgaaatgggaacactggaaacttctttgaaactgaagaaaaaaatgaaaaagaagtttttacaatcaaaactgccatgaagactgctttacccaaaattttggtccacagctttcattgaattacttatcagggcaaacaaagtttagccatgtgaacacgttccaattttgttggaaataatttggatccagctatctttatacaatggtgagttcgtattgcatctcatggctaaaatactgaggtaaaggcttttggatctttgtgtgtgtgtgtgtgcatgtgacaaaaacaagcaatggggaaaggagtccctatttaataaatggtgttgggagaactggctagccatatgcagaaagttgaaactggagcccctccttataccatatacaaaaatcaactcaagatgaattaaagacttaaatgtaaaaacccaaactataaaaaccctagaagaaaatctaggcaataccattcaggacatgggcacaggcaaatatttcatgacaaagatgccaaaagcagtagcaacaaaagcaaaaattgacaaatggaatctaattaaactaaagagcttctgtacagcaaagaaattatcatcagagtgaacagacagcttacagcatgggagaaaatttttgcagtatatccatctgacaaaggtctaatattcagcatctacaaggaacttaaacaaatttacaagaaaaaaaaacaacgccattaaaaaatgggcaaaggacgtggacagacacttctcaaaagaagaaatttatgtgggcaatgaacattttttttaaaaaagctcaacaccactgatcattagagaaatgcacatgaaaaccacaatgagataccatctcacaccagtcagaatggctattacttaaaggtcaaaaaacaacagatgatagcaaggttgtgaagaaaaatgaacacttttatacgttggttggagtataaattagttctacccttgtcgaagacagtgtggtgattcctcaaagacctaggggaagaaatatcatttgacccagcaatctcattactgggtatatacccagaggaatataaatcattctattataaagatacatgtgcatgttcattgcaaaatagcaaaaacatggaatcaacctaaatgctcatcaatgacagacttgataaaggaaatatggtacgtatacaccaaggaataccatgcagccataaaaaggaacaagataatgtcttttgcagggacctggatggaaccagaagccattatcctcagcaaattaatgcaggaacagaaaagcaaataccacatgttctcacttgtaagtggtagctgaatgatgagaacacatggacacatggtggggaacaatacacactggggcctgttgcagggtgcggagtgggagggagagcatcgggaagaatagctaatgcatgctgggcttaatacctaggggatggaatgatctgtgctgcaaaccactatggcacacatttacctatgtaacaaacctacacatcctgcacatgtacccctgaccttaaaataaaagttggaaataaaaaaaaccctaaacatatacctactacctgatccagtgatttcatttttaagtatttacccaagagaaataaaaacatatggccacacatgcaaaagaaatacttgtacatgaatgttcttagcagctatattcataatagccaaaaatctggaaacagcccaggtgtcaatcaatagtagaataaataaccaaagtatgctaggttcatgcgatggaatactacactcagcaaaaaaggaacaaactgcctatacatgcgataaaatggatgaatatagaaaaacatgctgagtgaaagaagagttacacaacgaatgcatgctgtgtcattccattcatgctaattctacaacaagcaaaactaatgtgtggtgaaaataaattggtggttgcccctaaggagacagagttggagactgattgatgaggagcaagagggaattttgggattgacaatattgttttgtatattaatagagatttgagttacacaggtgtacatattttccaaaactcattgaataatatccttaagatctgtatgttttgatgtatgtaaatttgacctcacaatagaaaaaaaagaatccttaaaaaaatgaaagaactaagtacatataaatgggaaaaatgcttgtagacagacttttcatgtaatttaaaatcttataattatcttgaataataaatactcattagatgttgggtgttttccaattaaaaatgggttataatatgaaaaaaacatgtttctaaaaattacagaatggtttcagctataaaatgctaacatctgataaacagttcaagatttattgcttcctgagttttcactaaaatttaaggttactaaaagtaagaattgcaataatatataactctgtaagttgtattcttattgagaaaacaataattttatgtagtttagaggttatttaaaagttatttatttaaaaaggtagaaaggaaccagtaagtaagagagagaaagagagaaaagatttttagacataaagatgtatttttggtaagaaaagaaataattttatataagaaaaggatttcatgtggtaaagttttgtcctaaaataaaatgaccgattattttaaaagaggtatgatagaacaaatcaaaaggtccaagcatgtcatagatggtctgtgtaagttcatgatcaagtctgtggaagaaaatttataaaaggaattttgtatatgattaagttggctataattaataagaaattattcataatagtctttctgagattggtcccctatgttaaaacaaggtttcttgatggtattactttttttttttttttttttgagacagagtcttgctcagtcacccaggctggagtgcagtggcacgatctcggctcactgcaacctccgcctcccaggttcaagcaattctctgcctcagcctcccgagtagctgggattacaggtgcccaccaccatgcccggctaatttttttgtgtttttagtagagacagggcattcatcatgttggccaggctggtcttgaactcctgacctcgtgatccacctgcctcgccctcccaaagtgctgggattacaggtgtgagccacctctcccggtctctttatggtattaatttactattaatgagattgtaagaggttttgatttttaattctataatctttgacctatagctcccttatcctcagtggcctctgcaggcaacacactccctccttaccaatccccttcagactctgctgagggactcagcccagccactacctggagcaggacatttaccagccttactctatgatgccccttccagcagatccccagtgcggaaatagagatgtttgctgtacattttcccttcacaacttcagagctttataacggaaagtctcattctaaaggactaagggaagatcctgaggggtttcaaaacctcattcagaatagtttcagacccatgacctcaactgggcagacgtccagtcccttttaatattctcctcagtgaaacagaaaaatacctctgctctcaaaagggcaagggaggaagtggaccaatcccatagagaagagacaaacaatcctattgtagctctcagagcacagcagacattagacataaactccaaaaagtaaaattagagctcgatgctctcatctcaagactagtagacctggccaataaggtgtccaacaaccgggatagggatgaagaacataaagaagacagagaggacaaatggcaagcccacctactggctgttgccctcaagtgccagctggataactcacaggatacctatccataaagtaccacagctgaagagagtgatcccaggtcccctaactaacagaaaggatcctaaagacctaagggactaggaccaaaccaacatgccctctataagggggaggatcactggaaaagggactgtctccttcatgtctgaagggagggggaagagggcaggttccaccaggtgcctcacagaggcagatggtccaagtagtaaaaatgacaggtcctggggactcctcaattggccctccaggtgtccatcccccaggagcccaggctgacactgggcatgaggaacaagcctgttgacttcttggtcaacacagggggccacctacttggttttgaataccctcaaggataaaattacccaccaaaattgactatggaaacgtgagggaaggcaaaagatagcccctttattgagctcctaaaatataaactagatcaaacgagatgcactaaaagggatggccccaatgattaaaaagcttagaaaacagggacttctgagggcctgtcaatccccttgcagtactcctatcctccgtgttaagaaatcaaatggaaaataccaattagtgtaagatttaaggacaattaatgaggtcacagaaaacagaaacccagggtacctaatccttatactctatggtccactctgcctccaagttgtacatggtactcagtcctggatctaaaagatgactttttctgcattccactggccacagactctcagcctctcttcactttcaaatggcaggatcctcagacaggcaggaaacagcaactgacatttactgtgttgacccaggtgttcaaaaaacttccccaaaatatctggagaggccctagccatgaagctggaggatctgaccatttcgaatggatgggagaatgtgaccaagcattccaaaagctaaaaacccagctcacgagagacccagaattagccctacctgatttaagcaaacctttccatgtttatgttcatgagaggggaagaattgccctaggaatacatattcaaaggttggacccactgacctgggtaatgatctacttttccaagcagctggactcagttgctaaaggatggccaccttgcctttggttggggatggccatggccaccctttcaaaagagacaaaaaagttaactgtctggactccccaccatacccagaccctcataaaagaaagggggcagaagggctgtccccaggcaaggctctccagttacaggtaatgcttattgatgacccccacataactttgaaggtgtgtaacagcttgaaccctgccaccctctttccatctgaagatggttacctatctcacaactgcttagaggtgatggtgaagtgtactccagtagcccagaccttaaaagtgaacctactgaaaatgtggaagtccaatggttcactggtaggagcagctatctgcaagaggaacagaggagggcagatgtgctatgttctctcccactgaagttatacaagccagcgctctcttgccaggatgctcttcacagaaagcagagcttgttgctctaacccaggcgttagagtttggggaagggaaagtcctcaccgtatacactgattccaggcacgtgtattccatcttacacccacatggggctatttggaaggaaaggggcaggttaaactcttaaacgttagtgccatcattttaagattattggaagctggaagaaaaccagcccacatggcaatagtccgttgctgaagccaccagaagtgggacattgaggtaattaaagaaaataataaagccaacctagggtcaaaacaggcagctttagggaaggtcacattccaaatgccacttttgcctttcctcctgggtcctgctcttttaaccccagttttctctcaaaaggaatggaaaaaggcgaccaaatggggttataccaaaaatcctgaccatccaggatggctaataaaccctcgtggacaatttcttttcctaaaaacagttgcactgcaggccattaaaaaggctcactctaacacccactttggtgaagaaatcctttataactgattttgtgaaagcatgactgtcccaaacttcagggagtcaatcaaaaaggtggctgggactcatcccacctactatgttaataacccctgatacccaccccacgtggggatagcaggggtgagaggaactcagagagggctcctcagctggtccagttccaaggtagatgtccaggggaagatgagaaagttttcatagttatgcccagaggcctgggaaactttaaatacctcctgatcttcactgacaccttttcagggtggatagaagcctttgccacctgcactgacactgcacatcaggtggcaaaggtgctattaaagaaagttgtcccaagaattgggctgcctcagtcaatccaactgagggaccagcattcatatcttccattactgaagctacttctcaaagcctagaaacaagatagcacccacatgctacctggagaccgcagtcttcaggtaagcaatgagtaggtgtagcgatttctgtcaagactattattcctacctaatggttatttcctcttctacatgcttgacgtactatgatctcatgtaaccctcacaaggtagcctctgttgttatttctccattttacagaagaggaaactgagacaagaaagcttcactaacttgtcccactcagtatgattagaatgggacaggcagagggttaggattagaagtgtgcatctaaccttcttcaagggtggaaatttccaatcagttatgttacaaacatttgtaaaataggcatgttccaagaatggtacaagtaatgcactcacttaaaccttatagtaaccccgtaacgggggtactaacaccagccccattttacagatgaggaaactgaggcacagaatagttaaggaaataacccaagattgacagctgttagtggcagaggcaatatttgtgaccaggcagttagaccccagagtctgggctttcagcttcaccaggctggcattttcagctgcgaggcatcagagtagactggagggttgggtctctgctctgtcccccttcctttgcagaaccatccttcctctgctccagggtttttcagccttggctctactgacattttgggtcggttcattctgtgtcctgggggtggggacactgtcgtgtgcattatagggtattgagcagcttccacctatgagatgctggtagcatcaccccttcagttgtgacaaccagaaatgtttccagacattgccacatgtcccctggagggcaaatcgttcaatcccatttgagaaccacagacttactccacaatttcattgtttaactttagggagagtctgggaccttccactgggaagggccaggcacgcaactcaggctgggccaataagagtcctacatcccccagttgtggattggttctgcagtagacatgtgacccatcatggaccaatcaaaatattccccaatccttccttacttgctttatctaagtgtctcccactgattgtttattagttgcaaggagggaaaccagaaagtattcagtgggtaaatcaggcaaccaccttgactgggtggatcaaaactagcatcaccagtgatggcatatggatctcttgtgggttaaaacgtgaggtcctgaaaggacacagaatcacttatgtggtattccaggaacgactgcataacctgaatctaattcataggaaaatggccccccaaaccccaaagtgtgtcagagtgtgacttagaaaccaaagaaaggctgaggaggttttccagattaaaggaggctactttacaactgctaaacacaggcctggtcctagccctagaaaggatactgtactggagaaaaaaagaatatttaaatggagggtatttagcaagttgataaaattggaatattgacagatttgataaaagcactgtgtcaatattaaatgtgcaaaggttataatagtacctcagttatgtaagagaaaattcttattcttaggtgacacagactgaagtattcagaggtgagctttgtgatgtgtgaaatctatgcccagtggttataaaaataatgtattaggtatatatataatagagtgtgcaaatgacaaaacaaataggagaaatgttaccaatcagtgaagatgggtgatctttgtactattcttgcaactttcccatgagctttaaattatttcccaatatttgtttgtttcattcctgtaatgaagagcccccaattaatagatgcttaaatatgacagatgtttatttctcatgtaaaagcctggataggtagtcaagaatcatcagacataagctcttatctcattactctgacatcttcaatacatggcttcccttttttgatccaagatggttgctccagttcctaccattatttctacattccagcctgtggggaagggggaggagagagtagaaggctggttgtgacctggaaatcacacatacctttactgtgctcatcccatggaccagacattagtcacatgcctacttctagctgcaagggaagctgagaaaatatttacttcttctaaatagccacataaccagtcaacatttagcaagaacaggagaatgtatattgggagatatattgttactgccttcctccccgtacatactgctgtggtctgaatgtttgtgtccccacaaaactcatatgttgatgttcaaaccccaatccaacagtactaagaggtggggcctttaggaggtgattaggtcatgagggctaagccctcatgaatgggattagtgcccttataaaagatgtgcaagggagctacctagcctcttttgccatgtgaggatgcagcaagaagtcatcatctttgaagcagaaagcaagccctcatcagactccatatttgctggcaccttgatcttggacttcccagcctccagaactgtgagcagtaaatttctgttgtttataaattccccagtctaagatattttgttatggcagcccaaatatacacatactcttggttccatgagggcagggaccatgtctgatttgtcccccacagaatgccaaatgccccaaacagtacctgacacttacaaatggcccatcaattattgaatgaattaaggtggcttgggagttcagagtcagagaaattttaagaagaccttgcatggagaagagacctcatggttcttgaataaaaggcaaaacgtggttataaaccaaaatgaaaattgacttctttcccagtgatccctgaagactaattcaagatgacaggcaaatgaccaacgtatccctttatgcgcttcctcatgatgggatgagggaaaaaatagaataaagaacttaaatcagaattttttgagaaagtgagttcccatttgtatcatgttatgattatacagacagaaactttccatatgttcagctgtgataggatagattcccttgaaaataagtcttcttgagtttggaatggtcatcaatatctctgacagggcaacaacaacaaaaaaacatgtctaggccaggcacagtggctcacgcctgtaatcccaggattttgggaggccaaggcaagagggtcacttgagccctgggcaccatattgagatcctgtctctacaaaaaattaaaaaattggctgggtgtggtggcacctgcctgtgatcccagctacacaagaaggtgaggccagaggatcactcgagcccaggaggttgaggctgcagtgagctgtgtttgtgccactgcacttcaggctgggcaacagagtgagaccttgtctcaaaaaaaaaaaagaaaattaaaaagaaaacacatttgtgctagaattctctgcttgcaagtaacttaaattcattcaggttaatttaagggggaaactggatcttactggaataatattgtgtagcttaaaatagtgagtaaagagttatcagtccttctagtaggacagcaatcaaagaagacttgttaatctcactagggggaaataatagactgccttttctcagtgtggccataagaatgactgggctttgaacaccttcaatccatgtattgctctactgaaaattcaaattcttgggtgaggaagtctgactggtctaccccaaaccatgtaattagtcctttgctggcatgagggaggggcagggatggtgatcagaaggaatggggtcaggatagtccaccaaaaccatgcagtgtgctgttatttaacggatgctgggcatacagaagagctatcctggacaattcaccctttggctttgtggaagaaaccatgcaattatcacggggaaccttcttgaactactttggtttgagagtagtctccccagattttttctgtactccttgctgcttcatatggtatataagtggtacgaggcatgcagtaagtcagcagacattcctgagaggctggtgggcaggaaaagtcaagtctaagtccagaatgaatctctattccatgaggctacaaaactgccctttctgtggttaaaagggcttggtatgatcaatcaatctgctgtctggctggtggggagatatggtaccagtcctggcttcttcatcactcctgcctttctaggggaggagtgacttaaactcgagagctggctagcctgcagacagtgtatgttcattgctcttcaccctgcaatgttctgatccccaacaattagtgtttagattcaacatccactaatccttgagaggtttgtcaaaaaatggattaaccatgtaaaagaaaccaagggcaggcagttcagccagactccacaaggcactggggtggatgaggcaccaggaaccaggattccctctggctttatggtctatttccttctaggcctgtttattcacaagtatacccagccccaacccatatgaccacctaggtagccctcactctgagtctgactggacacggggaacctatgggcatcaatcaactgacaccagggagaggtcaagtctaacagaataagcatagcagtagggaagttagttaccccttcaactgggttgtggggtggaggaaggaattgcccaagagtataaggattggtcaaacaacccctaatgacacctacttcattcccttcctttacagcctcttgtaacacattatttaggaaatccatccttaaaaagtcccaatcctcccaccctgacctatgctgatgctcgtcacagaatgaccatggaagctgtgaccaaatagtcagatgccacaagatataaagttctaagaacatgaaagaatgcaggactctgtcaaatcctagttagaattagtggcaagtacacttttatatcttaagaacaaaatccaatcatgtgacatgaaggatattagacgggcatgaagtacacaatcatctcctcctccgacttatggaatcagggacacagcagccgcaaattgggtatggtgctatccactgtggtcgccaacagggttccagttagcaagctggttgaaaagctctgatcattatggaatcacaggcatgtttaaaaattactctcagggatgacaatctactgaattgcatgggatgtttctcgtggggaagtcaggttaaagtatggttaatgaacttgggggaaaaacagtacagagatgacccactcaggataattaccttttaacctcaggcaagagtcaggaataaacacttgagattctataacatagtatcaacacttttatgttaagggtttattattgtctgtgattttttatgtttgagacaatctcacatttccaattaaaaatgcccactcaagtaactaagatgtacttgcggtcattatcaactttaaaaaaattgttggaacatatgttttagtttcataagggcagttacaaatgtgaaatcaaacagtatttaaaaatcccttagaagtaattgttgaaatagataatacttaaaaatagagtaagatttgcaaaccaaactttttaggctaaaggaggaactaagcttttggatttataactctaacaaaataacatatttaaagccccaaaaacaaaacagacaaaagagactgagaaatatttatttttaactttatttttattgttgacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgttaacagttaattgttgttgggtgttgggaatatgtgtgaattttctttactgaatttccaaagttttgtatgagtatgtattatatttgtaatggaaaatacatacataaaatttattaccaaaacaccaaagattatttaaggaatttgagacaaaatatttaaccaaattcccacaatgacaacactattttagttattttccacatcttttcatttaagactttatgcacacatatttaacactgttatcacaagcgtgtgcactgaaacaagatagaggaaacagatcaagatgttagcagtagttgttaggtgttgggaatataggtaattttttaaaataatttactttattttctaatttttcctctgggtatgtattatgcacaccaatggagacacacataatacactgttatcaggacattattatagggaacatttgaaaaaattaaagtgaaagtatttaaccataattccacaaaggtaatgtaacagctattttgaatatacattttgacacagttataatcataaacctgtgcacagaaacaagaatgaacaagataagaggagagtatatgtctttggatggtggggatatgattttttttcctccacttttctgtattttccaagtgtgtgataatgagttcaaattatgttcacaatgaaaatgtgatcataaactttttagtaacactaccataaagaacattcaagaaatttaagaaaataatgctcaactataagcctacaacaacaacaccacaacagcttttgactataagcatatatatttttaaacagttataatgaactgtttaaatgaactgttaaatgaacagcatataaatgaactgttgagttataactgtagtataaatatactttcgtgtcctgctttctccacttaatgttctgtaaatatatttccacgttgctacataactcgtgattatcatttttaaacagttgcattaagtgtccacagataggtttaaacaatcattctcttgtttaccatttgttactaccttttcactagctgaaggttggaacggacaccctgacttacagcaagttgctttctgaaaaggggctaccactgccaacaatgttaacaccaagtaatgtacccacaaagttcaccccgacatcaacactgattctcgtttcaagagtccttttcccatgtagtaaacctcactgcccctcagctttcccgatgtccgttccaacctcagtccttcctatgcagccagccctcacctacaccataccatcaaaaactccttttccaaactgctcaggacaccccgctcaattcattctcagaaacctggccttctacagttcttgcctctggtgttttcttctgtctgtctcctctcccctcctagatctggtgatatattaggactcccttctttgactcactcatttctgcttcttgctctcagctctacaatcttcctaaactttgacactccctgcatctttgacatacttccaagccctaatcctgcagatccagaagagtaagattcagacacatttcccccagtgggtactttaattttgcttgttcaaatgatctacacttacattttgcaaatctttttttttaaattttttaaattttatattttttttccagccaactcaaggccaaaaaaaatttcttaatatagttattatgcgaggggaggggaagcaaaggagcacaggtagtccacagaataggacacaagaaacctcaagctgtgaggtcaatttgtaattaaaagaatactaagattagatgaacacaacactcagaaatactctaggagagctgaaaaagaaggaacagatgttaacaaaacaaattaaggctgctggggaacctgagtccatgttaagcttgggttgactgtaaagaatttttttttttttaatgcaagttagacatggagttagagggtcagataaataacgaagagaattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatgaaaggttattagcctgcaacattatttacagcatgagagcctctcctacggttctcaaccttcattaggcactactgtgatctagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgctggcacgttcgatgtagcctgagcactccccaaaggcatttgcaggctcaaatatgatcatgctggcatgagttttcaggtgttcactgaatgctgtgctggaagtgaaggtttctgtgcattcatggcagtcatagtatggttcttctacctgaatctcttgatcttcaccttcttctgggtcttcaattcccacaccgtcaggctcgtcggcatctccctctggctcttcagcttttccctctggctcttcagctctttcttctgggtcttcaatacctgcaccatctggctcatcagcatccccatttggctgctcggcctctccatttggctgtccagcctctccaatgggctctgcagcctctccatctggcccttcagcctctccgtttggctcagcagcctccacttctggctcagcagcctccacttctggctcggcagcctccacttctggctcagcagcctctacgtttaagccctgaatcctcagaactacttgtggaacatggacattggcttcaacttcctgggctgctgctgctgcagctgctgctgcttcatcttcttcttcttcttccagatgaagctccttatgtttagtgaggactgtgctatgaataaaggacttaccacaatccttgcattcatagaatggtatagctcctttgaggggctcagtaagaaatgaggtgtgagtataggaggacccgtactcatagggctcattcttatgaacagttacgtgatctgcaagttctgctgggttgacgaaagattctccacagactgcacattcaaagagtctctcttcggtctgacttctctgaaactcagtgagggctaagcctggaatgatagcttcctcagccatctggctctgctccagtaaatcatcttccctatgaagtctcatatgctcattaagggcagagctatgaatgaagccttgtccacacaaaaggcatcgaatggccgacccagcaagagcaggattcctctctgcagcacgattcctccgtggcttcatgggcaagagggcaataaaaccatcatcacaccccttcatggaatacaactggtcttgttcatggattctctgatgctcgaaaaggaatgagctatgaataaaagattccccacactttggacattcatacagctgctctccagtgtaatctctctgatactcgctgatggaatgggtgtgaattacagaatgtgtgtactcccgactgtcaaccaggcacttcctgctgtggactttctgatggtctgtgaggtctgtgagatccacaaagcccaggccacagtcctcacattcatagattttgtcatcagggtcatccttctgagggtcttccatgtctgagccttgaatgacagggtcttcaattgtctcctgaccatgggtctcctcgctgtgggtctcctccccatcagtattctcgccttgagactcctcgccatgagacttctcttggtcatagattttctggtttgtgttgaggtcttcgctggtagcaaaaaattgtctgaagtccttacatttgttccgcgcttgctctttagcatactgctcttgggcgtaacttgtttgagggtcagtaggggccaagctgcgaatgacagaccattcatagtttctgcttccagagggcttctccctatcatgaatcttctggtgctcagtgaggtcagagctatgagcaaagcactccccacactcctgacattcatagagcatccctcgagggcgaaatgtttgttcaccaaaaggcagagagtgaattacagaggtctcattgctcctatgctcaatgtatttctttttagcacgagccttctggtattcacggacatttgagctgggaacagagaattcgccatccttcttaaactcaccagatccctctccaggaacacttttctgaggtttggcacggaatacactctgtatgacagagtcttcatagttgcgattcttactgcccccttcacaagggttctctctggcaggaatcttctgtcgcttatcattaaggtctgagatataaatggaggattctcccttctcattagattccaccaattcatttccattgtgacttcttggaggtttggaagccactaagctatggataacagacctactgtattcccttccttcagaggtgttccctccagcacgaactctctgatggttgatagcatcgaagctctgaatggtagactctgccattacttttggtttactgggccctgctacactgtgacttttctgagcttccacagaggctaagctatgaataacagacctctcatatgattttgcctcatagacattttccttagtgggaatcttctggttttcataggggttagagctaatggtgaacgccttttcgtcctcatcactttcaagaggtcttgttatagtatgactcttctgagattcagtgaatggcccactatgaatgacagatttctcataccctctgccttcaaagaggttctttcgagaatgaattttctgatgctcactgagctctgagctttgcatgaaggcatcccggccatctgtaaagtcacagagcttctccttattgtaagttttctgacgccttttaagggactgaccaggaataaaggtttcctcacacactttacccttgttttcaaatgggttccctctagtatggattttctgatgttctttcagggatgagctatgaaggaaagtctccccacacaccttacattcgtacattttctctttaccatacattttctgaaactcattaagggctgggctgggcctaaaggtttccccgcgctcacgttcacgttcacgttcatgttcacgctcattatctttgtcatccccaaagtggattttctggtgctcaatcagggcagaactatgaaggaaggtttccttacacaccctgcactcgtagaatttgtctttgccatatattttctgaagctcactaaaggtggggctaggcatgaaggcttcctcacattcctgattcttacattccacaagataacctctagcatgaatcttccgatgttcagccaaggcggcactcttattgaaggtctctccacagtccttacattcaaaacgtttccctccaacctgacttttctgaacttcactgacagccacactgtggataaaggactcaccatactcatagaggttctctctagtatgcatgatctggtgctcaacaaattctgagatgacactgaacgacctcccacactcatcacatacatatggcattgccccaaaatcaattggctgtgactcggtaaaggagggggagctgaggctgctcaggctgctcacgctcatggcttttctcatctcactaccacattcaaagggcttcttcctgggacagcctttttgatcgtgaatcgagcccttcccatctgtgtcaaaatgatagcgcctctttctttcaagaactctctttctggaaacaagggttgaattaaacctaaagcctcccctaaatgcattcccttcataaacccgctgctggatcactgactccctcttgttcaatgaaatgtccttccagttatcatctgacattctggggaatctctgtgaccggtcgcttgactcccttgctcttcccgatttggaactgcgtgacacatccttgatgaatttttccattatcactccgtgggaagattcatcttcacaaatcccccgccggtgggttgattttttggcttcaggcatagtttttagacctggaaagaaaccccaaatgtaaatactccctagtccccataagaaggacagtgggacttggaggggtgcacccttctgtgatgtttaggaatgcaaagtgtagaagttccttgatagcatctcactggttgtgtggctcctctgtgggatgtgcctcctgcttacctcgactggtgcttgggtaggcacttctcttggatcttgatgagtggccctgcgtcatgtgggagtggccatcgtcttcagcaagctgcactcctggtcacaaggacaatatgatgcctcaaattcaagttgaggaccaagactcatcaccataaattgatcttcatctttcactgagccactaaatatgaggtggcccacatctgattccttggatgtcagaagacatttgctgtctcatttccctactatctattccctaatccattctaatctacatgtaattcttctgactccactcagaaatgtgtacaaagaccccacatgtccctgaaatcagtgcattgtcttttagtcttcaccttcttgtaaccactttttaagtcctcttttccactggccttcttcctcttacctcgcgactgctcttcctccacccactcccttgaggccccatggccttacagacctgcagcacagccaactgcccactaccaacttgggctagatgtcttccaggaaagtccacatgggaactcaggatcccatcctgaatgtctacttaaaaacctccagtgctaccactctggaaaaaagtatcaactcttgtggcaagaagcatctccctgcttgtccccaccctgtacaatgtatctttacccaaagccagaggcatttcttaaaaacacaaattttatcatttactccctcatttgaaatctttcaaagatttcttattacccttgaagtccaaatatattaatgtggactctaacatccagcttaaaaaggagcaagatgacaaaatgctccaatgactggactgggagtgactgagagaagcagctgcttaccgagggagagcagcttcctgtagttttccatgttgtcctggattgtgttgtgaggtttcctgtcctcagcgaggtccaccacattttggtatgattcagcatcctaaaacagcaaacacagacctctcaatggagtctgtccccaccgatgttcaaagacagaataatgttggcaacatgggagttacatatatgaagttatataggaagtgctcacggtattggggttctgagtgatccaagtcaagtgttactagggacctacgtcgtacctaccttggtgctacactctgaggcagatcccaaagacgcatgacacatattccttgccctcatgcagcttataatttggttggagagaaaagactcatgaaacaattagagaacaataaacaataaatcggggtacagatagtaagtgctaaacgggttttgtagagggacagttcagggtgggcctgaacagtgtgcaaaggtttgtggagggcaggtggggccttaagtggtaagtgagattatgacacatatagaaagggattggtgggaaaacttagactaaatatcaaacaggcacggagtactcagggaacagaaagaagacacacacattcaggaagacatctggtcaggatgtgacttaaacctccctcccggtttctccatggcatagcatggctacattgagggagtctccagtttgcacaatttccaaatcacccaggaataactgtaagccctgagggcatttttataattgccttttctgtcttaatggatatttacctaaaaaggaattttaaaattcctcacattactgaggagaaccttctaccaggattctaaaggacctttgcttattgccagagggctgactagaactggtttcagggagtcatggtcccaggaagaatggcactgaggctggagagagacttgaggagggagatggtgctgtgggaagcccacaggctttggagctggacagagatctgggtcaaagaaggattgcaccaattatgagctatgcagccttgggaacggaaatctttttgaacctttctttcaggttcttcacctgtaaaatggggagaagagtatctatctgctttgcaatactgtgggtgaggattttctgcagtgtgatgtcttgcttaaatattaagaaaattatgtaaaggaaatacaaatgtcttgatattaaatctaccatagttctattgctgggaagaggcatggagcaacatgaaaaatgtagcaaaaaaaagaggacttgctgagtaagcaaagacaaagaggtacgggtatctgggtttaagagggaagccttatccatgaactgcctgtgtcctgccacaaaaaagcagaaacaacaacaaaaactaagtagggcaaggaaacacagcagagcttcacagataaaattcttttttcacatgaaagaaaaagcacgctttgattgaaaattaaaatctaggccagtgggcagccctaaattggttgttcgctttgtgtttgtaatcaacaatgacatcttaatgcatacaaactgcaatcaagttcaatggaagagatgctgttctgaaaacaatgctagtatggctcaatgtagttttcacaacatgatctatacatgtgaacaattaagaaatttacacatgaagctaaaagatgagagaattttctgttgtgtacaccttcaaaatgtaatttgtgtcatttgctgctggtgttaccaccatactgagtcagtaggaatcagtagcttccagacttttaattatgcagacatggggctcggatgccaattcttcacacattgtcaaggaagggcatttaaaaagcaaaacaagacaaagcccaactaccaagacaccagtggccaggcccacacatgcctccagccttcttcctatatcccagccacctggcccttggtttggttcccatcccacaactttagctgagctctccctaatgcctggggtcccctcccccaacacctgacccggcgtgctcctggctctaaatggcaactgttaatgcctccaagacatttcccttcaatccaaatcaaggcccttgttacaatttcttgttaactctctatttttccttgaggacactgagaatgatgagcagttatatacaacatttgtgtcaatacttatttgtgcaactgtcaaaagcttctcagggcagggcccctctctgtgttgctcactgctgtgccccccagggcctaggcctgctttctgacatgggatgggtactgatatgtgaaggaaaggaaggctcagcccaatggcttctcccttctttgagtccagtcagtgctggggtcctcctccacactccaccatgtataagtgacccctctcctccttcctaaaaaacaagctcaagttccacattttttttcccttcatgaatctccccggcacatgctgcctcttaaaccacaactgccataattgttaacatttaacggtgtgcctaccatgtgccaggtactttatgtatgtgtgtgagtgacttttcacagcagccctgggagcaatcaccatattcattttacagatgaggaaacttaaattcagcttatgagtaaatggcccaaggccacacagctagcaagtggcagagccaggctttaaacccagctcctgtcagctccagagcctttgtgctccctggccagtctactctgcagacccacagctttcctggctccctcctgaggaccagaaacatctccagagtcactctgcttccctggccctgtagggaacggccaatgtgaccaacctaccaagtgacacacatgctgagggggcaggagctcctctgaccacatgaacgacaaagaaacagccagcagcaacctgggctacttgtcacctaagggatgggcccgggctcctcctggagcgctgggactctcaccccagctggactctagggggcagataaacacaccatctggggaaagaaaggcgtctctgccatgaaatgaagatggcctttctagaaagagaggaaacctgagcatacctgagatcgggactcataagccctggagtccctgtcgtcctctctgtccatttcaaagcttgttttcgccaccacaggaagggaaagatcccgcggaggcatccctgggaagaaaaaaggcatcaacaagaagcagggcccagtccatcctgcaggtcccaggtttgtcccactcaactatgaagccagctggggtgtgagtgtatgagagcaagtgcctttctcttctctgcattctgtggcagcctctgaggagtcccataaaaccagtggccctacaacaacccagacccagggcagggccaggggccctgcctcatccttctgctcccagtctcggaggtggttcagattgtgcccaagctgtgtgggtccaggtacagtgtccactagcctcatccttcgggcacaacctctgggtctccccagctgcaatgtgtgacagggagatggcatcagagaccgtcccacagggtcatggctctgaacaatgcctattgtgttgtgaaccgtcactaaatgtcactcactcctgatatccttctcctgatcaattttagggtgccctgctgcccacagcagtgttctccaagtccaggaagaagaggaaatgatttccagcagtatggacaccaacaatacactggtgtgatgattgattcccttccaaatctcaggcctggtgctcagatgtggcacttccctaacactgcaggaagtcatggcagacattcctagttaacaatattgttacaatgtgtttttcattctcgccttctgcctatggcacttcatactagttttcaatttttgcagtggcatagtctttcatacagaaacttccagtttttttttttttaatgcaccagcttaagaatactgagcaaatagtttaggtggcaacaggtctatgtggtgaaacctgtgctggtggtaccgagtggaacttcaaaaatacgagccttggactaaacttttggggaagcggaatatactccaaatggagcagcagaaacttcgaggccctggcactttccccttgaacctgtgcacagcacatgctctatatctcctactgggaaagaaagtggttaagactcactgcttcttgggttcctggtgtgggaccagcggtctcgtggctccatgtctctgcttctgcccctccggtcccagtcccggtcacctaagcaggtgagacattccagtggttaacaaagctctttgacacacctgttttccctgcatgtgcacaaacacccctctggaaagagatgctaccctcttcccacaaggagatggatccaaaacagagagctccaggttcccaggctcatctggccccttctttatcatatacccgcaacatggtttctgcaggctttgcccaagtggggcttgcttccaagcaagttccaaagctcagtccagtagctaacccccacttcagactctttgctggcttcccagttcctaaggggctgagtccacattcaggagaatggactgcagaccccctactgtctggcagccgatcttaaagtacacgttattctactacaaaaaaaacaaaacccaagaaaacaacacacacaccctccctgaaagcagtgctccctataaaagctcactgaagcatctttaatgaaccttcctgaggaggctgggggtacagctggaagcagcctgttgcaaattccaaatagctttatatactttatcgttgaataaaacggtattaagtatttaaggtgtctgtttagatataaaaatgtctcattatgacatcaattaatttaccctctcctcagatctctgagtgaagctgaccactcggggatggcgggtcatcttcatggaggccccaacccactgtgtctccatctggaagcatctggcagcgcctgcccatgggtgaccagtggggatgggtactcaccactgaaagaatggactgagtgaggtggtgaggactctcttctgttccgggtcatgtcgtcgtcgctggtcacgtcactgttgttgtcgtctaagaggacaccggtcgccaagttactatctctggcccacattctcacaatagttccccccaatccctgagccgcatctccctgtcacagacacacatggttggaatgacctgatcctgacatttctgagttcaaaacccttcagcggcttccaaccactcctggcatactaaaaactgggtggggggagcatggtggctgtgaccaccccgacctcacccccagacacaaacagccagaaggcaacctcctagcacaccacaccaaaaaggcaggagccataggaggttttctcccttctacagaagtgtctcctttccctctcctgactcaggatggtggttctgcactagggaggttttggcgaccaggggatacctgggcatgtgtggagacacttttggtggccacacccagaaaatcatgatgcagctcaatatcccacagtacacaggacatccccaccgctgcccaggacagagagttatccagtccagaccatgtcagaagtgtggaggctgagagccccaggggacacctgaggcctgcactgaccaccaacaccccgtggagactctcaccttctggttggtacatctccttgtaattctccagcagagtgacgagcttctcacagttctccggcttttttgctcgcacccaaggcttgagcttttcagggatgatggtcaggtactgctcaaggaccaagagctcgatgatctcctccttggtgcgggtctccggctgcaaccaatcgaggcagaggtttcggagtttgatcagggtcttccgaggcccaacaaattccacatagattaggttccgaaacctctgatgaaaaaactcagagtcagttggaccttctcctatgatgacatccggctccttagtcaagtcactgtctagctcatacagatttggggcccaggacttcttaggtttggtggcagacaagtgctttggaggcagcatttctctaagtaaaattttcactggaggaaccaaacatgagtcaacaggaaagacgcggcagcctgtgaccgtcagtactcagggacctgtggatcgtaaggagatatacacatgtcccagaagttgaagaccaggcagcagtggaggccaccttaccagaggcatcgacaatgcttttgggatatgggagtccccagtaaataggcaaacaaccgcacaaagttggcctcagcacagcagttacaagcatgacctctgggcttcacagagacctactcgaggagttagctcggctactaacttgggctactaacttgggactgtgggcaacttgtctaatgccctagaagtctctctgtaatctgagaaataagaataacagcacctccatccctttcagaattgtgaagcttaaataaactaagatacctaaaaagacttaactgcccaatgcaaggcacaagagaaatgttcaaggccctagccagtactaaaatcagacgtcagcacgtttattagcaaaaatgaaaaggggaagtaggagttggggcaaatcctcccctaacatttcttcccttaacacaattattaaaacacagtatacaacatgtaaaaaatggaagaccattcaaaaatattaaaagtactcaactctaggtaatatgacattattccctcacacagtgagaagtgaccattgagcctcttgatgctactgcacgttcttttgccttcatcaatcttgacaaaggtctaatctgtctaaaagaaccggctttctgttttgacattcctttcttactgtttctttacttagttcatttatttccttctctttattttattatctgcccccttccattttttaaacttttgagattggacataaatgtaaagattttcaatctctccttttttttatgtaaccaagtaaagctatacatttccttaaagcatttttgctattatttgcattttattgcgtattttaatgactggtcagcacatctggtgcaactaagtaaggcaatatgggaaagaaatctaggtctgggagcataaactacctactggctttacttccagagaagaaaaaaaaccatatgcaacagaaattttctccctttgttttaaaaggaaagcaagtttaaattttttaatttggaaaaagtctaaaggaaaactgaaggtgtttccattattcagagtctctcattagacattatcacttgcaaatcaatgtggtaatcacggtaaactcatgtttactcgtctcagtgatgggctcccacttccctccctatgcaaactgccctcccacgctctctcctgcatattatcatcccatggagcttgggcaccatccaatgcaaatgcctcgatcctgaagaccttagcgactggactatttccttgctgccttccttcataggactgagaaaccacggagagcacaacatagataatgctctgctgggcagaagaatcccaaagcaagggaaggcaacagaccagagagtccaggctccagatgattggtgtgacatttcagacatggtcactctaacccaggacagggcaagagcagaggtctgtgcctgtgagggagacaggcaagggcagacggcccaactctgttatgtggcagacagactcaggagaacactctggtacctgaaatgatactagccctcatcctcaggcaacaagataccctcagatatgtaatcacctgtctgggaacaggatcctttctggaacttcagaccaagcagctatccacaggaacagagtcaaaacacaggtatctgcagaagttttaaaggaagaaatacacagactaagaatatgaaagacatgtagaaggagtgtcagagaattaactccccaaacaactggggactcaaatagcactggggtgatgccttctataccttcggggaaaggccattcccatgctatataaaccatgccagacaggagaaataaaaagctttcaaactgtctttatgaaaccagaacaagtcaaaaacgcaagacaaagatatcactaagaaaccacgaaccaaaactcatgaaagcagaaataaaagtcttaatgctgctattattgaacattattctatgcagttctactcaattacaataagacaagaaaaacacatctgaggcacagagagataaaactaacattcccttatgtaagatctatacacatatatatgcttctattctgtgaatttctctccctaacagacatgaattgaagcataaagtaccctaggtgaaagctatatatcagaatggcaggcttatagagttcaataggaaaccaataatttttttaaagaaaatacaaatagcccaacctgactcaagaagcagagaaaaatatgaccactagggaagaaatctaaaaagctgaaataatgtaaagagcaacttcccaagtaaactttctgtgaataaaatatttaccgtgttataaaaaccattccagagcacagaaaagagatggaggacttcctacaattaattttgtgaccacttgaatgcccatatgtatcttgtcacaaggtggatgccaacttctgtgccaaaaaaaataaaacacattgcttttcctcaagaaattcaggattaaacatacacaatcttcccttaacatgctcaagattttctgaccaggccaatagaacttggcccttggtcaatagaagccattgaaaaatggaagttatttttttaacagaaaaaccttaaaaaaaaaaatcagatctgagctacttcccaccatggcagaggaaactcatttgggagtaaagaaaggctttggaaacaaaacaatcaatcataaagccgggcaacatatgtttgtatgcacgggaagaaacaagtacactcatatactgcctgtggcaatgcaaattttatcaaaattaaaagtgcacatatcctcctctcctacaaattctacttctatgaatttacctcagagatatgtaatgacctatgtgcaagaatatattcattgaagtgttgttaatagacaagatatgttatgtttgtataatgaattactatgaaaccctttaaaataaggcaactctaaataaatgagtatgaaatgatctccaagatagttaagtgcaaaaccggacacagcactgtatacagcattctcagaaactaaaaaaagatgtgcttagacagatgatttctagaaggatatataagagactattaatgatgactaatcgcaattgcctctggggaagggaactaggggtcaggaaagggagggcaacttactttttcattgtatattctccttttgttttttgtttttatttttattttaccatgagcatgtattacctagtcaaaaaaataaattcaaagttaaaacaaaacaataaacaaaactaccagtagaggcctttagaggttgtgctactcacagagcaggtgcaggcagccgtaacatctttacactgatgctgagcccaggctctccccgcatcgcctccctatcaccatccacagcttgaatccatagtcataccctaacctggccattagcaggtacatgaaagtcaatttagaaaaccctaaagaatcaactttgaaacctgttagacccaataaatacttatgatattgcagttgcaatctgaatatacccctcaattacacccaacaactgtcagtacataaatacaatgccatcccctatcttggcaattccacttctgaaatctaactcacagacccatctgcccatgtgcacaaagatatacagttcaaaagtgtgttcacagaagcactgtttacaacagcagagaacagggacagtcaaacaaatgctcaagcgtaattccaatggcagagaccactgaaaggccaccacgtgggagacaggaaaataaagatgggtccaacttttctgcactataaaaaccaaccaaaataaaaaccaagcaaaaagggagggggaaaagtattttataacacagatgacagttaatgtttgaaatgtaaaaggcttttggcattaggaaaaatagcccaatatgaaaataaacaacactaatacacagagttcctaaaattagtgataataaaggccggttacttaacatcaaaaatcaaagaaatgtaaaatattacaataaaccttttttgacctgtcgaatgggcaaatgtttaaaagatgaaaattgatgctagtgagggtgtagagaagctagctggtgcaggcatgaaccacatttctggatcccattttggccactgtttaaagatactaaaaaaaacacctacttcttttgaaccagcaattctccatttaagaacaaatatagccaagtagataaaatgataataagaaaaaaaagctaaaaagtcagctgcagctgggcgcagtggctcacgcctgtaatcccagcactttgggaggccgaggcgggtagattacctgaggtcaggagttcgagaccagcctggccaacgtggtgaaactccatctctactaaaaatacaaaaattagctgggcgtggtggcagtaatcccagctactcaggaggctgaggcaggagaatcacttggacccaggaggcagaggttgcagtgagccaaaatcgcaccactgcgctccagcctgggcaacagagcgagactccatctcaaaaaaaaaaaaaaaaaagtcagctgcacactatggtttaacctttgtatgtacagctaatttctggtttgtaaaaggtaaaaccttgaacacaaaataatggcaggtaacacattttacacatggaatggtgggaagggacgagcaccactgacagggaaacgtgttctgttgtgttactgctatgtaaccacagtcctaacacaagtcacattagagcaacccagagccaaaggcaggaagaggaagtgctggtcaaccttctcctgcagggctacctgacacaaggtgggccatatgcaatgaggttagctgccttcctggccgagtggcccaacccttagccttggattcaacccgtcctctacttgctgcccaaagggcaactagcagtggggccagatgctgaaatttgcacctgccagggccacatacttacctcaccctgactggggaagaccagatcccacgtgaccttctgtgacagcgagtctggccaatcaaaagcataactgctctgcccacttggcccccacttccccaggccagcttctccatggcaacagccacgcctaccactgaagaaaacagaagatacgtgtttgcaggtgctgagaggaagaaaggtctaaaggcttgcctgatgctatcaaatgaaatattaaagctgaggagttaatctgcctgaggatggcctaaacgggccatcaataaaaacgtagcttattaatcagagctgtgcttgaagatgtatgaatccaacagaacaacagagcacctgtatttataccctaccgcaaggctccatgggcaaagactctgttacctttttcatctctatatttttataggtgttcaataaacattatttgcatatagatgcaaaaacatttaataaacccaaactaacaaagtccaaataatagcccatgatcttgaaaggctattccaggaatacaaggaggatgtcccatcagggtaaactgttacataaaggatgaaaggggaaggggagcccacaagcagtatttcaagttaaaaaacatttgcaaacttcaacagcctttcctcataaattcttagcagagtaaaagcaggagaccatctaagcattataaagacttatctcaaatacatgcaaacaagcatgttattaaacattaaagatgttcctctggaagtggggacaaggaagggacagctataccacaactacaatttaacatgaccctggaagtcctagctagtgcaactgaagaaaaagaaaagtataaatatggggcaagcattattttgaactacaaaaccttatgagtaaatacagcaagagaaataattcccattaatagcaaaacaaataaataaatctccataaataaatttaacaaagttacctgcaacttcaaacaaaatttcaaaaatttacagaaggaacacaaaaattagccgggtgtggtggcatgagcctgtaatccaaactactcaagaggctgatgcaggggggccctgggaggtggagggggcagtgggctaagatcatgcccctgcattccagcctgggtgacagaactagactgaatcaccaaaaaaataaaaaacaataaaaaataaaataaaataaaataaatgacagaagggcaataagtctgaaataaatacataaagacacgtgtatcacatttaaaaagctcctttttattttgaggtggggagttttgacaaactgataatccagttcttctggaagaataaatgtacaagaatatcaagacaaccctgcataaggtctatttggagtgggaggtggtttgtctgtaaaatgactccaacacacaaaaataaagtgttttttccaatataaggatataagcactaggacaaatataccactgggacataacagagtccagaattcaactgtgtaaaagtctatagacacatggggacttaatttataataaaggactggaaatggattccttatttaaatataaactaggaactttcttacagctaaatggcaaaggataactttaacaaaaaggccatgacaggaccgctaatacctcagtgtttggttactcaagcatgcatttctagaattagggttggcctttgacgttaggaaaggccaatataaccactgctggcatggagcctcccctaagaaattaggtatttcagctacacatctctggaaggctaaggccactagggccagtgacaaacatactttgttctaagtaagttactgcatccaaaaatcagcatctctcctgagttttcattaaacaaggaatgaaaacaaagtatttagcaaaatgttacataaccattaagtcgtgttgtcaaggaatgttacagctttattttctgattataaaaataaaacacagcactacatgcaggtattgcaaaacattcaccatagaaactgcaagccacacccactggttaactttgttgctattaataaatcttaaaatctatacttatgttgttcttactgcaaatattcccatttacgtgtacacagagaatgagaatgtccacacaatggaatataatgcagttttcagaaagcaaagctatagatggagaccttgagtgtgaactgtttaataaatggcatgatctcatgtatgtaaaaaataatcaaacatatggcagtacatacaaactaaactggaagaaaactcacataaacttgtattaagactattcataaaatagaggaaatctatcagaataaatgattaataataacaagtctctgtttctttttccatctctatttaaaatgttattttaacttcgcaatcaggaaaaaaactgaatataaaaatgtaagtaaatgcaattactgtttcctagcgtgtttgttttccttcctgcccagcttgttacagcacatcaggccctgccctttctctgctgggttccccataatacaatctccctctgacccttaagcactcccaccgacagtaccctgtggtcaccatctgtacctcccctctccagtgactgtaccacagagggggctaacacgcatcaagctccacacccaaatcctcacttcattgacagctgtctagccgtcatatggctcaagactgaactctggcccacagggcaaacccatatccttcctggcttgaaggtgggctcccacacacccctcattactaaagcttccatatctccctctgctctctcttcagagcaggactcagtgttaagtagtagccaacagcagttaggggcacacaagggctagctgactctgggccaggggacaaagaaaggtcaccaacttcaaggggagggaggagaggcgccaagtgatggggccactaataaaggatccctctacacagccaggcaggaagggtgcttctgggagtctggcgttctttgatctccaaaggatgttttctttacactagatgtctaaacatgaaacctctctgtatacagaacaagcctggcgctgcctgctgcatgacagcattgccattgaagtctggatggtggtactgatgccattctttggatattttatgacactttacttctattccattaaaatgagtaggaaataaaagcatggctcttacaattaatataacacataataaagatgaaactcatcaggcatccttgccagaagtcagggaagatccatggctttaatcagagaaatgatgggtcagtgttcaactgagcagggaagaacttaatgaaagaacacatcatgcactagaaagcgtctgggaccatgtgtgagaagaaatcctgtgactccggtttggcctcaggctcccacatcccatctgatgcaggagaaaatccaccgagtctccttcagtcccatttctatttacttactttggtccctcaccatggtgcacctagattcagccccctaactcgttctacctacctcattaaaagggggctggaattgagaactttaaagtcaggaaccgaggaggttactctcttcgtctcccagggacagcgtggtgtgtggtctcgtctctcttcttgtttgctccattctcctgcctctctctgcagaccgacattctctacttcagcacgcacatggagtaagatgctgtcccagcccaggcctacgtcacctcccagtttaaatgcccgacactcagtgtcccttcatccaaattctcagtattaaagtgcatgctacagcctgattccttctagggcagtggttctcaaactcagatgtgcagaagagttgcctagggtgcttatgaaatacggagctacctttccaggtgggatgactcaggaggtctgtggttccccaggaaagaagcattcctacaatcactccaggagctgttctttgagaaccactgctctaaggtatccagtctggtccaatcacctatgaataaggtacatatgggacatagggactttagagggaaaattttatataggagcaaggagtaaatgaccaccaactccatctcacaggccacaacctccaccctctggtctgttggctggcttctctcagataatctcaacatcctgggcttatttctaccacattaagcttagcacttaccacactgcagcaaaatctccttgttgttgtccatccttgagagatttccccaaaagtttagaaagagaggaaataatatctaagagttcagtcttatgaccagcacaaaatggttcaagacaaataaagctactttaaagagacaaaatgtcttccagaacagtatgagttatttgactatattctaataacaataattggctcatctgatttttttaaggggagggagtactaaaaagtaggccacaaagcttggtccatccaaccatctacaggatagtgaacaactctcatcagacctaacttgaatggagtttggggaggacaagggtgttagataaggggcttccgatatcttggtaaccctaagcaagggtttcactgtgacaacatggctgtaccaggctatgtgacaaaccagcgctattaaagctcacccacatcctcttggttctgattccgtactcaccaagcaaccttctcattatggttgtgtttcccatgtaggtctgcctacagggagagaatttgctgatcatacacactgctgagtacttgggtccctgctattgtactcctaccatgaattaataaaccagaattgtgggaacaggaacatcctatttcaagtcacatgtcagtacggttttaagtctcctgagcttagttaaatgtggatctaccaacatgagccctcgggcaaaggaggtttccaagtctccacagggttaagcaccataatgcatatcttgagcactgaggccaggaatacaccaacccatcccaagggctcacctggtcatgtcagcttctccctaagcagtattccaccaccaccatagccacctatcttggtaaacacattcttactcttcttgtgatgggagtttccattcagtagacactgaggccagggattatgtcattcacttctggagactctaagcctggcatgatcctgtcctggatcaggcccagtatcaatgcttgctaacaaatgaacaaacagacaacctctagctatgtgcttgcttccccacatcatgtgactcactgtgcctcctctgaatcagtcagcaggccatgaacagagaaagtgaggagtctccctcctcaacacctctcaaataatctacccacttcactcctccctgtgatatgaccacaaaccaagccaccatctctcacccaggcccaagttggtctccccacacccactgcgtccaccctccccttctgcaccctgaaaccagatgatctttttaaaaccacaaatctgattatcatgatactcccatggttaaaagcacttcccgctgcacttaaggtcaagcccagttactcaccacagattacaagtcttttcacaatgaaaccacaacttaccttcttcctacctcaatcagatgccactcaacgattcccttgctctaggaatcctggattttcagctcctctctctgcatctctcaacaacaaccctatcccctctgctgagactactctccccatgacacacaccattcacactccttcagggctcagctttaatgttctttaccatctcagggaggcccctatgtggcctctctaagattaagtcagctgttgctagcagatgttctcttgcaaaagtataaatcaaacaattatgttttccacagctttaattcccaaatagactaaaaactctttgaaaacacttcctttcccccattggggctatgtcccagtacctggcacaaagtacacacttgatcaatattcacaaatgagtggatgaatctctcatgcttctttaatcaccaggcaagagaaaaagagtagccctgaaggagtagctgagtatgagaaaaagagggaggatactgaaatggatggtgtgaggccaaggagaatttttagagaatacacaatccaccagaagagtctgggtgttctcagagggcacaaatggtgctggggtggctatgtggaacacatatgcagtaggaaagtgtcagagtaaggaagtgcggtggtcactccaaagatgaatgtggcactgtgaggaggaaattcaactcacctggacccagccacctagcgtttggacctagtccctcttcctctcgccagtcgtctccaagaaggacggaagatcaagaaggcaaagctgtagaggaaaagaaaatgtgagacgccaagtttattttgcagttactgggttcctcaggggggaacaataccacaacagttccacatttatcttctatgatggcacaggtcaaatgagaccatgaaaagcatcccatccaggatgaatggccacgggtatagctcccttagaccacctcacaccctgggatgtactcatagactttctccaacaaggttacatcaaaggcattcaagtcaatttctggggtgtcttacaaccttctctggggctctagattaaggaatcaattcaagaaccccatttttggcgctggccgtccccatgttaggaccgctatcctatcgttattattaggtaatagtaccctttatcacgtaaaatattttagggtttatcaacatgttctcagtggactaataggacatagtccaagtcccactgcacctcagagtatgtgttcaatcaattagaggtccctgggggaaggaccttcatgattatgagactggtttatattccaagagtcaggtgggcatattttggtgaggttaaagagcttattaaaaactattcaaaggatgggcgcagtgactcgcgcctgtaatcccagcactttgggaggccaaggcgggcagatcacctgaggtcaggagttcgagaccaccctggccaaaatggcgaaacccctggtctactaaaaatataaaattagatgggcatggtggcgcgcgcctgtattcccagctactctgaagaggctggggtgggagaatcacttgaacccgggaggcagaggctgcagtgagccaagatcacgccaccacactccagcctgggtgagagggccagactctgtctcaaaaaaaaaaaaaaaaaaaaaaaaaaaaaaaaaattatgacaggctaggaaggaagcgtcatatgtgtcactttccctacctcaaacaaaacaaaagggctgacttaagatctccttgggtggagccagggctaggtaagtgagctctaggactccgtaggagagctagggctgggagggccacacccaaacgaactaagctttggaagctgggcagccctctagcggctctgctcatgaacagtttctccagaggccccaccctacctatggggcagcccctttaaacacacccccacctgcccagggcagcctcctagttcccatgcactgcccctctcaggaccacccgcagccctgaatttttccacctccagctgtacgattttgagtgaaaatccttcaccaacagagtctccaaatcacctagaccccaaatcttacacccacagcccacttcctccattttctcacttaaaatcccacctttccccaaatctcttaaaacgtctgagtttggccttggattccacttttctgctcactgacccaaggctgcacagctgaacccgcccgcttcccgaggcctggctttggcgccccctggaggaagtaaggcgccaccagccatgagggcacgctgcccaagatagcgggggtagggctcagctggcacgccagtgcagcccgcggtcactcaggaaggctccagtgcaggccccacccatgaaccggcaaagatggcacagaatgaatgaacacggctctacggccctgcctaccttgaaatcccctcagccccctccaacagccctgctgtcactcaagatggcgcctgcgcagtacacctctgctgcccccgccaccggccaacacacgtggtactaggatggacggggctcacgctcactcctacagcgcagctgtcattcagtaatggtgcctccgcactgcacccgccacattgaatgccggctgctctatcagacaagacacacatgctatggcccccctcagtcactcaagacaaagcagaccctccctcagaaccgcacctgcagccagcccagctgtcattcaggatggcacctgcacagtacaccgtggctgccacctaatggccagcaaagatgatgccacagagtgggcggggccatgcagaccccgtcagtcactcagtcctctgcacccggccctacagccaacccagcagtcattcaaaccagtgcctgtgtaactgccctcacgtgccccattacagccaaagattgcaccacagtggaccaggctcggcagcccctagtcactgagaaagccctccctcatgcccgcccctggggccgacccaggtgtcactcaagatggcgcctgcgcaatcaacctcgggcgccaccctgtggctagcacagacagtaccgtagaggcggtgaggggcagtggaggtgagggtgctctcagccctatcagtcccgaggaacggtcccgggccccagcccttagccccgccagcagggcgcctgcacaacccgcctcgcagctcccccactaagccgcccccatacacaagatggaaccacacgcatcctgtggtgaacaaagtcttggtcaggcaacaacaggggaaggggtgagcctctgccaccgttagccaaaaacacagcgagcgcggtgataacccgtcaccctgtccttaagcataaatggctccgcggccgctaaggcaaactctttaggcacgtctcccggctcccccagatgcggggactgagccagtcccactggcaaaacagcctggcgaccagcacacacagcccaaggagcgcggcactccacagctttccatcaccgcaaggcaggcaagcacagcaaccgtggccccgcccctccctgtggacaaccccacacctatgcggcaaaccgcagccgccccgatcaaagatggcacccaggtgggcggggcttgaacagaccgtcccgcccatgccacctgcagccacttcagccttgccccgccgcatctgccgccaaccaatccgggcaacgcctgcgcggcaaacctcagctgcccccatcaaagatggcgcccaggcgggcgggccttgtctcgcccaaccaactaggacagcgcctgcgcagcaaatctcaagcactttcattaaagatggcgcccaggtgggtggggcttgaacaaaccactaggtccaatgccaccctgtcacttcagccttgccccgccccatctgccaccaaccaaccaggacagcacctgcgcagcaaactccagcagcccccatcaaacatggcatctaggtgggcggggcctgagcagatcgtcatatccaatgctacacagtcacttcagccttgccccgccccctctgctaccaaccaaccagggcagcacctgcacagcaaacctcagcagcccccatcaaacatggcgtccaagcgggcagggcctgaacagatcgtcacatctaatgctacccagtcacttcagccttgccccgccccatatgccaccaaccaaccaggggagcacctgcgcagcaaacctcagcagcccccatcaaacatggcgtcaaagcgggcggggcctgagtggatagttacccaatcacttcagccttgccccgccccacttgccgccaatcaactagaacagcgcctactcggcaaacctcagccaccctcataaaagatggcacccaatgggtggggctggaacagaccattacatccaatgcaacccacagtcattcagctttgcctcgccccatctgccaccaatcaaccagaacagcgcctgcgcggcaaacctcagccaccctcataaaagatggcacccagtgggtggggcttgagcagacgattacgtccaatgccacccagtcacttgagccttgccccgccccatctgccgccaaccaaccaaggcagctcctgcgcagcaagcctcagccgcccttatttaagataccgcccgagagggcggggaaagaaaacccctacaggcaggacagcccttcgcccctcccaccaccactgcggcaaacaagccccgcccccagagggtagccgggcacgccggcgccgcgaggccgatggcaccccgcaggaaggggcattttcgcagcccccagacccagcccaggaggcccagggctcccgagagccgcattccgccgtggcaacagggatagcattggtgtcgaccttgctggacttgccgtggcagagcccccggctgtctgccctaatgcccccggtttgctgcggtggcccccggccagtcagaaaggcgcggagaccctgcagcagcccctcagaccccggactgcaagatggcggcaccaacgcagcagcccgggctgcgcccacccctgccccaaaaaggcaccaaccatccacagcctggccgccactgtgcccactctcggactgggcagcgggcggccaagtaccatgtccgccagcccgccctgccacaagggtcgctggcttgccgcggggtcttgggcttgcggcaagacggccactctggcccagagccgtcgcgacaccaaggtcccgcgggcaggaggcgcgcggggcggccgaaggcgcactcacctcacctcagtgctgcgcagcctcgggcacgaacagccgcctagcgcaccctcatggcgcccggcgcccggcggcgccaccagcccagggtggacatctcccgcgcctcccaaacctctcctcccgcagctgcccagacttctgcacc

SEQ ID NO: 1389 - DNA, 66171 bp, Homo sapiens; identical to SEQ ID NO: 1388

SEQ ID NO: 1390 - DNA, 66171 bp, Homo sapiens; identical to SEQ ID NO: 1388

SEQ ID NO: 1391 - DNA, 14089 bp, Homo sapiens
cagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctgtgtaccctcgtggggcggcacgggcacgtgcgctcgtctcgctggggcttggtgtcgatgttcgctccccctggggtgttcagcgcacctgcccgagtgtgcacctgtgcgtgttcgcgttgtgtgtccgcctgggcccctgtggaccaccctgcaacggtgggagcgcaggctctcagcaaacaggtgcagcagccccgcccccactcttctgagctgtgtggctttgatcaggggacttccctgtctgttaaatggaaacctaatagtatctgtagcgagaagtatggccacctttatgtgagaaaagggattcgcagggctcagcagggctgggcacaaggagagttctgggctccgggaaacactgccggtatttttattgcttttactgtggttgctggttgtcgttgttgtgactgcgtctccattctctcaggggatgacttgtttgctatttcaccatgaacactgaggctgtggggtgtgaatctcctccccccaccatacctctgtctcatcccctttccttcttcctcctccattcactgcggatccagcttctcctgaccttgacctgatggctgtcgtctttcccatctgtcaccccgcttgcctgcattttctcctttctcatgccttcccctcccctcaacctagatccatgattaattatgtctcatattaaaaacaaagccaagcaaaaccccaaagcaataaacaaatcagaactccctaatggtactctctaacactctttcccacgaaggtcccataggaattttcttgccctgaaaaatgtctaggcagcctcctctcctcactcccaacagactccccggcccacactgaggttgcaaatgggcaaccccagggtctaattcagccccacaacttgtgctatttgactaaaggtgtcttcctgttaaacactggaaataattattgacatcatgaaatgtagaaaatgccatctgaaaatatagatttccagtcttcttttgagaaatcacaggatgggcgacaccagtcccatgcgtttgctctgcagacattagctgagttgcatggtgcagcttcttcagacaggagacctgatctctcttgccccactccccactgcctccgtcgtctctccccatgccatatatccactgccatttgttcatgtgctccttacaatagagaagtatttctctggacctatatttaattttcatttgtagaaaagtgacagtaaaagagtcctcttgattgactcattgattgatttttgagagagtctttctctcttacccaggctggagtgcagtggcacgatcctagctcactgaagccttgaactcccaggttcaaaggatccttccaatatctgagactacaggctcgtgacaccacacctggctaatttttaaactcctgggctcaagcaaccctcccaccttggtctcccaaagtgctaggattacaggtgtgagccacctcgcctggctgatttatttattaattcatgtcgtttcctatcccatttgttatatacaaatgtgcagactggagaatcatgtgtggctgtaggtgtgtatatgagtatgtgagtgtgtatgtgtgtgagtatgaatgtgagtgtgtgtgactgtgagtgtgtatgagtgtgtgtgttagtctatgtgagtgtgtgtgaatgtggatgtgtgtgtgtttgtgtttgtgttagtgtgtgtgtatgtgactgtgtgtctgtgtgtgtgtatgtgtggatgtgtttatgtttgtatgtgtgtatatgggagtatgtgagtgtgtgtgtctgcatgtgcctgcccatgacaatcactccctttccagctttgtctccagagcaccctctagcgtttgacctgctgtgtgctttatttgttccctgcctgtctctttgtctccctactagaatgtaagccccaggagggcaggaatctccacttgattactgctgtatttctaatgcttacagtcgtgcctagcccctgctggccctctgtaatgattcactgaatgatgaaatgtccatcagtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaaggtgagaggcaggggtcctttgggaggtgagtgggtggagaggaaggaattggcagagcctagggaaagactaaacattcactccttcactcatccattcaacagctattcatggagcactgtgtcagtcagcttttgctgtgtaacaagtcatccccaaacttaggggcttaaagcaacaatcacttatcagctcatgattctgtgggtcagaagtttgacctggcttcaggggacacttttcctgcctgtgcttgtctgtgcagcctcagagagctggtgaggccactggtcgatctcagatggctttacccccatgtctgctggtgctggctgttggctggcttggtggtgctgaggacaggccatgtgtctccagcaggatttttcagggttatcctcatgggggtgcttgcagggttctcagggatggcaagagagggaattccccaattttcaagcactggaagatttgaagaggaaaaacacatgatctcatttgcatttcaaaaatattcctctaactcagtggatttcaactgggcgtggtcttataccccacttctcctccccggacgatttttggcagtgtctggaaacatttaggattatcctaactgtggagatgctgctgttatcttgtggggagaagccagtagtgatgctgataaacgtcctaccatgcacaggacggaccctccccccacagaaagaatggtgcagctccaaatgccgatagtgccaagtttgagaaaccctgagtctcactgcatgtgagaatggattgtagggctaggaagtcaagaatggaaggtgggaggccagttaggagattcctgcaactgtccaagacagaggtgaggtaagtggagagatttgggacatctttgggagaaggaatcagttcttgctgatggatgtggagaaggggaggaaacgagaggtatcatgatgacttttagggttttggcccaaacagatggataaaggatggtgccatttgccgacatctcaatgacaccccatagcagaaaggggctgaaccttataccaactactaggcactgtctttttcctcaggggatgagcagggctgggacagaaggagtggataacagaggccagctctgctagtgaggcttggagctcctggctggggctaaggtgcagaaagagtggaaaatgccaggatttgcccagtctattcagcttagggatgagaaggacactaaggttctgactatggggacatgtccccactagtgtctgttctttggaagctggggaagcctccatcatcctggtttacttctgtggctttttcttctgctccttcactcagtttctgctgggggcctgtagagaaggaactcttttatctactggacaggtaagggactgaagactcaagtggcagggcacatcaggtgacccagttgaagttttctaggtagttatagaacagaattcaggtctttcattctctcagccccatctgaatcatcacataggcatatgtgtgtttgtgtgtgtgtggggttgtgtgtttgtgtgtgtgtgagagagagagagagagaaggagggtgagagagagagagagagagagagagagagaggaggctattactagaaaagggacaagatgccagtgggaagagcccactcctgccatctggccactcactcatggctcctttttcctccactcccaccctcacccagacctgtcttctcaagagactgggctttcccaggagtggagctcggtggaggaagatgacgaatcagagggctcccaggtacactggggggtttgttctttttccacaaatgtcccactctgtagatctcagcactttgtcacatttgcattctcagcttggaatttacctgccccataaaaatctcaagagatctcttgtgtctgatctctatggtgatcagacacagactggagggtctccatgtggtgtgtgtaactcagttcacatgtaccctccaacacttccttcataaatccatctacccatgcatccacctctgtacttcatcttctgtccacttattcatcaaccctcccttccatccaccctcttacctttccaatcactcatccattcattcatccacctctcaaacatctactagccattcactcatctgtccactctttcatccacctaaacttttattcacctacttgcttgtatacccattccatccatccatccatccatccatccatccatccatccatccatccatccatccctatacttcatctgtttatccacttatccatccatccatccatccatccatccatccatccatccatccatccatgcatcaacccatccctatacctcagctgtctatccacttttccatccacccataaaccctcccttccacccaccctctcacctttccattcacctgtccattcattcatctacccattgaacatccaccaactattcatctgtccactcattcatttacccaacctttcatcccttatgcatccatatacccattccatccatccatccatccatccatccatccatccacccattcatccatccatatatccagttatccatatacatactcattcacccttttattcagatgccatcaatccatctgttcaatccacccacctacatatccatcccctatccactcaactgtccacccacctattcatccctctactacctgttggctgtggtgaggatatggctagtatgcatccacccatatgcccacacattcattcatccatctgtatctattcacacacccagtcataagaccacctaccaatccattcacccatccacccactattccatttatccatccactaatcatctactgagttttaatccagatactacaagtaaaaccaaagacaattatcaaacacatttctttcactcaaaaacctaatgttttcttttttgaggaataagatatcaatataagaaaaccagtggttctttcatttatacattcatctcatacatgagaaaaatcacataatcactctcagtgagcacatgagagtcccatccatctcccaatcatgtcaggaatgtaactctggctgcctcaagccagaaaatggatttattggctcgtggtgcagggatgagggcgagggaaacaaactggccaacaaaccatgatagtgcagaaataagtgctgggcacagtggagtggcccaaaggaagaagttaactgcatgccaggaggtttattcttggatatcccagagaggaggacacaccacacctggagttttcgggatagtaagaattccacaggcatagcagggaagggaacaacatgtgcacaggcaagttggtataacaaggtacgtttcagggacactgaagttaagggcagagcagtgggaggtttgggtgaaaatatggctgggatgacatcattcactcattgcacgtctatttcttgagcacctgctcagtgccaagcagtgttcaatgcacagagtgtacaatagtgagacagaagtggtccctgccttcatggagctcacagtcaccgaggtagacagacgacaattgaaataagcagctaaaatatgaattgggttgagtggtgataactgctatggagaaaaatgaagcaggaagggggtttgggagtaggagctggggctgggggttgctattttaagaagcttgtctaggaaagtccccactgagagggagctattgagtgaggacctgaaggaggtggggagtgagactggcagatgtctagggagagcgggctctatgcagaggacacagcaagtgcaaaggccctgaggtacagatgtgcctggtacatttggggaacaccaaggggcatggtggtcagtgtggctggagggtgggagggaggactaggaggtgaggtcatgggggcgatggggtggatgatgtagtgtctcatgggccatggtgaaatgtgagttttactctgagtgggtgggagccataggcgagttctggacagaggagggacatgttctgatttggcctttagcaggactcctctcactgctaagtcccacaccgaggaggttggatgtgttttgcaggcagtgggagccatcgaaggtgttcggggacttacagaatcactctgggagcccatgtggaaggaaggtgggttggatgtggctggggttagagtttagaggggcaaaggagcaagtcagaaatgtatagttagggaaaaaaggtagaaatgaaacagagaagagttgccactttccttgtgcatgttacaagcttcatgctattctttttattttttatttttttgagacggaatctcgctctgtcaccaggctggagtgcagtggcactatcttggcttactgctcactgcaacctccgcctcctctgttcaagtgattctcctgcctcagcctcctgagtagctaggactacaggcgcacaccaccatgcccagctaattcttgtatttttagtagaaatggggtttcaccatgttggccaagatggtcttgatctcttgacctcgtaatccgcccacctcggcctccgaaagtgctgggattacaggcatgagccacgacgcccagccagcttgatgctattctaagctcatcttattataacacatctagtaactgaacactcattaactctcataactcatgagccttgtgagattgttagcatggtttcctcctctacagatgaggaaactgaggcagagaggaaccaaatggcttgcttcaggtcccacaatgagtgggtagcagagctagcatagagtttgggcttggaggggaggataggagcgaatgggacccaggacctgatgacatttccagacctgtggaacgtaaaaggtgaaggaacagggacaagcccaggggcaacacgtgaattctgatgtggggacagggtagagggaggttctagcctccagcatagggatcaaggaggcagtttggaagaaatgacaaggtcgattttagacatgctgcttgggagaggcctctgtgacatcattcattcactcactcgtttgcccagttgtaattccttgagccagcattgatggagcacacaccagggggctgataggggagggcctctcattggcaggccctgggtcagttttctgcatggacagaccctccttcctgcagacaaccaccctctttcaaaaaagaaagaggagcgggctgtctggaaccagagacctttgatgacagttacagcctcattatgggccaggagctggactttgtgctctacttaccttaatttacttggtactcttatcagtccttgatgtaggacctgttatcccattttacagatgggaaaactaaggcacagagaggttatgtgactttcccttgtcatgcaacgtgtaaatggcagagctaggatttgtacccagcatgtctcttaaccactaggtgtcctgcctgtgcttggggcagagatgaaggcctctctctccctgttctcctagtcactatacctcctgtggagaggagtgagtgaagaagtggaagaaagaaaaagagttactttccgggagggcagaagttcccagtctgtgggcacagaagaaagcaagcaggggaaaatggtcccatcattaccgttccataaaatgcaagcatatgtaacacctgcaaatcttatctaagtgcatgagattttaaaaagatcaatgcccagaaataacccctggtaaaagttgctgtaacaggccaaattcatccatagtgtgagaagttggggtagtggttacctttgaggtggggggatttcggggttgataatgatctgcttcctgtttggggtgctagttacatggtgtgttcaccttctgaaggtgcctcaggctgtacacctaggatgtgtgcaacctcccctttctacattccacttcaacagaatgttttaagctggctgggcacagtggctcacgtctataatcgcagcactttgggaggcagagtcaggcggatcgcttaaggtcatgagttcgagatcagtctgcataacatggcaaaaccccatttctactaaaaatacaaaaattagctgggcatggtggcacatgcctgtaatcccagctactcaggagactgaggcaggagaatcgcttgaacctgggaggcagaggttacaatgagctgagattgtgccactgcactccagcctgggagacagagtgagactctgccaaaaaaaaaaaaaaaaaaaaaaaaaaagttgctgtatatatccttgtatatatcctgccaaacatgtttccctatatactgagactgaattgagatttgtgtgccagtgcttgattgagggttgtgctctcaggtgaagcccagcggggagtgagggaagctggagaggggaggagagggagccaggcaaatatactggtagaactgaaatccagtctccgtcttatcgcaagggaaccctggaatgtgaatagagagttgtcctcctctgggctgggcgcagtggctcacgcccgtaatcctagcactttgggaggccgaggtgggtggattacggggtcaggagttcaagaccagcctggccaagacggtgaaaccccgtctgtactaaaaatacgaaaattagctgggcatgggggcggatgcctgtaatcccagctactcgggaggctgaggcagagaattgcttgaacccaggaggcacaggttgcagtgagctgagattgcaccactgccctccagcctgggcgatacagcgagactctccttctcaaaaaaaagaaaaaaaaaagagagagagagagagagttatcctcctctgagtcagtggagtggccttttgtatcccatatgagttattgttggctgtggactgccctggagggcgaattaacctcctgggtaatcctctaggaaggaggatctcattagcaaagggcatttgtcagaagagaaggagcaactacaaactgtaaaccatacaagtagcggccaatacccctagcctccaggggagagctgcaccagcctgaaaaacagaaataaagagaaattaggtgaggcatccatgggtctattatgtgtgatgtgtgtaaaactattggatttcagattacctgtatttattacattttcttaactttatattctgcttttcaaaattgaagtataattatttccaataaaatgcactaaccagagagtgtttacacatgtacatccgtgtaaccaacaccccaatcaagatattgagtgctgtcataattctagaacattctcttattttcccttctggtccatctcactccccagccctggaagcaactacagttcttgatttccacttgcatggattagttttgcttgttgttgaattttatctaaatactgtcatgtagtaaactacatatatattttttaattccaaaaaaggaaattatggcaaaattgttattcctccagttggcattttcacttaatacgtgctggacagttttccatttaatatatattgattatcttcattgtatttcaaagttactttttcctgctgccaaatattctctagctcagttgtgtcagacccatttccttgggtgatgaattgctaggctcccattgctgtcactgttacagaagacaatgctacaatgagcgtttgttcagttggcccaattttacgcatggattatgaggaactttataaaaattcacattctctggttctcctcagatacactgaaccagaaaatccaaaggggatcccaagatattcaaaaacctctcccaacaacttttggtgctctaccaggtttgggaactgcttaagtgggtcattgtccctaggtatctggttgtaaaggaagatttgaaataaggtgtcatccagagggaatcagcaggctaaagggaggaatttgtttcaaagattataaatgtgaattccatcaatgatttataatatactttaataattcgtagtctgtgtccttccatttttcttttttcacaggatttttttcagtgttcaccattgcctaactttccagataatccattatgtcttgtacattcaccaaacttccttgatattttaatagcaattgcactaaattcatcattaatttggaaaattgtcatcgttaaacattttgtcttctcatctcttatcatggtatgttttttcatttatgaactcattcaacaaatatttacagagttcataccctgttccaggcactgggaatacagtagcaaacaaagcaaaggtttgccctcttggtgcttacagtgtcattggaggaagagacaataaacatacatagcatgtcaggtggtgataggagcatggagaaaaagacaaggggcatgcatagtgcagggttaagggtatctggaggaagggcattccaggaagaagaactcgtaactacaaaggcttggaagtgactgtggctggaacagagtgagaaaggcaaggaatgacgtcagcgttagaaggagcactctgactggcccatgggcaagaaattgggtgggattatcaagacaagaaacaaaattctgtatcaagagtacaagatagatgacagtggctttggccagggtggtggtagtgaagggaagggaaatggtcagattctgaatgttttgaagataaagccaacagtacttgctgatgtcttgaatgtgggtggtgtcagaaagagagtcaaggatacaacaattggaggtctggaggggcctgaaggggtaatgggaggaaaactgcatgaggagcttttttttgtgggggacattacaatatttgtttggggacatgtgaagtttaagatgtccatcagatatccaactggagatggcaaataggcagtgagatatatagttgggtcaacaaatacacatacatatgcaagcacacacatatctcttgagggggtggggtcattagagcatagatggtatgttaaaactgagatttaatataccagtgagattttgaaattgtcatcccattattcgaacatttcctctgagagagcatagttatgttacattcttttgtttatcttatatctactcagttgtaccgttttaaattcaaacagcttttctcttgatatgacatttcatttctgatcatataagtctattttcctgcaagtaacaatggtggccccttcctttccaatatttatccttttccttttttctgtttcagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaagatcaatgaaatctggtacatttcctaacatcaaaccaactttgcattcttaaggttttggtgcaccagtcttttcatacactagattatatttattgatattttatgtaggattcttgcctctatcttcacatgtgagattggtgctatctttgtgaagttttggtatcatggttaagcttgcatcatagaaagacttgggtaacttttaccttttctatgcttttcaatagtttctgtagcttaggaagtatcagtcccttgacaccttacatgaattcattgttataaccaggtcatagagtcatggagagaacgtttcagctaattcttgggcagctttcttagttctttacaatgttatcagtttattaatactttttacctcttgcatttattttggcgaattacagaggtttttgtttttttttttttttgagaccgagtctcactctgtcacccagtctggagtgcagtggcgccatctcggctcactgtaagcagagggttcatgccattctcctgcctcagcctcccaagtagctgggactacaggcgcccaccaccatgcccagctaattttttgtatttttagtagagacggggtttcaccgtgttagccaggatggtctcgatctcctgacctcgtgatccgcccgccttggcctcccaaagtgctgggattacagatgtgagccaccgtgcccagcccagagttcttttatcctctagaaaattcttcattccatagagctttttcatattattagcttaattatgcataatgttttataattaaaaatttctctttattttgttctatcccctgtttcctgtaaactgctgtttgtggtttactcgttattagatttgtcaaaggtttatctagcttactattgtttttccaaagaaccaacattaggattcatttatatccattatttcttttatttgtaatttgtttttctttgatatgtattgcatttattttttattgtttttcttctttgtctcagtttttatactgaatacttgatttatattctctttatattttctataatagcatacttattaacgcaaatgtacttctggatatagcgttggccacatcttaacatttgattattcatttttgtttatgttgtctaaaaattacattgtagtgtgtctaaatattacattgtagtgtttctaaagagtgctttgaaactcagtgatttggtttattttttgtttaaaaatagttttgttttcttgttttactgcactgtgaacacagaatgtggcctataacacatctgcttccaaaactttttaaaaagcttttagtgtggcctagaacatgtccattttttgtaattgtttcacgaacatttaagatgaagatatcttctctgtctgtagaactgaaaactttatgtgcctgttagttaactcagtatcgtcaattatattgttcagattcatgtgttatctaattttggcctattatattcattaaaaaccaataaggttatgtgaaactttgttagtacaattgtttttgctaataaatttttataatctttgctttatgtactcaacagctgtgtaattcgaggcatataagtgcagcattgttatgtccttgttaattaaataatatatgtaaaacaccatatgacaatggctggcagatagtaggcactcaataaatgttaattaaaacctg

SEQ ID NO: 1392 - DNA, 28882 bp, Homo sapiens
cgcggtcattgtcctggcagagcggcgagccggtgagtgtggctgcggggtcgcgcccaccctctacctgtgccgggggccggaacctggccccggggagggcgcggcctcggggagacggcgtgcaggcccaggtacggggagtgcagggctgggtgctggtccagggcgtgcgggcgcaggagagggcgtgcaggccgggaccgaggtgcgcctggagaggctgagcggccgaggagaggctgaggggaagctgaggggctaaggagaggctgactggaggctgaggggctgaggagaggccggggccagggagggagaggcgtgagtgggttggaggtaggaaagttgcatgaacacgagggccatcctggggggaaggtggcctgtgtgagagacaggcagtgcatatcatcctgaggatgaggctgtgtctttgtggatattgtgaatgtgtctgtgtgtgtgtctgtgtgggtctgtatgtgtgtgtgagacagattgtgtcgtcctgagggtatggctgtgtctctggatattgtgattgtgtgtgtgtgtttgtgtgtgtgtgtgtgtgtgtgtgtgtgtgtgtgtatgagacagagagagaaactgcgtgtcgtccagaggctgggtctgtgaatgaatgtgaatgtgtccatgtatgtccgtgtgggtcatgtgtggtagcgtgtgtgtgtgtgtgtcccacttcttcagagtcttggtctctctgtggagctgtgtctctccaggtctctgcctatgcatgtgtggtgatatctctgagtgactgcctgtgtccttgtctttggtgttgtgggtgtgtcagccttgatctctgtccatgagtgtctctgtgggagggtgccctctgggtgtccactatgtctgctctttccatgcatgtctcttggcatgagtgtagggctgtgtctttccaggggccagtcctgtctggatctttcctatctctgtgtgtccacctgtgtctagagtatttcttgatgtttgcgtgtgactctgcaggggtgggtgcgtctgggtgtgcctcttccaaagactatatgcctggacaagggagcctagcagagccactaccttctcaccctacgcttctcctagtctgcctgcccacagttccctggctttttcctgcccatagaaggctctggaggcgtaggggcctgggagtgacaggggccgggtggaggaggggaaaaggaaggctgtttcttctgcctcccacaggatcttcttaaagtgggatcagactcccaaagggtctctgtgccctactctgttctgaccaaggagaggttgatttgttcagggaatgtgtatgcagccagtgctggccatttatagatgtcccagtaactctgaggtagagaccatcatcatccttatcttacagatggggaaactgagtctcagactaagtgactcacccaaggctacctcaggcatccaggttccagagcccccacaattaaccaccagacaaatgggagatcccttttttccctttccgctcagctgacacaaggttgcaggattttccccgagggaatccccgcttggaaacaatggaaatggaagaaaggaaggaaatgccaaaaagctcagaggaagaagaatccagatctaaggccaaactgggttcaacagccactggccatactcttgggcaagtcacttccagggccgctgcatgatttttaagggtactttgccttcatgggccccttgctccattgtttttttaaagcactaaaaattacattttgttatttcattaataggaagacaaatgtaatctaggctggattagatattttcttatgattttaaaagaaattaagaccttcctatgggcccctaaaggtttcatgggccccatgctctgtgcctactgggtaagtgggctctggtcactgctgtgatctggcaaaatgggccagtgttcttgacctcacaggacaggggtgaaagagaccactatctgcaaggaatttttttttatattaaattgtgtttcaaaaatgttgatggtaatatgaagtttctacacccagggaaacaattcaaaggaagagaaagaaaaaataattaataacttctacccccttctcattcccactccatgccctccagacaccaacccagcctcattccacagccttccccaggctggaagatgctgtacagatgtgtccacatccacatgttttggtttgttttttcacaaaggggctaaaggtatgcataaaactgggtaacttgcttttctcacttagtgaaaccacagacatgtcaacagatgcagaactaactctgcttcgcagaggcgacctgatacttcatactatggagaccctaccctcgatttgattcctttagtaatgtttattaattttgttttcagggtttttttttgcctctagaaacaatgctgccataaatatctttttttcctatatgtaacttttacacggagcttttattggtgtgggcagattcccaggaacagggttgctgggttatgggatttgtgtattgccagctcactttccagaaaaatgttgagcgactcacattccctcaccagtgtgtgagagggcctgttcctttcaatcctggccagcactagaagttagctcatctgttcattcagcttgatgtctaagtgcctcctgtgtgttagacgttgtcctagatgtcggaaatacaatctgaaagtgatcatccctgctccctgggggcttctgttctcatggagggaagacagatgacaaacttgaaaacaactattttaaaaaagacagttgtcaatagtggtttgtactgcaagaaaatagagggggagagagttgctgcttgaggtcaggtgattgggggtagaggacttctccaaggaggtgacgttggagctgaccaggaagcaggggtagtcatgggaagagcattccctccagagggaacagcagatgcagaggccaggaggcctggggccaagcatgggagaggggagtagaggagatggaaggggagaggccatcaggggcacatcataagggctatgtgggcagcagtgaagactttgagtgatttctaatggtgggggaagccaacgaagagttttgaagagttttagcccagaggacattttcactgagtgattacagttggccaggtgtggtgcccgggtacaggcattaagtggtaggaacccccagcccacacctttgtgatccttttgttctacaacagggcttctcaacctccacactactgacctttgggcctgatcattctttgttgtggggcctgtcgcgtgcatcgtacagtgtgtagcagcatccccagtctctaccaactaaacgcccatagcactcccctgccaaattatgacagtttggcaaatgtctctagacgttgacaaatgtctccgggggcagaattgttcccgattgagttccaaaggcttctgccaacttggccttatatatatgcccccctacaattaaaattacttttcacttgtggaagttggggccatttggcctaagaaaggctcttctttgtcttagtggttcttacgctttaagacgtgtcagaatcacctgggaaacttgcttagaaataccgattcaggggccctacccaggtagtttgattcagaggatctgaggtggggggcaggaatatatattctgagtgagattttaataagcatccccagtgattctggtactttgagaattggtgcaccagctacaagagcattgtgttggagaggattgaggcttttctgggtgatcttgaagggttggagatgtagagaggcatgtttctgtttatagcagaagaaaaactcatttccagtcagaggtgttggtggcacgggtagtgagcccccatcacgggagaagccaggactgagccagcatgtctcagactccaagaatttgtcctcatctgtgtcatggatcctatttttttactttgccatttacttgatttggctcactgattttttttttgtttttaatttaaatcaacttagtttaaaagggtattctgtgtgactgctgtaaaagaagctgagttttgctgtaagaagggaaacaaactttaaaacaaattgaagtaaagccaggtagttctaatgagatattatggtcaccctaactttggggcctgaaccctgcttttctttttaattttaatttttaatttttctgggtgtgtagtgggtttatatatttatggagtacatgagatattttgatacgggcatacaatgtgtaataatcacatcaggataaatggggtatctgtcacctcaaggatttatcctttgtgttacaaacaatctgattacatttttagtgttttgtttttttttttttttgagatggagtctcgctctgtcacccaggctggagtgcagtgttgccatctcagctcactgcaagctccgcctcctgggttcatgccattctccttcctcagcctcccgagtagctgggattacaggcacctgccaccacacccggctaattttttgtatttttggtagagacggggtttcaccgtggtcttgatctcctgacctcgtgatccgcccgcctcggcctcccaaagtgctgggattacaggcatgagccactgcgcccggccagttatttttaaatgtatcattaaattattattgatcatagtcaccctgttgtgctgtcaaatagtaggtcttattcattctttgtgtgtgtgtttttttgtttttttggggtttgttttttttttttttttttgagatggagtctcgctctgttgccaggctggagtgcagtggtgcaatcttggctcactgcaaccctctgtatttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctctgtatttttttaataccaattagccatccccacattccccccacccttccactacccttcccagcctcaggtttcttcatcattctagtctctatctccatgagtttgttttaatttttagctcacacaagtgagaacttgcaaagtttgtctttctatgcctggcttatttcacttaacataatgacctccagttttatccatgttgttgcaaatcacaggatcttattctcctgcttttcttttgtttcaaggggcgagtgatgggttgcagggatgttaagatatctctccacttgagactttatcctgagcttgtcaggagaactggaggagaattgaatcaagatgcatttctctaggcgaatctggctctgagagcccctgggtggaagttccttacactcatatctgctagttgaacctcatggtaaccccatgaagtctgggggaagtgcccaaagaggccacaggtggttctggggcatctcagggggcctcagtccagcactcacactcaaggagggatccgggcagggccattgggagaaggcagggtgtccggtggccctcagcagcctgcgggaatgtgtgtgagtgtatgtgtgttaaccatatctataggagtgtacatgggagtgcatctgtgaggcattgtagcctggaggctaagctgtggacccagacatactctgcctgactccagtcccagctctgtaatcttgagcaagtggtttaatctcctcgggcctcagcctcctcatctgtgaaatgggtaggtagaagtagtacctaccttccaggatggttggaagatcaagtgatatacattcaagttccctacatgcagtaagccctctaaatactcactgttgatgtatgtgtatgtgtgtctatctgtctgtctctgcttgtctctcagtgggtgtgtgtctgtcctgtctacatttgtgaggccagcctaggcctggtctctcagcatgcctccctctttcttctccctacagcactgttggtcaccgcaggcctgtcttcctattcaccgtgggcagcagagggatggctgctcagctgctgactgatgaggcactggtgagtcatgttgccctgtcactctcctttccaaaggctggatcctgccttgggtgagcctctgctgctcgaaccctctccaaggcccccagtcccatcttctggggctgtgtctgccctgatgaagagggctgtgcttatagatgatgctgaccctggctgtggggtcagttgtaggggacagggaagctttggaatggccaaactagctctctggactcttaggagacacaggtgggcacctgtgggaagtggtggtttagacatgtgacattgagtgaaaacttgcgcaggaccatgctggatgtgtgacctttaaaatgggcaaacacactaaatgcttcttgtgaatgtgaatgcccacatgtgtgatgaaagtacaaaagcttatgggaatgaggcccacaaattcacccatgattttaccccaaaagataatcactctggaatgtttgagtctggctaagcaattttaatgttaaagattgctttttcatcagagatttcatcctgagcatttctccacatcattaaaaactcctttgtaacgtccatcttaatgaccccataaaagtgttgttcagtggccataccctggtttacttaatggttcctctgttgttggacctttattggtttccaagtattctttttttggttataaacagtgtcatgagggacactgggcacaaatctttctttgtgtcttatatgatttctttaggagtgattccttgaagaggaagattgggttgggtatttttgaggtattttgatattatttccacatcagttacggcggtatgtattcccaccagcatgtctgagcgggtctctgatgatttatatggctgttgtcaggcatttattctgcatgttggatatatttagattggtgcaatattgcaccatgataataaatgataaatggatataaatgacaaatgctataaaccatgatgagcctgataggggacaaatggtgccacgtgatttatttctgagtagcattgtttgtattattagtgaagttcaagtcttagaaaatgtttactagccatttctgtgggcagggaaatgatccatcttgtgctttagcagtctacaggaatctgagtatgctttaaagactttacagaagcaaatgtgtgtgtgtaaatatttgtggcaaatattcttcccagatttgctttttgtttctttattttactttattttttctgtataaaagcatttcatatttttaaaatcaaatctgttggtttctcccactgtggtgtctttcttcatctttaagctgtgaaagggtttctccatccacaggtcacatagcagctatattttcttccttttcaccatttgtcatttgaatgttaacaatgaacttttgaatctacctgtaattgattttgctatataaatgtgtcagtagacttatttgggagctttggtttattctgtcttcatttgtttggtacctttgttgaggtacacatcacgtatcacaaagtgtacaattcactgattttgggtacattcatagagtcgcgttaaccatcaccacagtccatttcagaatattttcatcatcctgaaaaagagccgagtacccattggcactcatttccattttcccccatcagtccacggcccctggcaaccagtaatcagctttctgtctctatgaatttgactgttctggacatttcaaataaatggaatcatacatggtgtggtcttttgtgactggcttctttcactcagcataatatttgcaaggttcaaccatgtggtagcacatatagagcttcattcctttttttgactgaataatattccagtgtgtgtttctacatattttatttatcctttcatcagttgatggacatttgggttgtttccactttttggctattatgaataatgctgctatgaatattcatgtataagtctttgaacatatgttctcagttctcttaggtgtgtacctggaagtggaatgttgggtcatatggttaactctgttgaaccagtaaaggaaccaccagactgttttcctaagcgattgcaccatgatgccttcatttttgtctcatctgtgattcttgccttgaattcttcttttacctacattacttagaaagatttgttgattgtttttatttcaacagggttgggagttttggtttaagttttttttttttttaattactactagtgtaattacattcaatttttaaaaaaaattgagcctgtctggtttcagcgttttccctgtggtgaaatggtttgtgtcattagacaggaaaccgaaaaagatggagtactagaaaaaggggccttggacacgtacgtgcagagaactcagaggccctttgttagcacttctgtcccaacacgatgggctcccagacctggaaggctgtgttctgtgtctcagcacaaccctggtgccagtctgggcttggtgcctggagactgctcagtgaatagttgagtgaattaggtgggtgtacttagggaagacttccagaaggaattgttgtattacaattttgtaaaataaataaatataggtgtgagagggaacttttggaggtaatggatccgtttatggccttgatggtggtgatggttccacgggtgtatatgcatctgcaaactcatcaagttatgtatattattaaatatgcacagctttttatatatcagtcacacctcaatcaagtagtttaaatttttagaaaaggaggaattattagctgggctggctgaaagatacattgggccaaaaggtcaaataatatcatataaggatctacagttgtacataagatatatattaaatatcaacattaaataatagcaagagtcgacatttactgagagcttcctccatcacacgaggcactgtgtttggaccatatttgtacacatttaaccttacgaccctgtggagggggacattgttatcaggaagcctgcctctcatatgaggcttagaaagagaaagacagttgtccaaggaaacacagctcatgaggggcagagccaggattccgttgcagagtgtggttcctgagcctacactctgaaccaccagcccaactgctttctatcaaaggtgacccctcaggcagaggaggctatcttgagcccaagccccagaagggcaccctaggaccatagagggactagccagcgggggtgaggcctccccttgggattcagttggtggtggggacactcagtatgctggagagagccagtgagctctgagtgtcagtaacaatagctggcacttattgagtgcctgctgtatgctatgcattaccattctgagtgtcttacataaataagtgggcaggtggggcctgtagcaaattggagctttcttgccccatcaaagggtcagccaccactcagctccagcctagagtggccagatattctgctgtttaaagagaaactagaaattcattttcttggtaaattgtggatgtgtttttcatgtgagtaacaattaaaaacaattttgaaacccccataggagcaaaatagaaatgtgtacagctggcttcaggcccaggtacatctcatatgctctgtgtgctcagaactcccgttctttccttgtgccttgggggttgtaccactgaatcagttcagaacagcaggtccctctgtaggacacaataggtctctcattactcacatgccatgctgtgaggaagcccaagcagccacaaggaaaagtgatgtggagaaaaagagatgcccaccaaggcctcagctgtgccatccataccagctcaagagacagacttgtaaacaaagaagctagcagactactctagcccagctgccatccaactgccaccacacaagagatgccaggcacgaactgcccagctgagcccatcaaccccaaaatagtaataaattgttgtttttgagccattaagttctgagatggctgctacccagcaaaatataactggatcagaaatttaatctgtggccatggctcaagatcttcatgtggcagagtcatgcatggatgatgtgatcagccagcaataatgtgagacgtgcaggccttcatcacactagggaggaggtcgactgtcaagcaccatctctggaagtggcttcaggatcgcttgtgatctgtctggaagagaagcgccagctgggacactctgtgatatttatccaactgtcttctttataggcaaaagacgtgccatccatctcagggtctgatccaaactaaactgctccttggctgtgatgccagctagattggtattatacatggatgaggccatctaatgttggggctgagagttgaactgactaggtttaaaatgctgccactcccatctgtgtgacctcttgtgcctcagtctccccctttgtaaaagaaatgagctcataaaagtgcctacatagtagggttcttttgaagattaagtgagatggtgtgtgcagtgggcttagaacaatacctggcatgtagtatgtgcttaatgaacattagttatttttatcattatttactaatgaattagtatggaagaaacctggtgccaataccatgtctgtcttattcacagttgtatgcccagtgcctggtgcatggcaggcacttaataaatattcgtcaaatgaatacatgaaagggtgaagtatcactctgtgtgtttccaggaaccatcaatgaacatatttagaatatgttagaatatgtattagataccattgatctagaattcctgtttagggggtaaaaattcaaccatacttttctggtagcccggaaaattataaattaatcagttaaatttccgatccagttatattttgctgggtagtaaccatctcagaacttaatggctcaaaaactacaatttattactattttggggttgatgggctcagctgggcagttcgtgcctggcatctcttgtgtggtggctgttggatggcagctgggctagagtagtctgctggcttctttgctcacatgtctgtctcttgctgtggtatggatggcaccgctgaggccttggtgggcatcttttttttttccacatggattttccttgtggctgcttgggcttcctcacagcatggcatgtgagtaatgagacataatgagacacctgttgtgatgactggcttctcccagagcaagtgttccaggaggctgaggcaggagctggaagtcttctgtgatctagcctgagagtcccagaacattacctctgccagattctattggtcaagcaggtccctaaggccagcccacattcaaggatgggggaactagactccactagtgaaggatttgaggccattttcaacaagtctacccacttactattgtctaccaaagctgacttatattgaaagagacagtgaaaatgggtaatttgatccagcaaaatataactgtatcagaaatttaactggtgttttaatttacaattttctgggctaccagaaaagcatggttgaatttttaccccctaaacaggaattctagatcaatggtatctaatacgtattctgatatattctaaatatgttcattgatggttcttggaaaggtacctgcattttccttgcttgggcagcaggactgggcatttctgattcacagccctgagtatgataattgagagtatgagagttgtatgctcattttgggcaaatactcaaagcaggtagctttttatgtgtcttcctatcacatacgattgctttcttgggcctgttcaaggtaccatgtaagaaatttaaggattcagtcatttgttgtacaaacatttattgagtacctactaagtgccaggcgctgttctagggtctgaggattctgtggtggcccaggcagacacaacttcacaaccccccatgacgtagatgctgttatccccttttaacagaggaagaaactgaagcctgcagaggttaggtaattgaagatgttcactttcatacattcacatagctagaaaatggccaagccagggtttgataacaggtctttgtacttcccagacatgcccttaagacactgcactgtctttcaaaaaacaaacaaacaaacaaaaacactcacccccctgtattacttgtggctgtgtaacaagttacccccaaactcagttgcttaaagcaacaattatttactattttacacagtttctgagggtcaggaatggggcagtggcatggctgtggctcaagatcttcagtcttctcagggcttcccaggctgcagaatcccttctgagagcctcacacagtggttggtggtgggatgccttaactccttactgacattggtgggaggcttcagctgctggtcagatgggcctctccaaaggactctgcagggcagctggcttcctccaaagtgagtaatccaagggaaaaagagggagtgtgcccaggaccaaagctatgatctttataacctttttgtctttttttttccccctaaatttcttattgtgctaaaatacacataacataaaatttgccatcttaaccatttttaagtgtgcagttgagtggcattaaatgcattcctaatgtgcagcgccaccaccatccatctccagaactctttgatcttgtaaaactgaaactctgcagccattaaacaaacactttccatccccctcccctccgcccctggcagctgccattccacaagtctctataaatttgacttgatacttcatttaaatcatggaatcgtgcagtagttttacttctgtgtctggcttatttcgctgagcataatgtccccaaggttcacccttgtagcatgtgtcagaattttttttttttaaaggcggaataatatcccattgtatgcatagactgcattttgcttatccactcgtgcttacgtacacttgggttgcttccaccttttggcgattgtgaatagtgagtgtgcatataacctttccttggaagtgacaccacactaacctctgctgtatgttgttgatcacacagaatcaccctggcacagtgaaggggctacataaggctgtggataccaggaactggggatcattcggggctgtcttggaggctgccaacacacacacacacacatacacataaaacatgaaaatattcacagtgtcactcctctgatacagctgctgttcacattttgacacatttccttccatctttttcctgtgtattgttttcatgtggttgagataaaatggttatttagaattctggaaacccagaagcaactctacatggaaaagctctgcataatcttgtaatgaaaatagctatgtaattggccatgggggtaggctattatttaatgaatcccatgacatggatgttatggttgtccaaagacttgcccatataaataaaatggagtggacatctttgtgcatgaagctttgcccaatttttggattatcttgttgggatagatttccagaagtaaaatgtctgaacattttaaacacataaaatgtgtaatattaaccttttaattgaagaaacaataggtaaaacgcacctatttgaaaattagtaaactgggaaaatgaattctcccacttcccctccccatcctgaaactactggcatcacctgctcttaccagattctattttggttaagagctttattgaggtataattcacgtatcgtaaaatccatccatataaagtagacacattaatatccagtgctttttagtttatttacagttatgcaaccatcaccacaatattttagaaaatttttaccactccaaaaagaaaccccatacccattggcagtcactccccatttctctccaacccaccctcacccctaggcaaccacacatctaccttcattctattttgcctattccggacattgtatataaatgaggcatacgatatggattttgcctgtcccggacattgtgtataaatgaggcatacgatacagattttgcctgttccggacattgtccataaatgaggcatacgatatggattttgcctgttctggacattgtacataaatgagccatacgatatggattttgcctgttctggacattgtacataaatgaggcatacgatatggattttgcctgtcccggacgttgcatataaatgaggcatacgatatggattttgcctgttccggacattgtacataaatgaggcatacggtatggattttgcctgttctggacattgtacataaatgaggcatacgatatggattttgcctattccggacattgtgtacaaatgaggcatacgatatggtcttctgtgtccggcatctttcacttggtgtcatgttttccaggttccttcatgttgcagcgtgtgtcagagctgtcgtgtggacgaaccacattgtttatccattcgtcaggagatggacatttgagtcgtttccactttgggactattgcgagtaacattgctatgagcatcagtgtatagtttttgtgtggcactctgttttcatttttcttagatatctaccaagaatggaagtgctaggtcataaggtaactctgtgtttattcacttgaggaaatgccagactgtcttccaaagcagctgaaccattttacatccccaccagctgtgcattcttaccagtttcttgcattcacttccataaagaggtctgcgcctgtataagcacatatgtgtaaatttccctttattatttcctcttatggaaatgttaacaaactagacacactgttctgggcattgatctgttttttcatgtaacagtatattcgggagatcattctgcacctgcagctaaggggctgccccctttttttttgttatggctgtgtgtattccactgtggtggattcactgacctgatttatccaaacccctactgatggccatttgggatgtgttcagtctttttacttcttcatctgatactgtaataaatatccttacacatctatgtttttgcatgtgtattaatatatctgaattagtctaaagtgttcaaaagaatttgaatattagttttgatagattttgctaaatgccactccatagacattgtcccagtctgttctcctatcaggagtgtcagagaggaatgtttcagtatttgagttggagagagtatttcctttagagaggaatgttgttgcagtatttgtccttttgtgactggcatatttcatggagcagaatgtcctcaaggttcacccatgttgtagcatgtgtcagaatttctttccttattaagtctgaatgagatttcattgtatatagagaccacattttcttcttctttttgtctgttagtgtacacttgttgcttccaccttttgtctattgtgaatagtgctgttaggaacatgggtgtgcaaatacagagtgcacctgtaaaattctaaattagattctgtccctctcctgctcagaccttccaaagaatgaataagaaggagccagcttaggccagacctgaaggaagagcattttgggcagaagaaacggctagtgcaagttccctgggggatattcgaggagagaaggcaggctggcagggctggagcagagcacaaggggcagagcagttgtggggacagtgtgggggtcagaggtcagagtcaggactacatgtatgggcaccacaagttttcattacctgccgctctgggtggttcgtgagaggcagcagcctgcaaggatgaggactcgggctctggagacagcccatgaggttcaaagcctggctgtcccacgcagtagctgtgtgctttggtccaggaacctaccctgtctgtgccttggtttcttttatctctaccttccagcctccctccagtgccccctattgacagagcttcacagggagtagctgctaaggcagaaacatcacgggatcgcagagtcaaagcccgcagatctctgtgcagagtgtggaaggggggcttttggggatgaaagacaatcacttaatcacttttaaacaggcatactatattataatgttagcacctgactcgtaggtctgttttaagttaataatgactgaatcaatatgtgccagcacggtatctatttctcaaggctgctgtaaataagtaccacagactgtgcagcttaaacaaaggacatttattctgtcacagttctggaggctggaagtccctgatcaaagtatccacaggaccacgctccctctgaaggctcaagggaaggctctgttccaggcctgtctcccacctgctggcaagttccctgacttgtggcagcataactccattcttcacacagccttgtccctgtgtacatgtctctctctgtccatgtttttcctttctgaaatgcaaattaaaaccacaacaccaccttaccccagccaggatggccattattaaaaagtcaaaaaacaatagattggcgtggatgtggtgaaaagggaatgcttatacactgctgctgggaatataaattagtacaacttctttggaaaacagtattgaggtttctcaaagaactaaaagtagatctcccatttgatccagcaatctcactacttggtgtcaacgcaaaggaaaataagtatttatatcaaaaagacacctgcacgtgtatgtttattgcagcacgattcacaattgcaaatatatgcagtcaacctaagtgcccatcaaccaatgaataaggaaagtgcccatcaacccatagataaagaaaatgtgatacacacacatataatatatatgtatatcacatttatacacatacacacatacatacacacacataccatggaatactactcagccataaaaaataatgaaataatgtcttttacagcaacttagatggaactagaggccattatcataagttaagtaactcaggaatggaaaaccaaatgctgtgtgttctcacttatgagtgggagctaagcgatggatatacagaggcatactgagtgttataatagactttggaaactcagaagcgggcaaggtggcaggggggtgaggggtgaaaaactacatattgggtacaatgtacactattcaggtgatgggtgcactaaaatcccagactttaccactgtacatttcatccctgtaaccaaaaattacctgtacccctaaagctattgagattttaaaaattgaaaaacaaatttcccttttctataaggacaccagtcctgttggattagggccccctacccccactccaggatgacctcattttaactgatttcatctgcagcagccctgtttccaaataaggtcatgttcttgagaccttgaaggttgggacatcagcatatgaattggaggggctcataattcaacccataccaaccacttagagtagtacctggcacatagcagctgctgcataatgactggtgttgcctacctcatcatcaccatccacactgctccgccaggttctttcagtccacaggcttgtgacatctaccacaaagtgctgctccttccacgtggacttctctccactccccagcagtctcatctgccttttcaccttcgggtcttgatccaagctctcttccctacccagaatctcccactaaagacccaaccaccagttctcttcacagactactcaaagtcttcctgggcaccccccacagctggcattactcaggcacctggagacctttgttcataccttcatgattgattgcgtttaccaaattacgtgtctttgtctgcctctgccatgaggaactagttcttgaacattttgtgtctgtatcccagcactgggcttgctgcctggtgcttagtaggggctcagaaaagttagctgtgcccctggattccatctggggctctgcctctgctgtgctcctaatgcatttgttgattcactgggttagactcactttgccttcagttcctttccatctggttctcagatctgtgaccttctgttccagaatgtttcatatgggatttatttctctatcagagtgccaacccaatataactagacacagagaaaactgtgagtgatccctttagaactctgcatcttattgaaatcacttcagctacatcccatctgcctcccctaaatcctcttggcttttctggccattcctccacgcctctgtaaggagggccctgcgatgagcggatgtgggtttcctcttacaggaatcagtgacgttcagggatgtgactgtggacttcacccaggaggagtggcagcagctggagcctgcccagaaggacctgtacagggatgtcatgctggagaactacaggaacctggtctcactgggtaaggggcagcttcgttgagttactcatcattggcccataacttcaggaccacaaataaattaaaaaaaaaaaaagatcaacagatctgactacatggaaagttttaaaatttgctctacttgaagctaaaaataaagttgatcacgatggtatgggaaataatatttctcacgtgttttacattcaaagggtcataattatgtaagcagctcctgggaataagaaaaagactaagcgaataatagaatggaccaaacttatgagctggtgattcatagatttagaaatacacaaagttaacactttataaaagttttttaaaccttactactggagacacacaaattgaggtactagcagtttttgcccatgaagtgcacaaagatgaaaaaagaataatagcccatattatgaggctgtagaggaaaggactctcattttaggagtataaagttgggacagctcttttggaggatagcttggccttatcagtcaaatattgaaggattccatttttagagatctgtcctttagaaattctcatgtaagtatgcaaagttttccatgggaagaaaaatcaaggaaaacgacctaaatgcccagctgtctaagactgactgaacgtatcaaggcctatcgatatgttggaaaccaggcagctcttcaaagctgaggactgtttgtaggcactgccatgaaaagatgtcccacaacatactgttaggttaaaacactcacttttgtaatcagagcgtggtcctatttctttaacagcttttctggaggtattattgacctgtaattaaccacgcatatataaagtgaagagtttgatgcattttgacatagtgcatacccaggaaaccatcaccatgatcaagataaaggacatatctatcatccccaagagattcctcatcctcctttattacccctctctccccttcctcaacccccatccccagggatcccctggtctgctttatgtcactgtggttgagtttacctgctctccagttttatatacatggaatcatacagtatgtacccttttttttttggtctggctttttttggtttgacttggcattattttgagattcacccatgtcattgcatgtctcatagttcatttatttttatctctgtgtattattccactgtatgtgtatgccacaatttgttcagccattcgcctggtgatcaacatttgggtcatttccagttctgggctattacaaataaagctgctgtgaacatttgtgaacagttctttgtgtagacatttgcttttccttctgttgagtggaaagtctggatcatgtgctacatgtatatttaacttgtttaagaaactgccaacctgttttccaaagtgattgtactatttcacatttccaccagcagcgcacaagcttcattctaattgctttatcttttaaatttagcctcccttgtaggtgtgtggtctcatcactgtgcttttcatttgatactgacacttgtaggtgtgtggtctcatcactgcgcttttcatttgatactgataatcttttcctgcgcttatttgatgtttgtatattctctttggtaaagtatctgttcaagtcttttcctgtttttttttttttttctgttgggttattattgaattttgaaagttcactatgtattctttaactatctagaagtccaatgcgctatccattgcgtcacagagccagaccactatgtattcttgatacaagattttctttagatatatgccgtgcaaatattacctcccattctgtggattgtgttttcactttcttgatggcattatttctgactctaaagtttttaattttgatgtagtgcgatgtatctattttttgttgttctcgttgcctgtatttttggtggtatatctaaacaatctaactcaaagccatgaagatttattcctgtgttttattctaaggttttagtggtttagctcttcactgaggtctttgatccattttgaattaatttttgtgagtgatgtaagaacggggctcaacatcattcctttgcatgtgaatatccaggtgccccagtgcaatttgttgaagagcagaagtttttaattcaatgaagtccagtttatcaattttttttggttttggtgtcatttgtaagaaatcttggcctatcccaaggcctcagaggttttcttctgtaagttatatagttttaggttttacattttgttctttgatccatttagagttgaattcttaatatgatgtaaagtattaatccaagtttattggggtatgttggggggacaaatgtatgtccagttgtccaacaccatttgttgaaaagaccactttctccaatcgcctttgcatttttatcaaaaatcacttgtccatacaagtgtgggtccaattctgaatcctgttctgtccatctgtttgtgtgcctttgcaccaataccaagcaatgtcatcctttcagatcttgcttttatgacttgtgcccagtctagaatgacattctcctcaagatcattctgggttttctgcccaaagccccatgaatgacaaggttttacagtctgattggtaggaaaaggcactgttcccagccctgtgtcagctccggtcactgttttcaaatcctttcagatgtttttttcctgtgttgggtagtttcctgacatgcacgttttgaccaatagtctgctaaatactggagggagttccttgcaggtcttcagaacactgtgcagctcattcctctctcatctgtcctgggaactctatctgccttggtctctcagctctgtctcctcaacttggggagttggccagactgtacctcaatttacctttcctttgtcagagcctggaaacttcccaggcagttagctggggcagttgtaggacccaccttgtttgattttcttctctcagggattttgcccttcattgcctgatattcaatgtcttcacaaccattgttttatatattttgttttaggctcaagggaatcttatcctttatactctgtcttggacaaaagccccatttgggggaaaaatgtgtgtgtgcatgtacaggcgttggaggggagtctaaaatataaaccaaactgttaactctggtgagtaagattacaggagacttccattttcttttgtttttttttgttttttttgagacagtcttgctctgttgcccaagctggagtgcagtggcatgatcagagctcactgcaacctccgcctccctggttaaagcgattctcctgcctcagcctcctaagtagctaggattacaggtgcctgccaccacacccagctaattcttgtatttttagtagacatagggtttcaccatgttggccaggctggtctcaaactcctgaccaagtgatctgcctgattcagcctcccaatatgctgagattacagagacttccattttctccattactgttttggtgtttgatgttttaaaaacaagtgtgaattactttctaatcagaaacaagcatagaaagacagaaaactgaaaaagtgtgaaggacgagatttagcaatgtgaaaaaagaatgcacctacatttgtatcaaaaggaatgaatagcgttttgcacattaacggcttttggcgaaagtgccctctgcagaagcttcggatgtctcccatgacagtggccatgccgtcagacttcctgctcttttgctgacctgactagagaaaaggtgtgatcgggtagttttaatctgggtggtgtggaactgtgttttcacagctgtcgtggttaagggctgagtgtttgctgtttgcagatgatctctactgcagggttttagcctgagaaagggaggtggcttcctcccctctgtccctctgctggtatgctgcccccagctctcctgatttctccaggtcatgttcactccaggagacttccagctgtattcacaaccaagactcctggtcctctccgatagctgccagctcatattccagagcatctcagactccatcagccccagacaaaattcaccatcacccctggagacagtcttctctccaccgagtctacaccccacactaccatctgtgccagcatctgggcattgtgccacaccctgactagggtctctaaaccacaatcattctcctgcatgaagtatttctcagttcttttcctctgagatgggaaaagtgatgcatggtaatatagccactcctcaggagccacagctcgggggccacactgccagggcttgaatcctgctgtgcctcaggtgtattgtgccctcgagtacatctctgactccattcttgtatctccgtttcctcatcagcaaaatgaggatggtcataactatctactactgtatgtaactcaagtatgattgtgagggtctccagagatccgtgcaaattgttcagcactgtgccaggcgtgttgccagtgctccatactcgcttatctggtaccttctgtgtgcaggctgtgtgaggagctggggggtgagcaaggcccttgcctctagtggagctgactcctgctgggggccgataataatcagatcaagggacaggcagagaaaaattgccacaggtcactgagtgttcataaagaagtgggcaggaggaccttccttccttacgtagggtggattgggaaggctcccgtggggttgtggggaaacaggcctgaaggataaggacgtccacggcaggtccacaggacagtggatgcagaggccctgaggcaggaagaacacacggacaagagggagagcatggtgatgagaaactgggagggagggtgggcaggggacgactcaggcaggcctgctgggtgctgagggccctgaggctgctggaggtcctggcatcattctcagtaccgtagggaggtcacgggagggttgatctgactcctcagaagaccgcactcccggaggagtggaggacgcattgcaggggtgagaatggggtggggaggacagagaggagctgctgtcgcatttcaggcaaggacccgtggtggccagccggctttttgtcagtggggaccgggagatttggtctgattcaggctgtttgcgcacagcaatgcttgccagcagtcaggacggtgggagggaaagggcaagtcaggatgtctgctaagtctctctaaaacaattttttaaattttatatttaaaactgtgaaaaatatatagagaacataaaatgtaccattttaaccacttataggagtacagttcagtggccttaaggacattgatgttgttgtgcagccatcaccgccatccatccccacagctcttttcatctcccgcaaatgaaaccctatccccattaaacaccaactcccacccactcctcagcccccggcatcctctgttctaccgtctgtctctgggaatccgacctccaggtaccgcagatgagtggaatcacatggcatccatcctttcatgtctgatttattttactaagtctctttgatgggctttgcttttttaaaaaatgtttttcatggggaaagtctgaaatcccaagtttcgtatcggatgtgttaggcttgggctatccagttgagatgctgggcttttttgaacagtttggacatagcccagaaagcaggtctgggctgaaggtgtatgtttgagcagcatcagcctgtggataacgtttagatccagactcactttgtgtggctttgaaggtccagtgtgattcaggagagtggtctcaaactcaggtggcctcaggaactaccaggtggatcatttatgtggaggagggggacagctgctgccccatgcaatgtcttgttgcccataagaatgaggctccacgtggccatatcttcatgttttttatgagctagcagccacatggacagcaacttttaaatgctgggaatgagtcccctgatgcagagtctagactccacctaggctagaaatcgaggtttagaaatgaacaggatacacgtggaaggtgattgaagctgtgggcacagaggtatttagccagggagggtggatgagcagagaaagagggtctgaacccaagctccacggaatgcctgccacccaagaactaggcagcgtgtgacgtagcaacagaagcaattgtgagaccccaagtcatgtgattattgtgggctcaagtgagcggtcctgtgtgtatgaacacttagtgctgaggctgatgagagggctggggtgcgggagggctggggccagccagggcaggtgcgtgatgagctagcgggagccggagccccagccaggggagaggatcttgcagccagcaaccctggggcagccataccagagaagtggcaaaggggcaggagaaatgcccgatttttctctcatttcacttccagtttcctgcctttggccaaacacacaggaagccagtgggcaaagtcagcatcctgagcacagggcaggtcagagaagggtggagaatagaaagtgggtcgaaggagtagagaataaccaacacatgccatataaatgctagctatttattatttctttattctttttcttcttttttcaatatttatttatttatttattttttaagagacagggtctcaccctgtcacccatgctggagtgcagtgacgtgatcatagctcactgcaacctcgaattcctgggctcaagtgatcctcccacctcagcctctcaagtagctgggacaataggcatgtgccaccatgcctggctaatttttaaaaaaaaatttagtagaggcgggggtggggggtctcactatgttgcccaggctggtctcaagcaatccttgcctcagcctcccaaagtgttgggattacaggcatgagccactgtgcctggccatcttattatttctgataaaaactgttgcttgaggagcacgactggttgtggatctgcaggatgaagtgaggaggccctgcaagtcagtagccggctgcagtcattcctactcaggtttgcagagcctgccctttgctccctgcaagcccagctcactactgcagtttctctccaggagtgcctgtcatccctcttctgaagggacatttgctctccctgttcacctcctgtgttgactctgcttcataaaccacattggcctcagttccatgcctccctcctccctccctctctgatccaaggttcttctttgctaactcgctctgtgccttgggcctcattggggtcggtttcatttgctccttcctgctgtggagcttcctcactcccagcatctttaactacatgtatttgcatcttctgtttttgtttttttcagactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggggttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacggcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaa

SEQ ID NO: 1393 - DNA, 7654 bp, Homo sapiens
cgtcagggagtggccgtgagggaccccaaagccaggtctggaaaaggggggtgggttgggtggtgggggtgcagcccccaaagaaatgggggtcgaaatggaggaaaccccactgagatgctcaaatgtaaaaccgctgaagaataaagggacaaatgtacacatctgtctaaatgaaaaaaatgaaaatcctggccgcaaaaacacatacattaacgtctaaagacctgcagggaagacaagacttttccgcctgggacacatgaaagacatcgagctaatttccttaataaatgaagagctcttggaaaccaacgagataaagaccaaaccaagacagaaaaatgggcaaaagggataaaactggcaattcgcaagaaaatccaaacggctggccgacctgcgaaggaaacatcacgacctgtttgcataaagaaatgcaaacctgaaacaccgggcacgtgcggtttaggggagcgggcagtctcacacactactgagttgtttcccagcagccgtcaatacagaccttccactgcgtaagcccactgcattgccatttaataaaacagcaagaaaatgagagagaaaaataatgaggtagaattgtatgggattattaaggattgaattctcagtagatttagtgaaatatacaagttactgaagtttgtagaaacgaactggtaagtgttttctcatttatttgttttttaaggataaacccaaatataggtaaaactgttggaaaggtaggcaagaaattgttgatgagttacttctagggacaaggaatgtggggtggaagagggatttttcccttctgccatccatactgtgaatttccttggcagaaatacgtatttcttctctggcagtaaaatcaatgaattactaaaagttcactaatgtactctttggtccaactattccactctcaaggaactaaaaaagcaaaggaaatacagggatatacagaagattctatacagggatattcacggagcatcatttttatcaccaaaaatgtgctccacagaaaagaattaaactgtattctggtaaatttacacagcgcgattttaactgactaataaaaatgctgtatgattttaactttaaaggaaaaaatctgtaagatgtggttaattaccaaaaggtgtttacctaaggagcacacagactttaataccccaaattaaactttatattatactcaaggagttatcagtggttgcttgctacactgagaagctgctttatgtgttttagactccctagaccatcaacagtctctttttgcccagcagtgccacataaacataatatacgaatgaaaacactgtgcttcttatgaaaatacacgttcaaaacaaattccccagcaggaatattgaaggtgaatgtggtagtaccctgacttaggttacagattttcaaatctggctactctcattaggctcacctggagagctgttaaacaatgcagattcccagtgtcccacagagatctttgtttttcaggttcccaagggatcctaatgtctagttaaggttttgtaggtgattttaatatattttaaagactccatcatccccctgtctcctcaaaggcctctatctgcaataccagtttctctccggatcctgaatcattaatttccacaagacaccacatgctctcagagctcctgcagttaccacccccttgctcagcacctcttggccctgaaaatgcctcttgatagagcagtctactgtcactaactcaatggttttaccatacattctctcctgctaacatatatgccccacaggcttccatcccttccaaacccactgaaattgcttgacaatttcagcaattccttatgtggccaagaaacttgctcttaatctcactttatctctcagtaatattcaacatcctcattaaaacaagcaaacaaaaacaaaatcccatgcatgctatcttatttttggtgacaattacatggtcctggtttccgctcccctgccatcagtggtctcttctcagtcataaatggcttctgctctgcttgccatctacacgctggagggtcttgcctcagaacttagtcactagtcttctccatcaatgtccactccctaggtaacaacccttccctcctcacctagtcacataatttaaatgccacctacatgccaatggctcccaaattccaatcctctgccacaggactgtccacaaaagcgcagtcttttgcttagaaactgactgctccccttggatgtctatcaggcaactcaaagcattttaaacaaatattaatttcccctttccccatttctataaacagtaccagttgctgaagccaaaaaacaaaaacaaaaaacgacaaaaaaaaccctcacgattgttctcgttccttttttccttaccaccaacatccaatttatcagcaagtcttgctgaccctatctaaggcaaatcccaaatttgtcccatgatttccctttccatggtagtcctaagaaacattatcttcctacaaaaacccttcttccattccaaacccttcctccagtattctccacacagtattaagggtgatcttgcaaagcaaaaaagatgtcaatgttccagcttgaatgacctcctgcccccatcccaattgcatttaaagtccaaaagcccaaaattagaagagccaacattatcttttgtcttagaggacaattaaatataggtgttgtaaaatttcacaatctcttccttcaatgcctaatttaagaaattcttccccacactgatgtcataaagatattcaaatagctgtgcattttagttttctttatggttatttttgcctatgttctgtgttagggatctaattttcccctgactttgtatcatatttctctatatgagcaggtctgtgcttgaactctcttgttggtcccctgatccatttctctatctctgtgcattaacgcaccatattattacagctttacagtatcttggtatttgaaagggcgacggccctaccttgtttttcaaaagtgtctggccctaccttgtctttcaaaattatctgactcttagcccaccatctttcaaataatttttagaagcagcttttaaagtttgatgaactatcctattgagattctgacattttattaaatccacacagcaatttagagaaattgaaaacattatatcaagatctctcatctttgaccactgtctatatctcttacggctgtcaatgatacactgtaattttttttccctataaaggccttatttgactttaggaggtcctttttttcccccattaattgtataattggttatttaatagtttcagaattacaaaaaagttgcaaagatagtacaaaacttccccaccctgttttccctgatgttaataccttacataaccttgctactttgtcaaaaagaagagataatattaacactaaacaaactacagactttgttttgatttcacccatttttccattactatcttccttctgttccaggatctcatcccagacacagcattacatttagtgattacatctccttaggctccccaaggctgtgacagcttctcagtattttgtagaatactcagtttgtttgatattttctcacaacttgatttgggttatgaatttttgagaagagtatctgctattgcctttttttttttttttttttttttttgagacagagtccggctgtgtcgcccaggctggcgatgcaatggctcaatctcagctcactgcaacctccacctcccgggttcaagcaattctcctccctcagcctcctgggtagctgggattacaatcatttgccatcatgcccagctaatttttgtatttttagtagcgatggagtttcaccatgttggccaggctggtctcgaactcctgaccttgtgatcagcataccctggtctcccaaagtgctgggattacaccgcacccggcctgctattgctttttatacgctgactttggatccagtgaacttgttgactttttttttctacacaaaaaaaagttcctgtatttttaaaatgttaacatgctaattaatgacttcatttttactttcggagtttcaccatgttggccaggctggtctcgaactcctgaccttgtgatcagcataccctggtctcccaaagtgctgggattacactgcacccggcctgctattgctttttatacgctgactttggatccagtgaacttgttgacttttttttctacagaaaaaaatgttcctgtatttttaaaatattaacatgctaattaatgacttcatttttactctcattgacaatcatacctcacttcattaacataatgcattggctaggacttctggggtgatattgaacaagtcttgtcctatatttgaaaggggatactcttatctttactatgaaaggggatactcttatctttactatgaagtaaaaacattcactgcaggcttgttttgtacagcctctttattgggggttaaggaaattgccttaagttctagttttttaaaaaaatttatcataagtttaattttatataatgacttctctgcattcattgggaagattgtattatttaacatcatctgatgattggtgaataaagcaggttttatgttgaaaactgtattcctaaaccctgcttgatcatgattatgtgtatctgattcgtatacacatgcagctgggtactactgagttatacttttttattacactatccttgtctggttttgctaccaaggttgtaacagccttatagaatgatttggattgttatctcacttcttatattctctaccatagtttataaactcctctccattggaaattatgtccctttttctattactaatattattaatctctccatgtttctccatcagttttgctaaagatttgacagttttgtctttttaaaatgacttgattttgttgaccatattcttccttcttttccatgtaattaatttctgttctttttgtagttctttcttgttcagttctgtatttcattgtttccattagatttcctctttgcgacatgaagaaacgtctttaggggtcaaagatcttggggaaaaaaactatcttttgaatacagatttccaaattaattgcattatactcatatagcatggcccatatgctactatttcacatttgtcaaagcatccttggtgatcttaagatatggttaattttaattgttcaatatattagaaaagaatgagtattgtctaattgttaggtatcaatttctatttatgttcataggatcaacttgttaactgtgttcagatttttagtattcttggtaattttttgtctgcctgatctatctgttctagatataataaaatctcccaatattcctatggttttatccaccactccttataattaatagtttttgctttatatatatatatttcaaggctatgtttttaggtgcaaacaaggccatgactctttgttgagaaacacagggaagttaatctgcttacatttttaattattgatgtatttgtttaatatgcttttggtcatttattttctcctttcctgcattctactaaattgatcaagttttctttagtcccctttcttccttctgcttatttgggaggtttcaattatatttattacttcactgtctatctttaagttcctaatttctacataagcatatatttttttaacagactataaagtactaaagcaaacatgttggcacacgttagcaattcactggatttcccattcccaccttcattaatattgtctagaattttaattatacctgttttaaacaaatgaaaacatttttacagtcaatgattaattatatttactggtatttcaagaatttattcactcattcttgtttcttgaatctcactcctcgtccctcgaggtttactttttctcattgcaataaatccttaaatgtgtctttaaataagtgtataaggtagtctatttgtatttctaaaaatgtctttatgagacatttttgaatgacattttagccaggtatggaattcttaggtaacctttatcttctctccttattttgaagatattattccattgtcttctaacaaacctgatgaggaggtctgcatcagcgtaatgttcctttctaataacgtctagtttttcccgcggtagctttcagaatagatgttatgtatagatttttgtttatcctgctcaggattgatgtgaccaatgaaggtctttcttccattctggagaattcttgggccagtgtttctttaaatagaacttttctgccattccatttctactcttttcaacctataaagtataatgacccgtcttaatccatcctccatttgtctcaatctttctgtttttcatactgttttctgtgctttctgagtaacttctctttttaactgcatctggtaatagcatttccctagatgttttaaatacagtaactatgttttctgttctatgatttccaattggtactttttttatatctacctttctcaaatggatgaacattttatggacactattctttatttcttcaaaaatcgtaaagtcacactaacactatttgaattgcattttgaaaggactgaattcatgtcttgattgctagttttgctgtcttgttcattttaagatttcctaactttaacccagtgctttgcaagtttagtttctaagtgtttttcctatgggttatcttttcccctcctctctgaacttttcttccctccatgtctttttggctgtctctacctcacccatgagaagcacagtccagagacaatcttgtattgtcaactggggattttgtgccatgtgacaaaaggggtgtattagtcactgagcaagattaaagcttaggctgggtcctctctgcatggctttgttttttcaccccctgccaccactcgtaagtaaaaaacctgggtatccatcactgtttgttgttgttgttgtttttccaggctccttttatgtcaggagagtccaaatccagtacctgtttgccacaatgagcctgggacctcaacatgcatggagtgcttccggacctcattacccaagagcagtcagatttttaatttcctctgcctttttcaagatcattagttcagaaggtttatgttttcaattccacatatccttgcatttttctttcaagttttgacccatatggatatcttaaatattcctattattgcaagtttatattaaaaggaggttaaattgtgaactcacaaactcatagcatcatagcaccatctcaatcaaaagtattatcttctgtgaactacaacagttttcacttctttcgcaagtgtggagtgacgtttgcctgaggctgtatgacctgtgatatcatgacaaattgaaggccaaagcagatgcgaatccagctgttttctattaagtcaaatgccaaggagatttacaaagatgtaaaataatgcgcctcttctcaataacctttggttttgaaaattgttatttttcataaaaaatgttgcttccattaacctgtaataggtttactaccattattttaaataaaatacacatttcaaatg

SEQ ID NO: 1394 - DNA, 1315 bp, Homo sapiens
aattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatgaaaggttattagcctgcaacattatttacagcatgagagcctctcctacggttctcaaccttcattaggcactactgtgatctagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgc

SEQ ID NO: 1395 - DNA, 14931 bp, Homo sapiens
gaaatatttatttttaactttatttttattgttgacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgttaacagttaattgttgttgggtgttgggaatatgtgtgaattttctttactgaatttccaaagttttgtatgagtatgtattatatttgtaatggaaaatacatacataaaatttattaccaaaacaccaaagattatttaaggaatttgagacaaaatatttaaccaaattcccacaatgacaacactattttagttattttccacatcttttcatttaagactttatgcacacatatttaacactgttatcacaagcgtgtgcactgaaacaagatagaggaaacagatcaagatgttagcagtagttgttaggtgttgggaatataggtaattttttaaaataatttactttattttctaatttttcctctgggtatgtattatgcacaccaatggagacacacataatacactgttatcaggacattattatagggaacatttgaaaaaattaaagtgaaagtatttaaccataattccacaaaggtaatgtaacagctattttgaatatacattttgacacagttataatcataaacctgtgcacagaaacaagaatgaacaagataagaggagagtatatgtctttggatggtggggatatgattttttttcctccacttttctgtattttccaagtgtgtgataatgagttcaaattatgttcacaatgaaaatgtgatcataaactttttagtaacactaccataaagaacattcaagaaatttaagaaaataatgctcaactataagcctacaacaacaacaccacaacagcttttgactataagcatatatatttttaaacagttataatgaactgtttaaatgaactgttaaatgaacagcatataaatgaactgttgagttataactgtagtataaatatactttcgtgtcctgctttctccacttaatgttctgtaaatatatttccacgttgctacataactcgtgattatcatttttaaacagttgcattaagtgtccacagataggtttaaacaatcattctcttgtttaccatttgttactaccttttcactagctgaaggttggaacggacaccctgacttacagcaagttgctttctgaaaaggggctaccactgccaacaatgttaacaccaagtaatgtacccacaaagttcaccccgacatcaacactgattctcgtttcaagagtccttttcccatgtagtaaacctcactgcccctcagctttcccgatgtccgttccaacctcagtccttcctatgcagccagccctcacctacaccataccatcaaaaactccttttccaaactgctcaggacaccccgctcaattcattctcagaaacctggccttctacagttcttgcctctggtgttttcttctgtctgtctcctctcccctcctagatctggtgatatattaggactcccttctttgactcactcatttctgcttcttgctctcagctctacaatcttcctaaactttgacactccctgcatctttgacatacttccaagccctaatcctgcagatccagaagagtaagattcagacacatttcccccagtgggtactttaattttgcttgttcaaatgatctacacttacattttgcaaatctttttttttaaattttttaaattttatattttttttccagccaactcaaggccaaaaaaaatttcttaatatagttattatgcgaggggaggggaagcaaaggagcacaggtagtccacagaataggacacaagaaacctcaagctgtgaggtcaatttgtaattaaaagaatactaagattagatgaacacaacactcagaaatactctaggagagctgaaaaagaaggaacagatgttaacaaaacaaattaaggctgctggggaacctgagtccatgttaagcttgggttgactgtaaagaatttttttttttttaatgcaagttagacatggagttagagggtcagataaataacgaagagaattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatgaaaggttattagcctgcaacattatttacagcatgagagcctctcctacggttctcaaccttcattaggcactactgtgatctagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgctggcacgttcgatgtagcctgagcactccccaaaggcatttgcaggctcaaatatgatcatgctggcatgagttttcaggtgttcactgaatgctgtgctggaagtgaaggtttctgtgcattcatggcagtcatagtatggttcttctacctgaatctcttgatcttcaccttcttctgggtcttcaattcccacaccgtcaggctcgtcggcatctccctctggctcttcagcttttccctctggctcttcagctctttcttctgggtcttcaatacctgcaccatctggctcatcagcatccccatttggctgctcggcctctccatttggctgtccagcctctccaatgggctctgcagcctctccatctggcccttcagcctctccgtttggctcagcagcctccacttctggctcagcagcctccacttctggctcggcagcctccacttctggctcagcagcctctacgtttaagccctgaatcctcagaactacttgtggaacatggacattggcttcaacttcctgggctgctgctgctgcagctgctgctgcttcatcttcttcttcttcttccagatgaagctccttatgtttagtgaggactgtgctatgaataaaggacttaccacaatccttgcattcatagaatggtatagctcctttgaggggctcagtaagaaatgaggtgtgagtataggaggacccgtactcatagggctcattcttatgaacagttacgtgatctgcaagttctgctgggttgacgaaagattctccacagactgcacattcaaagagtctctcttcggtctgacttctctgaaactcagtgagggctaagcctggaatgatagcttcctcagccatctggctctgctccagtaaatcatcttccctatgaagtctcatatgctcattaagggcagagctatgaatgaagccttgtccacacaaaaggcatcgaatggccgacccagcaagagcaggattcctctctgcagcacgattcctccgtggcttcatgggcaagagggcaataaaaccatcatcacaccccttcatggaatacaactggtcttgttcatggattctctgatgctcgaaaaggaatgagctatgaataaaagattccccacactttggacattcatacagctgctctccagtgtaatctctctgatactcgctgatggaatgggtgtgaattacagaatgtgtgtactcccgactgtcaaccaggcacttcctgctgtggactttctgatggtctgtgaggtctgtgagatccacaaagcccaggccacagtcctcacattcatagattttgtcatcagggtcatccttctgagggtcttccatgtctgagccttgaatgacagggtcttcaattgtctcctgaccatgggtctcctcgctgtgggtctcctccccatcagtattctcgccttgagactcctcgccatgagacttctcttggtcatagattttctggtttgtgttgaggtcttcgctggtagcaaaaaattgtctgaagtccttacatttgttccgcgcttgctctttagcatactgctcttgggcgtaacttgtttgagggtcagtaggggccaagctgcgaatgacagaccattcatagtttctgcttccagagggcttctccctatcatgaatcttctggtgctcagtgaggtcagagctatgagcaaagcactccccacactcctgacattcatagagcatccctcgagggcgaaatgtttgttcaccaaaaggcagagagtgaattacagaggtctcattgctcctatgctcaatgtatttctttttagcacgagccttctggtattcacggacatttgagctgggaacagagaattcgccatccttcttaaactcaccagatccctctccaggaacacttttctgaggtttggcacggaatacactctgtatgacagagtcttcatagttgcgattcttactgcccccttcacaagggttctctctggcaggaatcttctgtcgcttatcattaaggtctgagatataaatggaggattctcccttctcattagattccaccaattcatttccattgtgacttcttggaggtttggaagccactaagctatggataacagacctactgtattcccttccttcagaggtgttccctccagcacgaactctctgatggttgatagcatcgaagctctgaatggtagactctgccattacttttggtttactgggccctgctacactgtgacttttctgagcttccacagaggctaagctatgaataacagacctctcatatgattttgcctcatagacattttccttagtgggaatcttctggttttcataggggttagagctaatggtgaacgccttttcgtcctcatcactttcaagaggtcttgttatagtatgactcttctgagattcagtgaatggcccactatgaatgacagatttctcataccctctgccttcaaagaggttctttcgagaatgaattttctgatgctcactgagctctgagctttgcatgaaggcatcccggccatctgtaaagtcacagagcttctccttattgtaagttttctgacgccttttaagggactgaccaggaataaaggtttcctcacacactttacccttgttttcaaatgggttccctctagtatggattttctgatgttctttcagggatgagctatgaaggaaagtctccccacacaccttacattcgtacattttctctttaccatacattttctgaaactcattaagggctgggctgggcctaaaggtttccccgcgctcacgttcacgttcacgttcatgttcacgctcattatctttgtcatccccaaagtggattttctggtgctcaatcagggcagaactatgaaggaaggtttccttacacaccctgcactcgtagaatttgtctttgccatatattttctgaagctcactaaaggtggggctaggcatgaaggcttcctcacattcctgattcttacattccacaagataacctctagcatgaatcttccgatgttcagccaaggcggcactcttattgaaggtctctccacagtccttacattcaaaacgtttccctccaacctgacttttctgaacttcactgacagccacactgtggataaaggactcaccatactcatagaggttctctctagtatgcatgatctggtgctcaacaaattctgagatgacactgaacgacctcccacactcatcacatacatatggcattgccccaaaatcaattggctgtgactcggtaaaggagggggagctgaggctgctcaggctgctcacgctcatggcttttctcatctcactaccacattcaaagggcttcttcctgggacagcctttttgatcgtgaatcgagcccttcccatctgtgtcaaaatgatagcgcctctttctttcaagaactctctttctggaaacaagggttgaattaaacctaaagcctcccctaaatgcattcccttcataaacccgctgctggatcactgactccctcttgttcaatgaaatgtccttccagttatcatctgacattctggggaatctctgtgaccggtcgcttgactcccttgctcttcccgatttggaactgcgtgacacatccttgatgaatttttccattatcactccgtgggaagattcatcttcacaaatcccccgccggtgggttgattttttggcttcaggcatagtttttagacctggaaagaaaccccaaatgtaaatactccctagtccccataagaaggacagtgggacttggaggggtgcacccttctgtgatgtttaggaatgcaaagtgtagaagttccttgatagcatctcactggttgtgtggctcctctgtgggatgtgcctcctgcttacctcgactggtgcttgggtaggcacttctcttggatcttgatgagtggccctgcgtcatgtgggagtggccatcgtcttcagcaagctgcactcctggtcacaaggacaatatgatgcctcaaattcaagttgaggaccaagactcatcaccataaattgatcttcatctttcactgagccactaaatatgaggtggcccacatctgattccttggatgtcagaagacatttgctgtctcatttccctactatctattccctaatccattctaatctacatgtaattcttctgactccactcagaaatgtgtacaaagaccccacatgtccctgaaatcagtgcattgtcttttagtcttcaccttcttgtaaccactttttaagtcctcttttccactggccttcttcctcttacctcgcgactgctcttcctccacccactcccttgaggccccatggccttacagacctgcagcacagccaactgcccactaccaacttgggctagatgtcttccaggaaagtccacatgggaactcaggatcccatcctgaatgtctacttaaaaacctccagtgctaccactctggaaaaaagtatcaactcttgtggcaagaagcatctccctgcttgtccccaccctgtacaatgtatctttacccaaagccagaggcatttcttaaaaacacaaattttatcatttactccctcatttgaaatctttcaaagatttcttattacccttgaagtccaaatatattaatgtggactctaacatccagcttaaaaaggagcaagatgacaaaatgctccaatgactggactgggagtgactgagagaagcagctgcttaccgagggagagcagcttcctgtagttttccatgttgtcctggattgtgttgtgaggtttcctgtcctcagcgaggtccaccacattttggtatgattcagcatcctaaaacagcaaacacagacctctcaatggagtctgtccccaccgatgttcaaagacagaataatgttggcaacatgggagttacatatatgaagttatataggaagtgctcacggtattggggttctgagtgatccaagtcaagtgttactagggacctacgtcgtacctaccttggtgctacactctgaggcagatcccaaagacgcatgacacatattccttgccctcatgcagcttataatttggttggagagaaaagactcatgaaacaattagagaacaataaacaataaatcggggtacagatagtaagtgctaaacgggttttgtagagggacagttcagggtgggcctgaacagtgtgcaaaggtttgtggagggcaggtggggccttaagtggtaagtgagattatgacacatatagaaagggattggtgggaaaacttagactaaatatcaaacaggcacggagtactcagggaacagaaagaagacacacacattcaggaagacatctggtcaggatgtgacttaaacctccctcccggtttctccatggcatagcatggctacattgagggagtctccagtttgcacaatttccaaatcacccaggaataactgtaagccctgagggcatttttataattgccttttctgtcttaatggatatttacctaaaaaggaattttaaaattcctcacattactgaggagaaccttctaccaggattctaaaggacctttgcttattgccagagggctgactagaactggtttcagggagtcatggtcccaggaagaatggcactgaggctggagagagacttgaggagggagatggtgctgtgggaagcccacaggctttggagctggacagagatctgggtcaaagaaggattgcaccaattatgagctatgcagccttgggaacggaaatctttttgaacctttctttcaggttcttcacctgtaaaatggggagaagagtatctatctgctttgcaatactgtgggtgaggattttctgcagtgtgatgtcttgcttaaatattaagaaaattatgtaaaggaaatacaaatgtcttgatattaaatctaccatagttctattgctgggaagaggcatggagcaacatgaaaaatgtagcaaaaaaaagaggacttgctgagtaagcaaagacaaagaggtacgggtatctgggtttaagagggaagccttatccatgaactgcctgtgtcctgccacaaaaaagcagaaacaacaacaaaaactaagtagggcaaggaaacacagcagagcttcacagataaaattcttttttcacatgaaagaaaaagcacgctttgattgaaaattaaaatctaggccagtgggcagccctaaattggttgttcgctttgtgtttgtaatcaacaatgacatcttaatgcatacaaactgcaatcaagttcaatggaagagatgctgttctgaaaacaatgctagtatggctcaatgtagttttcacaacatgatctatacatgtgaacaattaagaaatttacacatgaagctaaaagatgagagaattttctgttgtgtacaccttcaaaatgtaatttgtgtcatttgctgctggtgttaccaccatactgagtcagtaggaatcagtagcttccagacttttaattatgcagacatggggctcggatgccaattcttcacacattgtcaaggaagggcatttaaaaagcaaaacaagacaaagcccaactaccaagacaccagtggccaggcccacacatgcctccagccttcttcctatatcccagccacctggcccttggtttggttcccatcccacaactttagctgagctctccctaatgcctggggtcccctcccccaacacctgacccggcgtgctcctggctctaaatggcaactgttaatgcctccaagacatttcccttcaatccaaatcaaggcccttgttacaatttcttgttaactctctatttttccttgaggacactgagaatgatgagcagttatatacaacatttgtgtcaatacttatttgtgcaactgtcaaaagcttctcagggcagggcccctctctgtgttgctcactgctgtgccccccagggcctaggcctgctttctgacatgggatgggtactgatatgtgaaggaaaggaaggctcagcccaatggcttctcccttctttgagtccagtcagtgctggggtcctcctccacactccaccatgtataagtgacccctctcctccttcctaaaaaacaagctcaagttccacattttttttcccttcatgaatctccccggcacatgctgcctcttaaaccacaactgccataattgttaacatttaacggtgtgcctaccatgtgccaggtactttatgtatgtgtgtgagtgacttttcacagcagccctgggagcaatcaccatattcattttacagatgaggaaacttaaattcagcttatgagtaaatggcccaaggccacacagctagcaagtggcagagccaggctttaaacccagctcctgtcagctccagagcctttgtgctccctggccagtctactctgcagacccacagctttcctggctccctcctgaggaccagaaacatctccagagtcactctgcttccctggccctgtagggaacggccaatgtgaccaacctaccaagtgacacacatgctgagggggcaggagctcctctgaccacatgaacgacaaagaaacagccagcagcaacctgggctacttgtcacctaagggatgggcccgggctcctcctggagcgctgggactctcaccccagctggactctagggggcagataaacacaccatctggggaaagaaaggcgtctctgccatgaaatgaagatggcctttctagaaagagaggaaacctgagcatacctgagatcgggactcataagccctggagtccctgtcgtcctctctgtccatttcaaagcttgttttcgccaccacaggaagggaaagatcccgcggaggcatccctgggaagaaaaaaggcatcaacaagaagcagggcccagtccatcctgcaggtcccaggtttgtcccactcaactatgaagccagctggggtgtgagtgtatgagagcaagtgcctttctcttctctgcattctgtggcagcctctgaggagtcccataaaaccagtggccctacaacaacccagacccagggcagggccaggggccctgcctcatccttctgctcccagtctcggaggtggttcagattgtgcccaagctgtgtgggtccaggtacagtgtccactagcctcatccttcgggcacaacctctgggtctccccagctgcaatgtgtgacagggagatggcatcagagaccgtcccacagggtcatggctctgaacaatgcctattgtgttgtgaaccgtcactaaatgtcactcactcctgatatccttctcctgatcaattttagggtgccctgctgcccacagcagtgttctccaagtccaggaagaagaggaaatgatttccagcagtatggacaccaacaatacactggtgtgatgattgattcccttccaaatctcaggcctggtgctcagatgtggcacttccctaacactgcaggaagtcatggcagacattcctagttaacaatattgttacaatgtgtttttcattctcgccttctgcctatggcacttcatactagttttcaatttttgcagtggcatagtctttcatacagaaacttccagtttttttttttttaatgcaccagcttaagaatactgagcaaatagtttaggtggcaacaggtctatgtggtgaaacctgtgctggtggtaccgagtggaacttcaaaaatacgagccttggactaaacttttggggaagcggaatatactccaaatggagcagcagaaacttcgaggccctggcactttccccttgaacctgtgcacagcacatgctctatatctcctactgggaaagaaagtggttaagactcactgcttcttgggttcctggtgtgggaccagcggtctcgtggctccatgtctctgcttctgcccctccggtcccagtcccggtcacctaagcaggtgagacattccagtggttaacaaagctctttgacacacctgttttccctgcatgtgcacaaacacccctctggaaagagatgctaccctcttcccacaaggagatggatccaaaacagagagctccaggttcccaggctcatctggccccttctttatcatatacccgcaacatggtttctgcaggctttgcccaagtggggcttgcttccaagcaagttccaaagctcagtccagtagctaacccccacttcagactctttgctggcttcccagttcctaaggggctgagtccacattcaggagaatggactgcagaccccctactgtctggcagccgatcttaaagtacacgttattctactacaaaaaaaacaaaacccaagaaaacaacacacacaccctccctgaaagcagtgctccctataaaagctcactgaagcatctttaatgaaccttcctgaggaggctgggggtacagctggaagcagcctgttgcaaattccaaatagctttatatactttatcgttgaataaaacggtattaagtatttaaggtgtctgtttagatataaaaatgtctcattatgacatcaattaatttaccctctcctcagatctctgagtgaagctgaccactcggggatggcgggtcatcttcatggaggccccaacccactgtgtctccatctggaagcatctggcagcgcctgcccatgggtgaccagtggggatgggtactcaccactgaaagaatggactgagtgaggtggtgaggactctcttctgttccgggtcatgtcgtcgtcgctggtcacgtcactgttgttgtcgtctaagaggacaccggtcgccaagttactatctctggcccacattctcacaatagttccccccaatccctgagccgcatctccctgtcacagacacacatggttggaatgacctgatcctgacatttctgagttcaaaacccttcagcggcttccaaccactcctggcatactaaaaactgggtggggggagcatggtggctgtgaccaccccgacctcacccccagacacaaacagccagaaggcaacctcctagcacaccacaccaaaaaggcaggagccataggaggttttctcccttctacagaagtgtctcctttccctctcctgactcaggatggtggttctgcactagggaggttttggcgaccaggggatacctgggcatgtgtggagacacttttggtggccacacccagaaaatcatgatgcagctcaatatcccacagtacacaggacatccccaccgctgcccaggacagagagttatccagtccagaccatgtcagaagtgtggaggctgagagccccaggggacacctgaggcctgcactgaccaccaacaccccgtggagactctcaccttctggttggtacatctccttgtaattctccagcagagtgacgagcttctcacagttctccggcttttttgctcgcacccaaggcttgagcttttcagggatgatggtcaggtactgctcaaggaccaagagctcgatgatctcctccttggtgcgggtctccggctgcaaccaatcgaggcagaggtttcggagtttgatcagggtcttccgaggcccaacaaattccacatagattaggttccgaaacctctgatgaaaaaactcagagtcagttggaccttctcctatgatgacatccggctccttagtcaagtcactgtctagctcatacagatttggggcccaggacttcttaggtttggtggcagacaagtgctttggaggcagcatttctctaagtaaaattttcactggaggaaccaaacatgagtcaacaggaaagacgcggcagcctgtgaccgtcagtactcagggacctgtggatcgtaaggagatatacacatgtcccagaagttgaagaccaggcagcagtggaggccaccttaccagaggcatcgacaatgcttttgggatatgggagtccccagtaaataggcaaacaaccgcacaaagttggcctcagcacagcagttacaagcatgacctctgggcttcacagagacctactcgaggagttagctcggctactaacttgggctactaacttgggactgtgggcaacttgtctaatgccctagaagt

SEQ ID NO: 1396 - DNA, 30651 bp, Homo sapiens
gaaatatttatttttaactttatttttattgttgacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgttaacagttaattgttgttgggtgttgggaatatgtgtgaattttctttactgaatttccaaagttttgtatgagtatgtattatatttgtaatggaaaatacatacataaaatttattaccaaaacaccaaagattatttaaggaatttgagacaaaatatttaaccaaattcccacaatgacaacactattttagttattttccacatcttttcatttaagactttatgcacacatatttaacactgttatcacaagcgtgtgcactgaaacaagatagaggaaacagatcaagatgttagcagtagttgttaggtgttgggaatataggtaattttttaaaataatttactttattttctaatttttcctctgggtatgtattatgcacaccaatggagacacacataatacactgttatcaggacattattatagggaacatttgaaaaaattaaagtgaaagtatttaaccataattccacaaaggtaatgtaacagctattttgaatatacattttgacacagttataatcataaacctgtgcacagaaacaagaatgaacaagataagaggagagtatatgtctttggatggtggggatatgattttttttcctccacttttctgtattttccaagtgtgtgataatgagttcaaattatgttcacaatgaaaatgtgatcataaactttttagtaacactaccataaagaacattcaagaaatttaagaaaataatgctcaactataagcctacaacaacaacaccacaacagcttttgactataagcatatatatttttaaacagttataatgaactgtttaaatgaactgttaaatgaacagcatataaatgaactgttgagttataactgtagtataaatatactttcgtgtcctgctttctccacttaatgttctgtaaatatatttccacgttgctacataactcgtgattatcatttttaaacagttgcattaagtgtccacagataggtttaaacaatcattctcttgtttaccatttgttactaccttttcactagctgaaggttggaacggacaccctgacttacagcaagttgctttctgaaaaggggctaccactgccaacaatgttaacaccaagtaatgtacccacaaagttcaccccgacatcaacactgattctcgtttcaagagtccttttcccatgtagtaaacctcactgcccctcagctttcccgatgtccgttccaacctcagtccttcctatgcagccagccctcacctacaccataccatcaaaaactccttttccaaactgctcaggacaccccgctcaattcattctcagaaacctggccttctacagttcttgcctctggtgttttcttctgtctgtctcctctcccctcctagatctggtgatatattaggactcccttctttgactcactcatttctgcttcttgctctcagctctacaatcttcctaaactttgacactccctgcatctttgacatacttccaagccctaatcctgcagatccagaagagtaagattcagacacatttcccccagtgggtactttaattttgcttgttcaaatgatctacacttacattttgcaaatctttttttttaaattttttaaattttatattttttttccagccaactcaaggccaaaaaaaatttcttaatatagttattatgcgaggggaggggaagcaaaggagcacaggtagtccacagaataggacacaagaaacctcaagctgtgaggtcaatttgtaattaaaagaatactaagattagatgaacacaacactcagaaatactctaggagagctgaaaaagaaggaacagatgttaacaaaacaaattaaggctgctggggaacctgagtccatgttaagcttgggttgactgtaaagaatttttttttttttaatgcaagttagacatggagttagagggtcagataaataacgaagagaattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatgaaaggttattagcctgcaacattatttacagcatgagagcctctcctacggttctcaaccttcattaggcactactgtgatctagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgctggcacgttcgatgtagcctgagcactccccaaaggcatttgcaggctcaaatatgatcatgctggcatgagttttcaggtgttcactgaatgctgtgctggaagtgaaggtttctgtgcattcatggcagtcatagtatggttcttctacctgaatctcttgatcttcaccttcttctgggtcttcaattcccacaccgtcaggctcgtcggcatctccctctggctcttcagcttttccctctggctcttcagctctttcttctgggtcttcaatacctgcaccatctggctcatcagcatccccatttggctgctcggcctctccatttggctgtccagcctctccaatgggctctgcagcctctccatctggcccttcagcctctccgtttggctcagcagcctccacttctggctcagcagcctccacttctggctcggcagcctccacttctggctcagcagcctctacgtttaagccctgaatcctcagaactacttgtggaacatggacattggcttcaacttcctgggctgctgctgctgcagctgctgctgcttcatcttcttcttcttcttccagatgaagctccttatgtttagtgaggactgtgctatgaataaaggacttaccacaatccttgcattcatagaatggtatagctcctttgaggggctcagtaagaaatgaggtgtgagtataggaggacccgtactcatagggctcattcttatgaacagttacgtgatctgcaagttctgctgggttgacgaaagattctccacagactgcacattcaaagagtctctcttcggtctgacttctctgaaactcagtgagggctaagcctggaatgatagcttcctcagccatctggctctgctccagtaaatcatcttccctatgaagtctcatatgctcattaagggcagagctatgaatgaagccttgtccacacaaaaggcatcgaatggccgacccagcaagagcaggattcctctctgcagcacgattcctccgtggcttcatgggcaagagggcaataaaaccatcatcacaccccttcatggaatacaactggtcttgttcatggattctctgatgctcgaaaaggaatgagctatgaataaaagattccccacactttggacattcatacagctgctctccagtgtaatctctctgatactcgctgatggaatgggtgtgaattacagaatgtgtgtactcccgactgtcaaccaggcacttcctgctgtggactttctgatggtctgtgaggtctgtgagatccacaaagcccaggccacagtcctcacattcatagattttgtcatcagggtcatccttctgagggtcttccatgtctgagccttgaatgacagggtcttcaattgtctcctgaccatgggtctcctcgctgtgggtctcctccccatcagtattctcgccttgagactcctcgccatgagacttctcttggtcatagattttctggtttgtgttgaggtcttcgctggtagcaaaaaattgtctgaagtccttacatttgttccgcgcttgctctttagcatactgctcttgggcgtaacttgtttgagggtcagtaggggccaagctgcgaatgacagaccattcatagtttctgcttccagagggcttctccctatcatgaatcttctggtgctcagtgaggtcagagctatgagcaaagcactccccacactcctgacattcatagagcatccctcgagggcgaaatgtttgttcaccaaaaggcagagagtgaattacagaggtctcattgctcctatgctcaatgtatttctttttagcacgagccttctggtattcacggacatttgagctgggaacagagaattcgccatccttcttaaactcaccagatccctctccaggaacacttttctgaggtttggcacggaatacactctgtatgacagagtcttcatagttgcgattcttactgcccccttcacaagggttctctctggcaggaatcttctgtcgcttatcattaaggtctgagatataaatggaggattctcccttctcattagattccaccaattcatttccattgtgacttcttggaggtttggaagccactaagctatggataacagacctactgtattcccttccttcagaggtgttccctccagcacgaactctctgatggttgatagcatcgaagctctgaatggtagactctgccattacttttggtttactgggccctgctacactgtgacttttctgagcttccacagaggctaagctatgaataacagacctctcatatgattttgcctcatagacattttccttagtgggaatcttctggttttcataggggttagagctaatggtgaacgccttttcgtcctcatcactttcaagaggtcttgttatagtatgactcttctgagattcagtgaatggcccactatgaatgacagatttctcataccctctgccttcaaagaggttctttcgagaatgaattttctgatgctcactgagctctgagctttgcatgaaggcatcccggccatctgtaaagtcacagagcttctccttattgtaagttttctgacgccttttaagggactgaccaggaataaaggtttcctcacacactttacccttgttttcaaatgggttccctctagtatggattttctgatgttctttcagggatgagctatgaaggaaagtctccccacacaccttacattcgtacattttctctttaccatacattttctgaaactcattaagggctgggctgggcctaaaggtttccccgcgctcacgttcacgttcacgttcatgttcacgctcattatctttgtcatccccaaagtggattttctggtgctcaatcagggcagaactatgaaggaaggtttccttacacaccctgcactcgtagaatttgtctttgccatatattttctgaagctcactaaaggtggggctaggcatgaaggcttcctcacattcctgattcttacattccacaagataacctctagcatgaatcttccgatgttcagccaaggcggcactcttattgaaggtctctccacagtccttacattcaaaacgtttccctccaacctgacttttctgaacttcactgacagccacactgtggataaaggactcaccatactcatagaggttctctctagtatgcatgatctggtgctcaacaaattctgagatgacactgaacgacctcccacactcatcacatacatatggcattgccccaaaatcaattggctgtgactcggtaaaggagggggagctgaggctgctcaggctgctcacgctcatggcttttctcatctcactaccacattcaaagggcttcttcctgggacagcctttttgatcgtgaatcgagcccttcccatctgtgtcaaaatgatagcgcctctttctttcaagaactctctttctggaaacaagggttgaattaaacctaaagcctcccctaaatgcattcccttcataaacccgctgctggatcactgactccctcttgttcaatgaaatgtccttccagttatcatctgacattctggggaatctctgtgaccggtcgcttgactcccttgctcttcccgatttggaactgcgtgacacatccttgatgaatttttccattatcactccgtgggaagattcatcttcacaaatcccccgccggtgggttgattttttggcttcaggcatagtttttagacctggaaagaaaccccaaatgtaaatactccctagtccccataagaaggacagtgggacttggaggggtgcacccttctgtgatgtttaggaatgcaaagtgtagaagttccttgatagcatctcactggttgtgtggctcctctgtgggatgtgcctcctgcttacctcgactggtgcttgggtaggcacttctcttggatcttgatgagtggccctgcgtcatgtgggagtggccatcgtcttcagcaagctgcactcctggtcacaaggacaatatgatgcctcaaattcaagttgaggaccaagactcatcaccataaattgatcttcatctttcactgagccactaaatatgaggtggcccacatctgattccttggatgtcagaagacatttgctgtctcatttccctactatctattccctaatccattctaatctacatgtaattcttctgactccactcagaaatgtgtacaaagaccccacatgtccctgaaatcagtgcattgtcttttagtcttcaccttcttgtaaccactttttaagtcctcttttccactggccttcttcctcttacctcgcgactgctcttcctccacccactcccttgaggccccatggccttacagacctgcagcacagccaactgcccactaccaacttgggctagatgtcttccaggaaagtccacatgggaactcaggatcccatcctgaatgtctacttaaaaacctccagtgctaccactctggaaaaaagtatcaactcttgtggcaagaagcatctccctgcttgtccccaccctgtacaatgtatctttacccaaagccagaggcatttcttaaaaacacaaattttatcatttactccctcatttgaaatctttcaaagatttcttattacccttgaagtccaaatatattaatgtggactctaacatccagcttaaaaaggagcaagatgacaaaatgctccaatgactggactgggagtgactgagagaagcagctgcttaccgagggagagcagcttcctgtagttttccatgttgtcctggattgtgttgtgaggtttcctgtcctcagcgaggtccaccacattttggtatgattcagcatcctaaaacagcaaacacagacctctcaatggagtctgtccccaccgatgttcaaagacagaataatgttggcaacatgggagttacatatatgaagttatataggaagtgctcacggtattggggttctgagtgatccaagtcaagtgttactagggacctacgtcgtacctaccttggtgctacactctgaggcagatcccaaagacgcatgacacatattccttgccctcatgcagcttataatttggttggagagaaaagactcatgaaacaattagagaacaataaacaataaatcggggtacagatagtaagtgctaaacgggttttgtagagggacagttcagggtgggcctgaacagtgtgcaaaggtttgtggagggcaggtggggccttaagtggtaagtgagattatgacacatatagaaagggattggtgggaaaacttagactaaatatcaaacaggcacggagtactcagggaacagaaagaagacacacacattcaggaagacatctggtcaggatgtgacttaaacctccctcccggtttctccatggcatagcatggctacattgagggagtctccagtttgcacaatttccaaatcacccaggaataactgtaagccctgagggcatttttataattgccttttctgtcttaatggatatttacctaaaaaggaattttaaaattcctcacattactgaggagaaccttctaccaggattctaaaggacctttgcttattgccagagggctgactagaactggtttcagggagtcatggtcccaggaagaatggcactgaggctggagagagacttgaggagggagatggtgctgtgggaagcccacaggctttggagctggacagagatctgggtcaaagaaggattgcaccaattatgagctatgcagccttgggaacggaaatctttttgaacctttctttcaggttcttcacctgtaaaatggggagaagagtatctatctgctttgcaatactgtgggtgaggattttctgcagtgtgatgtcttgcttaaatattaagaaaattatgtaaaggaaatacaaatgtcttgatattaaatctaccatagttctattgctgggaagaggcatggagcaacatgaaaaatgtagcaaaaaaaagaggacttgctgagtaagcaaagacaaagaggtacgggtatctgggtttaagagggaagccttatccatgaactgcctgtgtcctgccacaaaaaagcagaaacaacaacaaaaactaagtagggcaaggaaacacagcagagcttcacagataaaattcttttttcacatgaaagaaaaagcacgctttgattgaaaattaaaatctaggccagtgggcagccctaaattggttgttcgctttgtgtttgtaatcaacaatgacatcttaatgcatacaaactgcaatcaagttcaatggaagagatgctgttctgaaaacaatgctagtatggctcaatgtagttttcacaacatgatctatacatgtgaacaattaagaaatttacacatgaagctaaaagatgagagaattttctgttgtgtacaccttcaaaatgtaatttgtgtcatttgctgctggtgttaccaccatactgagtcagtaggaatcagtagcttccagacttttaattatgcagacatggggctcggatgccaattcttcacacattgtcaaggaagggcatttaaaaagcaaaacaagacaaagcccaactaccaagacaccagtggccaggcccacacatgcctccagccttcttcctatatcccagccacctggcccttggtttggttcccatcccacaactttagctgagctctccctaatgcctggggtcccctcccccaacacctgacccggcgtgctcctggctctaaatggcaactgttaatgcctccaagacatttcccttcaatccaaatcaaggcccttgttacaatttcttgttaactctctatttttccttgaggacactgagaatgatgagcagttatatacaacatttgtgtcaatacttatttgtgcaactgtcaaaagcttctcagggcagggcccctctctgtgttgctcactgctgtgccccccagggcctaggcctgctttctgacatgggatgggtactgatatgtgaaggaaaggaaggctcagcccaatggcttctcccttctttgagtccagtcagtgctggggtcctcctccacactccaccatgtataagtgacccctctcctccttcctaaaaaacaagctcaagttccacattttttttcccttcatgaatctccccggcacatgctgcctcttaaaccacaactgccataattgttaacatttaacggtgtgcctaccatgtgccaggtactttatgtatgtgtgtgagtgacttttcacagcagccctgggagcaatcaccatattcattttacagatgaggaaacttaaattcagcttatgagtaaatggcccaaggccacacagctagcaagtggcagagccaggctttaaacccagctcctgtcagctccagagcctttgtgctccctggccagtctactctgcagacccacagctttcctggctccctcctgaggaccagaaacatctccagagtcactctgcttccctggccctgtagggaacggccaatgtgaccaacctaccaagtgacacacatgctgagggggcaggagctcctctgaccacatgaacgacaaagaaacagccagcagcaacctgggctacttgtcacctaagggatgggcccgggctcctcctggagcgctgggactctcaccccagctggactctagggggcagataaacacaccatctggggaaagaaaggcgtctctgccatgaaatgaagatggcctttctagaaagagaggaaacctgagcatacctgagatcgggactcataagccctggagtccctgtcgtcctctctgtccatttcaaagcttgttttcgccaccacaggaagggaaagatcccgcggaggcatccctgggaagaaaaaaggcatcaacaagaagcagggcccagtccatcctgcaggtcccaggtttgtcccactcaactatgaagccagctggggtgtgagtgtatgagagcaagtgcctttctcttctctgcattctgtggcagcctctgaggagtcccataaaaccagtggccctacaacaacccagacccagggcagggccaggggccctgcctcatccttctgctcccagtctcggaggtggttcagattgtgcccaagctgtgtgggtccaggtacagtgtccactagcctcatccttcgggcacaacctctgggtctccccagctgcaatgtgtgacagggagatggcatcagagaccgtcccacagggtcatggctctgaacaatgcctattgtgttgtgaaccgtcactaaatgtcactcactcctgatatccttctcctgatcaattttagggtgccctgctgcccacagcagtgttctccaagtccaggaagaagaggaaatgatttccagcagtatggacaccaacaatacactggtgtgatgattgattcccttccaaatctcaggcctggtgctcagatgtggcacttccctaacactgcaggaagtcatggcagacattcctagttaacaatattgttacaatgtgtttttcattctcgccttctgcctatggcacttcatactagttttcaatttttgcagtggcatagtctttcatacagaaacttccagtttttttttttttaatgcaccagcttaagaatactgagcaaatagtttaggtggcaacaggtctatgtggtgaaacctgtgctggtggtaccgagtggaacttcaaaaatacgagccttggactaaacttttggggaagcggaatatactccaaatggagcagcagaaacttcgaggccctggcactttccccttgaacctgtgcacagcacatgctctatatctcctactgggaaagaaagtggttaagactcactgcttcttgggttcctggtgtgggaccagcggtctcgtggctccatgtctctgcttctgcccctccggtcccagtcccggtcacctaagcaggtgagacattccagtggttaacaaagctctttgacacacctgttttccctgcatgtgcacaaacacccctctggaaagagatgctaccctcttcccacaaggagatggatccaaaacagagagctccaggttcccaggctcatctggccccttctttatcatatacccgcaacatggtttctgcaggctttgcccaagtggggcttgcttccaagcaagttccaaagctcagtccagtagctaacccccacttcagactctttgctggcttcccagttcctaaggggctgagtccacattcaggagaatggactgcagaccccctactgtctggcagccgatcttaaagtacacgttattctactacaaaaaaaacaaaacccaagaaaacaacacacacaccctccctgaaagcagtgctccctataaaagctcactgaagcatctttaatgaaccttcctgaggaggctgggggtacagctggaagcagcctgttgcaaattccaaatagctttatatactttatcgttgaataaaacggtattaagtatttaaggtgtctgtttagatataaaaatgtctcattatgacatcaattaatttaccctctcctcagatctctgagtgaagctgaccactcggggatggcgggtcatcttcatggaggccccaacccactgtgtctccatctggaagcatctggcagcgcctgcccatgggtgaccagtggggatgggtactcaccactgaaagaatggactgagtgaggtggtgaggactctcttctgttccgggtcatgtcgtcgtcgctggtcacgtcactgttgttgtcgtctaagaggacaccggtcgccaagttactatctctggcccacattctcacaatagttccccccaatccctgagccgcatctccctgtcacagacacacatggttggaatgacctgatcctgacatttctgagttcaaaacccttcagcggcttccaaccactcctggcatactaaaaactgggtggggggagcatggtggctgtgaccaccccgacctcacccccagacacaaacagccagaaggcaacctcctagcacaccacaccaaaaaggcaggagccataggaggttttctcccttctacagaagtgtctcctttccctctcctgactcaggatggtggttctgcactagggaggttttggcgaccaggggatacctgggcatgtgtggagacacttttggtggccacacccagaaaatcatgatgcagctcaatatcccacagtacacaggacatccccaccgctgcccaggacagagagttatccagtccagaccatgtcagaagtgtggaggctgagagccccaggggacacctgaggcctgcactgaccaccaacaccccgtggagactctcaccttctggttggtacatctccttgtaattctccagcagagtgacgagcttctcacagttctccggcttttttgctcgcacccaaggcttgagcttttcagggatgatggtcaggtactgctcaaggaccaagagctcgatgatctcctccttggtgcgggtctccggctgcaaccaatcgaggcagaggtttcggagtttgatcagggtcttccgaggcccaacaaattccacatagattaggttccgaaacctctgatgaaaaaactcagagtcagttggaccttctcctatgatgacatccggctccttagtcaagtcactgtctagctcatacagatttggggcccaggacttcttaggtttggtggcagacaagtgctttggaggcagcatttctctaagtaaaattttcactggaggaaccaaacatgagtcaacaggaaagacgcggcagcctgtgaccgtcagtactcagggacctgtggatcgtaaggagatatacacatgtcccagaagttgaagaccaggcagcagtggaggccaccttaccagaggcatcgacaatgcttttgggatatgggagtccccagtaaataggcaaacaaccgcacaaagttggcctcagcacagcagttacaagcatgacctctgggcttcacagagacctactcgaggagttagctcggctactaacttgggctactaacttgggactgtgggcaacttgtctaatgccctagaagtctctctgtaatctgagaaataagaataacagcacctccatccctttcagaattgtgaagcttaaataaactaagatacctaaaaagacttaactgcccaatgcaaggcacaagagaaatgttcaaggccctagccagtactaaaatcagacgtcagcacgtttattagcaaaaatgaaaaggggaagtaggagttggggcaaatcctcccctaacatttcttcccttaacacaattattaaaacacagtatacaacatgtaaaaaatggaagaccattcaaaaatattaaaagtactcaactctaggtaatatgacattattccctcacacagtgagaagtgaccattgagcctcttgatgctactgcacgttcttttgccttcatcaatcttgacaaaggtctaatctgtctaaaagaaccggctttctgttttgacattcctttcttactgtttctttacttagttcatttatttccttctctttattttattatctgcccccttccattttttaaacttttgagattggacataaatgtaaagattttcaatctctccttttttttatgtaaccaagtaaagctatacatttccttaaagcatttttgctattatttgcattttattgcgtattttaatgactggtcagcacatctggtgcaactaagtaaggcaatatgggaaagaaatctaggtctgggagcataaactacctactggctttacttccagagaagaaaaaaaaccatatgcaacagaaattttctccctttgttttaaaaggaaagcaagtttaaattttttaatttggaaaaagtctaaaggaaaactgaaggtgtttccattattcagagtctctcattagacattatcacttgcaaatcaatgtggtaatcacggtaaactcatgtttactcgtctcagtgatgggctcccacttccctccctatgcaaactgccctcccacgctctctcctgcatattatcatcccatggagcttgggcaccatccaatgcaaatgcctcgatcctgaagaccttagcgactggactatttccttgctgccttccttcataggactgagaaaccacggagagcacaacatagataatgctctgctgggcagaagaatcccaaagcaagggaaggcaacagaccagagagtccaggctccagatgattggtgtgacatttcagacatggtcactctaacccaggacagggcaagagcagaggtctgtgcctgtgagggagacaggcaagggcagacggcccaactctgttatgtggcagacagactcaggagaacactctggtacctgaaatgatactagccctcatcctcaggcaacaagataccctcagatatgtaatcacctgtctgggaacaggatcctttctggaacttcagaccaagcagctatccacaggaacagagtcaaaacacaggtatctgcagaagttttaaaggaagaaatacacagactaagaatatgaaagacatgtagaaggagtgtcagagaattaactccccaaacaactggggactcaaatagcactggggtgatgccttctataccttcggggaaaggccattcccatgctatataaaccatgccagacaggagaaataaaaagctttcaaactgtctttatgaaaccagaacaagtcaaaaacgcaagacaaagatatcactaagaaaccacgaaccaaaactcatgaaagcagaaataaaagtcttaatgctgctattattgaacattattctatgcagttctactcaattacaataagacaagaaaaacacatctgaggcacagagagataaaactaacattcccttatgtaagatctatacacatatatatgcttctattctgtgaatttctctccctaacagacatgaattgaagcataaagtaccctaggtgaaagctatatatcagaatggcaggcttatagagttcaataggaaaccaataatttttttaaagaaaatacaaatagcccaacctgactcaagaagcagagaaaaatatgaccactagggaagaaatctaaaaagctgaaataatgtaaagagcaacttcccaagtaaactttctgtgaataaaatatttaccgtgttataaaaaccattccagagcacagaaaagagatggaggacttcctacaattaattttgtgaccacttgaatgcccatatgtatcttgtcacaaggtggatgccaacttctgtgccaaaaaaaataaaacacattgcttttcctcaagaaattcaggattaaacatacacaatcttcccttaacatgctcaagattttctgaccaggccaatagaacttggcccttggtcaatagaagccattgaaaaatggaagttatttttttaacagaaaaaccttaaaaaaaaaaatcagatctgagctacttcccaccatggcagaggaaactcatttgggagtaaagaaaggctttggaaacaaaacaatcaatcataaagccgggcaacatatgtttgtatgcacgggaagaaacaagtacactcatatactgcctgtggcaatgcaaattttatcaaaattaaaagtgcacatatcctcctctcctacaaattctacttctatgaatttacctcagagatatgtaatgacctatgtgcaagaatatattcattgaagtgttgttaatagacaagatatgttatgtttgtataatgaattactatgaaaccctttaaaataaggcaactctaaataaatgagtatgaaatgatctccaagatagttaagtgcaaaaccggacacagcactgtatacagcattctcagaaactaaaaaaagatgtgcttagacagatgatttctagaaggatatataagagactattaatgatgactaatcgcaattgcctctggggaagggaactaggggtcaggaaagggagggcaacttactttttcattgtatattctccttttgttttttgtttttatttttattttaccatgagcatgtattacctagtcaaaaaaataaattcaaagttaaaacaaaacaataaacaaaactaccagtagaggcctttagaggttgtgctactcacagagcaggtgcaggcagccgtaacatctttacactgatgctgagcccaggctctccccgcatcgcctccctatcaccatccacagcttgaatccatagtcataccctaacctggccattagcaggtacatgaaagtcaatttagaaaaccctaaagaatcaactttgaaacctgttagacccaataaatacttatgatattgcagttgcaatctgaatatacccctcaattacacccaacaactgtcagtacataaatacaatgccatcccctatcttggcaattccacttctgaaatctaactcacagacccatctgcccatgtgcacaaagatatacagttcaaaagtgtgttcacagaagcactgtttacaacagcagagaacagggacagtcaaacaaatgctcaagcgtaattccaatggcagagaccactgaaaggccaccacgtgggagacaggaaaataaagatgggtccaacttttctgcactataaaaaccaaccaaaataaaaaccaagcaaaaagggagggggaaaagtattttataacacagatgacagttaatgtttgaaatgtaaaaggcttttggcattaggaaaaatagcccaatatgaaaataaacaacactaatacacagagttcctaaaattagtgataataaaggccggttacttaacatcaaaaatcaaagaaatgtaaaatattacaataaaccttttttgacctgtcgaatgggcaaatgtttaaaagatgaaaattgatgctagtgagggtgtagagaagctagctggtgcaggcatgaaccacatttctggatcccattttggccactgtttaaagatactaaaaaaaacacctacttcttttgaaccagcaattctccatttaagaacaaatatagccaagtagataaaatgataataagaaaaaaaagctaaaaagtcagctgcagctgggcgcagtggctcacgcctgtaatcccagcactttgggaggccgaggcgggtagattacctgaggtcaggagttcgagaccagcctggccaacgtggtgaaactccatctctactaaaaatacaaaaattagctgggcgtggtggcagtaatcccagctactcaggaggctgaggcaggagaatcacttggacccaggaggcagaggttgcagtgagccaaaatcgcaccactgcgctccagcctgggcaacagagcgagactccatctcaaaaaaaaaaaaaaaaaagtcagctgcacactatggtttaacctttgtatgtacagctaatttctggtttgtaaaaggtaaaaccttgaacacaaaataatggcaggtaacacattttacacatggaatggtgggaagggacgagcaccactgacagggaaacgtgttctgttgtgttactgctatgtaaccacagtcctaacacaagtcacattagagcaacccagagccaaaggcaggaagaggaagtgctggtcaaccttctcctgcagggctacctgacacaaggtgggccatatgcaatgaggttagctgccttcctggccgagtggcccaacccttagccttggattcaacccgtcctctacttgctgcccaaagggcaactagcagtggggccagatgctgaaatttgcacctgccagggccacatacttacctcaccctgactggggaagaccagatcccacgtgaccttctgtgacagcgagtctggccaatcaaaagcataactgctctgcccacttggcccccacttccccaggccagcttctccatggcaacagccacgcctaccactgaagaaaacagaagatacgtgtttgcaggtgctgagaggaagaaaggtctaaaggcttgcctgatgctatcaaatgaaatattaaagctgaggagttaatctgcctgaggatggcctaaacgggccatcaataaaaacgtagcttattaatcagagctgtgcttgaagatgtatgaatccaacagaacaacagagcacctgtatttataccctaccgcaaggctccatgggcaaagactctgttacctttttcatctctatatttttataggtgttcaataaacattatttgcatatagatgcaaaaacatttaataaacccaaactaacaaagtccaaataatagcccatgatcttgaaaggctattccaggaatacaaggaggatgtcccatcagggtaaactgttacataaaggatgaaaggggaaggggagcccacaagcagtatttcaagttaaaaaacatttgcaaacttcaacagcctttcctcataaattcttagcagagtaaaagcaggagaccatctaagcattataaagacttatctcaaatacatgcaaacaagcatgttattaaacattaaagatgttcctctggaagtggggacaaggaagggacagctataccacaactacaatttaacatgaccctggaagtcctagctagtgcaactgaagaaaaagaaaagtataaatatggggcaagcattattttgaactacaaaaccttatgagtaaatacagcaagagaaataattcccattaatagcaaaacaaataaataaatctccataaataaatttaacaaagttacctgcaacttcaaacaaaatttcaaaaatttacagaaggaacacaaaaattagccgggtgtggtggcatgagcctgtaatccaaactactcaagaggctgatgcaggggggccctgggaggtggagggggcagtgggctaagatcatgcccctgcattccagcctgggtgacagaactagactgaatcaccaaaaaaataaaaaacaataaaaaataaaataaaataaaataaatgacagaagggcaataagtctgaaataaatacataaagacacgtgtatcacatttaaaaagctcctttttattttgaggtggggagttttgacaaactgataatccagttcttctggaagaataaatgtacaagaatatcaagacaaccctgcataaggtctatttggagtgggaggtggtttgtctgtaaaatgactccaacacacaaaaataaagtgttttttccaatataaggatataagcactaggacaaatataccactgggacataacagagtccagaattcaactgtgtaaaagtctatagacacatggggacttaatttataataaaggactggaaatggattccttatttaaatataaactaggaactttcttacagctaaatggcaaaggataactttaacaaaaaggccatgacaggaccgctaatacctcagtgtttggttactcaagcatgcatttctagaattagggttggcctttgacgttaggaaaggccaatataaccactgctggcatggagcctcccctaagaaattaggtatttcagctacacatctctggaaggctaaggccactagggccagtgacaaacatactttgttctaagtaagttactgcatccaaaaatcagcatctctcctgagttttcattaaacaaggaatgaaaacaaagtatttagcaaaatgttacataaccattaagtcgtgttgtcaaggaatgttacagctttattttctgattataaaaataaaacacagcactacatgcaggtattgcaaaacattcaccatagaaactgcaagccacacccactggttaactttgttgctattaataaatcttaaaatctatacttatgttgttcttactgcaaatattcccatttacgtgtacacagagaatgagaatgtccacacaatggaatataatgcagttttcagaaagcaaagctatagatggagaccttgagtgtgaactgtttaataaatggcatgatctcatgtatgtaaaaaataatcaaacatatggcagtacatacaaactaaactggaagaaaactcacataaacttgtattaagactattcataaaatagaggaaatctatcagaataaatgattaataataacaagtctctgtttctttttccatctctatttaaaatgttattttaacttcgcaatcaggaaaaaaactgaatataaaaatgtaagtaaatgcaattactgtttcctagcgtgtttgttttccttcctgcccagcttgttacagcacatcaggccctgccctttctctgctgggttccccataatacaatctccctctgacccttaagcactcccaccgacagtaccctgtggtcaccatctgtacctcccctctccagtgactgtaccacagagggggctaacacgcatcaagctccacacccaaatcctcacttcattgacagctgtctagccgtcatatggctcaagactgaactctggcccacagggcaaacccatatccttcctggcttgaaggtgggctcccacacacccctcattactaaagcttccatatctccctctgctctctcttcagagcaggactcagtgttaagtagtagccaacagcagttaggggcacacaagggctagctgactctgggccaggggacaaagaaaggtcaccaacttcaaggggagggaggagaggcgccaagtgatggggccactaataaaggatccctctacacagccaggcaggaagggtgcttctgggagtctggcgttctttgatctccaaaggatgttttctttacactagatgtctaaacatgaaacctctctgtatacagaacaagcctggcgctgcctgctgcatgacagcattgccattgaagtctggatggtggtactgatgccattctttggatattttatgacactttacttctattccattaaaatgagtaggaaataaaagcatggctcttacaattaatataacacataataaagatgaaactcatcaggcatccttgccagaagtcagggaagatccatggctttaatcagagaaatgatgggtcagtgttcaactgagcagggaagaacttaatgaaagaacacatcatgcactagaaagcgtctgggaccatgtgtgagaagaaatcctgtgactccggtttggcctcaggctcccacatcccatctgatgcaggagaaaatccaccgagtctccttcagtcccatttctatttacttactttggtccctcaccatggtgcacctagattcagccccctaactcgttctacctacctcattaaaagggggctggaattgagaactttaaagtcaggaaccgaggaggttactctcttcgtctcccagggacagcgtggtgtgtggtctcgtctctcttcttgtttgctccattctcctgcctctctctgcagaccgacattctctacttcagcacgcacatggagtaagatgctgtcccagcccaggcctacgtcacctcccagtttaaatgcccgacactcagtgtcccttcatccaaattctcagtattaaagtgcatgctacagcctgattccttctagggcagtggttctcaaactcagatgtgcagaagagttgcctagggtgcttatgaaatacggagctacctttccaggtgggatgactcaggaggtctgtggttccccaggaaagaagcattcctacaatcactccaggagctgttctttgagaaccactgctctaaggtatccagtctggtccaatcacctatgaataaggtacatatgggacatagggactttagagggaaaattttatataggagcaaggagtaaatgaccaccaactccatctcacaggccacaacctccaccctctggtctgttggctggcttctctcagataatctcaacatcctgggcttatttctaccacattaagcttagcacttaccacactgcagcaaaatctccttgttgttgtccatccttgagagatttccccaaaagtttagaaagagaggaaataatatctaagagttcagtcttatgaccagcacaaaatggttcaagacaaataaagctactttaaagagacaaaatgtcttccagaacagtatgagttatttgactatattctaataacaataattggctcatctgatttttttaaggggagggagtactaaaaagtaggccacaaagcttggtccatccaaccatctacaggatagtgaacaactctcatcagacctaacttgaatggagtttggggaggacaagggtgttagataaggggcttccgatatcttggtaaccctaagcaagggtttcactgtgacaacatggctgtaccaggctatgtgacaaaccagcgctattaaagctcacccacatcctcttggttctgattccgtactcaccaagcaaccttctcattatggttgtgtttcccatgtaggtctgcctacagggagagaatttgctgatcatacacactgctgagtacttgggtccctgctattgtactcctaccatgaattaataaaccagaattgtgggaacaggaacatcctatttcaagtcacatgtcagtacggttttaagtctcctgagcttagttaaatgtggatctaccaacatgagccctcgggcaaaggaggtttccaagtctccacagggttaagcaccataatgcatatcttgagcactgaggccaggaatacaccaacccatcccaagggctcacctggtcatgtcagcttctccctaagcagtattccaccaccaccatagccacctatcttggtaaacacattcttactcttcttgtgatgggagtttccattcagtagacactgaggccagggattatgtcattcacttctggagactctaagcctggcatgatcctgtcctggatcaggcccagtatcaatgcttgctaacaaatgaacaaacagacaacctctagctatgtgcttgcttccccacatcatgtgactcactgtgcctcctctgaatcagtcagcaggccatgaacagagaaagtgaggagtctccctcctcaacacctctcaaataatctacccacttcactcctccctgtgatatgaccacaaaccaagccaccatctctcacccaggcccaagttggtctccccacacccactgcgtccaccctccccttctgcaccctgaaaccagatgatctttttaaaaccacaaatctgattatcatgatactcccatggttaaaagcacttcccgctgcacttaaggtcaagcccagttactcaccacagattacaagtcttttcacaatgaaaccacaacttaccttcttcctacctcaatcagatgccactcaacgattcccttgctctaggaatcctggattttcagctcctctctctgcatctctcaacaacaaccctatcccctctgctgagactactctccccatgacacacaccattcacactccttcagggctcagctttaatgttctttaccatctcagggaggcccctatgtggcctctctaagattaagtcagctgttgctagcagatgttctcttgcaaaagtataaatcaaacaattatgttttccacagctttaattcccaaatagactaaaaactctttgaaaacacttcctttcccccattggggctatgtcccagtacctggcacaaagtacacacttgatcaatattcacaaatgagtggatgaatctctcatgcttctttaatcaccaggcaagagaaaaagagtagccctgaaggagtagctgagtatgagaaaaagagggaggatactgaaatggatggtgtgaggccaaggagaatttttagagaatacacaatccaccagaagagtctgggtgttctcagagggcacaaatggtgctggggtggctatgtggaacacatatgcagtaggaaagtgtcagagtaaggaagtgcggtggtcactccaaagatgaatgtggcactgtgaggaggaaattcaactcacctggacccagccacctagcgtttggacctagtccctcttcctctcgccagtcgtctccaagaaggacggaagatcaagaaggcaaagctgtagaggaaaagaaaatgtgagacgccaagtttattttgcagttactgggttcctcaggggggaacaataccacaacagttccacatttatcttctatgatggcacaggtcaaatgagaccatgaaaagcatcccatccaggatgaatggccacgggtatagctcccttagaccacctcacaccctgggatgtactcatagactttctccaacaaggttacatcaaaggcattcaagtcaatttctggggtgtcttacaaccttctctggggctctagattaaggaatcaattcaagaaccccatttttggcgctggccgtccccatgttaggaccgctatcctatcgttattattaggtaatagtaccctttatcacgtaaaatattttagggtttatcaacatgttctcagtggactaataggacatagtccaagtcccactgcacctcagagtatgtgttcaatcaattagaggtccctgggggaaggaccttcatgattatgagactggtttatattccaagagtcaggtgggcatattttggtgaggttaaagagcttattaaaaactattcaaaggatgggcgcagtgactcgcgcctgtaatcccagcactttgggaggccaaggcgggcagatcacctgaggtcaggagttcgagaccaccctggccaaaatggcgaaacccctggtctactaaaaatataaaattagatgggcatggtggcgcgcgcctgtattcccagctactctgaagaggctggggtgggagaatcacttgaacccgggaggcagaggctgcagtgagccaagatcacgccaccacactccagcctgggtgagagggccagactctgtctcaaaaaaaaaaaaaaaaaaaaaaaaaaaaaaaaaattatgacaggctaggaaggaagcgtcatatgtgtcactttccctacctcaaacaaaacaaaagggctgacttaagatctccttgggtggagccagggctaggtaagtgagctctaggactccgtaggagagctagggctgggagggccacacccaaacgaactaagctttggaagctgggcagccctctagcggctctgctcatgaacagtttctccagaggccccaccctacctatggggcagcccctttaaacacacccccacctgcccagggcagcctcctagttcccatgcactgcccctctcaggaccacccgcagccctgaatttttccacctccagctgtacgattttgagtgaaaatccttcaccaacagagtctccaaatcacctagaccccaaatcttacacccacagcccacttcctccattttctcacttaaaatcccacctttccccaaatctcttaaaacgtctgagtttggccttggattccacttttctgctcactgacccaaggctgcacagctgaacccgcccgcttcccgaggcctggctttggcgccccctggaggaagtaaggcgccaccagccatgagggcacgctgcccaagatagcgggggtagggctcagctggcacgccagtgcagcccgcggtcactcaggaaggctccagtgcaggccccacccatgaaccggcaaagatggcacagaatgaatgaacacggctctacggccctgcctaccttgaaatcccctcagccccctccaacagccctgctgtcactcaagatggcgcctgcgcagtacacctctgctgcccccgccaccggccaacacacgtggtactaggatggacggggctcacgctcactcctacagcgcagctgtcattcagtaatggtgcctccgcactgcacccgccacattgaatgccggctgctctatcagacaagacacacatgctatggcccccctcagtcactcaagacaaagcagaccctccctcagaaccgcacctgcagccagcccagctgtcattcaggatggcacctgcacagtacaccgtggctgccacctaatggccagcaaagatgatgccacagagtgggcggggccatgcagaccccgtcagtcactcagtcctctgcacccggccctacagccaacccagcagtcattcaaaccagtgcctgtgtaactgccctcacgtgccccattacagccaaagattgcaccacagtggaccaggctcggcagcccctagtcactgagaaagccctccctcatgcccgcccctggggccgacccaggtgtcactcaagatggcgcctgcgcaatcaacctcgggcgccaccctgtggctagcacagacagtaccgtagaggcggtgaggggcagtggaggtgagggtgctctcagccctatcagtcccgaggaacggtcccgggccccagcccttagccccgccagcagggcgcctgcacaacccgcctcgcagctcccccactaagccgcccccatacacaagatggaaccacacgcatcctgtggtgaacaaagtcttggtcaggcaacaacaggggaaggggtgagcctctgccaccgttagccaaaaacacagcgagcgcggtgataacccgtcaccctgtccttaagcataaatggctccgcggccgctaaggcaaactctttaggcacgtctcccggctcccccagatgcggggactgagccagtcccactggcaaaacagcctggcgaccagcacacacagcccaaggagcgcggcactccacagctttccatcaccgcaaggcaggcaagcacagcaaccgtggccccgcccctccctgtggacaaccccacacctatgcggcaaaccgcagccgccccgatcaaagatggcacccaggtgggcggggcttgaacagaccgtcccgcccatgccacctgcagccacttcagccttgccccgccgcatctgccgccaaccaatccgggcaacgcctgcgcggcaaacctcagctgcccccatcaaagatggcgcccaggcgggcgggccttgtctcgcccaaccaactaggacagcgcctgcgcagcaaatctcaagcactttcattaaagatggcgcccaggtgggtggggcttgaacaaaccactaggtccaatgccaccctgtcacttcagccttgccccgccccatctgccaccaaccaaccaggacagcacctgcgcagcaaactccagcagcccccatcaaacatggcatctaggtgggcggggcctgagcagatcgtcatatccaatgctacacagtcacttcagccttgccccgccccctctgctaccaaccaaccagggcagcacctgcacagcaaacctcagcagcccccatcaaacatggcgtccaagcgggcagggcctgaacagatcgtcacatctaatgctacccagtcacttcagccttgccccgccccatatgccaccaaccaaccaggggagcacctgcgcagcaaacctcagcagcccccatcaaacatggcgtcaaagcgggcggggcctgagtggatagttacccaatcacttcagccttgccccgccccacttgccgccaatcaactagaacagcgcctactcggcaaacctcagccaccctcataaaagatggcacccaatgggtggggctggaacagaccattacatccaatgcaacccacagtcattcagctttgcctcgccccatctgccaccaatcaaccagaacagcgcctgcgcggcaaacctcagccaccctcataaaagatggcacccagtgggtggggcttgagcagacgattacgtccaatgccacccagtcacttgagccttgccccgccccatctgccgccaaccaaccaaggcagctcctgcgcagcaagcctcagccgcccttatttaagataccgcccgagagggcggggaaagaaaacccctacaggcaggacagcccttcgcccctcccaccaccactgcggcaaacaagccccgcccccagagggtagccgggcacgccggcgccgcgaggccgatggcaccccgcaggaaggggcattttcgcagcccccagacccagcccaggaggcccagggctcccgagagccgcattccgccgtggcaacagggatagcattggtgtcgaccttgctggacttgccgtggcagagcccccggctgtctgccctaatgcccccggtttgctgcggtggcccccggccagtcagaaaggcgcggagaccctgcagcagcccctcagaccccggactgcaagatggcggcaccaacgcagcagcccgggctgcgcccacccctgccccaaaaaggcaccaaccatccacagcctggccgccactgtgcccactctcggactgggcagcgggcggccaagtaccatgtccgccagcccgccctgccacaagggtcgctggcttgccgcggggtcttgggcttgcggcaagacggccactctggcccagagccgtcgcgacaccaaggtcccgcgggcaggaggcgcgcggggcggccgaaggcgcactcacctcacctcagtgctgcgcagcctcgggcacgaacagccgcctagcgcaccctcatggcgcccggcgcccggcggcgccaccagcccagggtggacatctcccgcgcctcccaaacctctcctcccgcagctgcccagacttctgc

SEQ ID NO: 1397 - DNA, 30651 bp, Homo sapiens; identical to SEQ ID NO: 1396

SEQ ID NO: 1398 - DNA, 30651 bp, Homo sapiens; identical to SEQ ID NO: 1396

SEQ ID NO: 1399 - DNA, 30651 bp, Homo sapiens; identical to SEQ ID NO: 1396

SEQ ID NO: 1400 - DNA, 11786 bp, Homo sapiens
caggctcatgcctgtaatcccagcactttgggaggccgaggcgggaggatcgcttgtgcccaggagttggagaccagcctgggcaacatagtgagaccctccccccacccatctctacaaaaaattttaaaattagctagctgagatcatgccactgcactccagcctggacaacaaagtgagactatgtctcaaaaaaatttaaaaattacccacgcctgtagtgtcagatagtcaggaggcagaggttggaggatgacttgagccttggggatcgagggtgtagtgaggtatgatcgcaccactgcactccagcctgggcaacagagcaagaccctgtctcaaaaactatataaaagaaaaaagggctgggtcggtggctcacgcctgtcatgccagcactttgggaggccgaggcgggtagatcacctgaggtcaggagtttgagaccagcctgaccaacaaggtgaaaccctgtctctactaaaaatacaaaaattagctggccatgatggtgggtgcctgtaatcccagctactggggaggctgaggcaggagaatcacttgaaccccagaggtggaggttgcagtgagccgagatcacaccactgcactccagcctgggcgacagagcgagagactccgtctcaaaaaaaaaaaaaaaaaaaaaaaaacagaaaaaaggccgggcacggtggctcactcctgtaattccagaactttgggaggccaaggcgggcggatcaggagttcgagactgcctgggcaacatagcgaaaccccgtctctactaaaaatacaaaaaattagccaggcgtggtggcgggctcctgtaatcccagctactcaggaggcttaggcaggagaatcacttgaacccaggaagcagaggctgcagtgagccgagatcacgccattaaactccagcctcggtgacagagtgagactccatccccgctccgctccctcacctcccgccaaaaaaaaaaaagaaaatgcactgcaatagaaaaataaaagtactacactttggtcaaacagggtaactactagaacgtaaaatgatctttttgaaactatccacatttgttacacgtgttgaaaatgtaggatatatatgttatatatatacttatatatgttatatatacttatatatgttatatacttatatatgttatgtacttatatattatatatacttatatatgttatatctacttatgttatatacttatatatgttatatatacttatatatgttatacatacttatatgttatatatacttatgttatatacttatatatgttatatatacttatacatgttatacatacttatatgttatatatacttatatatgttatatatacttatatatgctatatatacttatatatgctatgtatacttatatatgttatatatatacttatatgtatgttatatatacttatatatgttatatatgcttatatgtatgttatatatgcttatatgttatatatacttacatatgttatatatacttacatatgttatatgtacttacatatgttatatatatacatatatgttatatatatataattatatatatataaaacaaaaagcacggttactacaaagaaaacaggtaaacattaagtggagtaaaagtatatcctgttatataagggacttgaacatgtctgggcatggtggctcaagcctgtaatcccagcactttgggaggctgaggcgggtggattactggaggtcaggagttcgagacctgggcaacatagcaagaccttgtctctattaaaaaatagatagatagatagatagatagatacatagaacatcaaaagagggagagagaaagcagacagatgtggcaaaatatacacaattggtaaatttgggtgaagggaatataagttatttctactaatcttgcaattcttatgtatatttgcaatgatttctaaataaaagtttttaattaccaattgaaataaagtaaaataagtcactatctagccttttctagacaaatattttaaactcttacacagagataagttaatcaagaaacgtatttcctggaaaaacccgtgatatgggtggagccacctgggaataaaaggtcggaacatcataatcactgtcagactcaacttccatcattctcctccaggcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaactgtaagtttcattcaaggtttgcttgtttgggtgatgggatgtgtgtgtgtgtgtgtgtgtgtgtgtgtgtgtgtgtgtgtgtatgtgtgtgtgagtgttggaaggagggtctgtctaaacttaatgccctaaagatattgtcagatattgtgatgaggggaatttcatcttctaccctttatgaggttgaattgtaaattcgaaaatcctgattctgggtttttattttgaggggatagttttctgttttctgtggcattggatattggcattttcagaaaagagcatgcatccaaaatgaaaatgatgaagcctacctgtcttttgaactcagctcagggaaaagctgatgatctctaatttttgtgattcctcctttcattaaatttaaggtccagtgagggtgaagtttccctaaagaggcaataatttatcagcagcaacaggatgaaatggaggggcttttcttcacactctatatattatgttaggatctctcaggaaactgaggacacattaattataatcatggaagattttctgcttcccacatggtttgctgggtttggcatagtatagctcatgccctacattgaagaaatgtgggcacccatcaacagcagccatttctgattacacatccctgtttctttagctgagtgactcctaaaagtcccttaatgtattaataatgcatttggacctcagttttcttactatgttaaatgtaataaaattgaatatcatatggtcacttgcagaattaaatggtattaaggcatgtaaatcatatagagtgatgtagtacaacaaacaataaacctgtaataaaagtcactaaactcccttccctcccatgatggagccttaattttctctatatgaggcatccctgtagtttaatatattcttagaattagcaataggaatatgatgtcaacaattaattttgagccattttagcccaatgacttatcctaagaagtcgctattattgttgccatcccgttttcacttatacgaaagtaagactcaggagggttgagtttcagccttagtgttagaaaagcagtaagcggtgaagccgggcttggaatcctggaagttggaatgtacaatgtgtgatctcgatgcatcctctctgtagtgcctctttgtaacaagaaaaaaataaagatacttaaagttctaggtaagcaaagtcagaactagtctttaagttagagacccataaagtataaggtttctcaaacaacaaatgttgttagaaggtcttgttgtggcagagttccaagaaaaccaatgaatgtgaagtcagttgatatattaatctaatctgtgtaattggggaggggcacttttaggaatgcatttagagataatcccattaacacaggaggttttctcccagattaaattaacgtaaacgactttggaggaaggttggttttcccagtttctaagatataatgcaataaattaacatgaaagatggttgggactatgtgcagactttttaaataaacctcagtttcaggactctgacctttttgtttcttcctagtaacagccgtggcagtcagagctctgcctgcagtgtgaccatggacagctctccaaagcttaaacttcagtaaattgactcaagtttcttcggaaagaactgtgagtagcaaagggcaactttttctgttggtttcattgggatttcactgcttttcctgaaattggaatgttggaaggaagtaggcattcctcactgcctggggagaaatgggcaaatgagtaaggggagggagcaaattcagagagatattttttattttttctgaaacctgtttgtgttttgagatgtctttcccttcatgtttttttttttttcactcttcatatttccctttctctgtctctctccccacctcggttttgctaattagctagcacaacaactcgccatcttactccttttccttactccctgttttttgtggggttttttttttggttttcttttttgttttttttttgtttttgtttttgttttttgtttttcagacagagccttgctgtgtctccccagctggagtgcagtggcgagatctctgttcactgcaacctccacctccagggttcaagcgattctcctgcctcagcctccccagtatctggcactataggtgcctgccaccatgcccggctaatttttgtatttttagtagagaccaggtttcaccatgttggccaggctagtctcaaactcctgacctcaggtgatccacctgcctcagcctcccaaagtgctgggattacaggtgtgagccaccgtgcccagacagaacttctttatttttgccttaattttgttatttaaccagtagtcattcaggagcatcatatagagtgatgtagtacaacaaacaataaacctgtaataaaagtcactaaactccctttcctcccatgatggagccttaattttctccatatgaggtagtttaatatattcctaggattagcaataggaatatgatgtcgacaattaattttgagctgttttagcccaatgacttatcctaagaagtcgttattattgttgcagtcccattttcacttatgtgaaagtaagactcaggagggttgagtttcagccttagtgttacaaaagcagtaagtggtgaagccaggctttccatgtagttgtgtggtttttagtgagtttcttaatcctgagttataattggattgcactgtggtctgagagcttgtttgttatgatttccgttcttttgcatttgctgaggagtgttttacttcgaattatgtggtcaattttaaaataagtgctatgtggtgatgataatattgatctatctaatattaacaggggggtgttaaagtctcccactattattgtgtgggagtctaagcctctttgtaggtctctaagaacttgctttatgaatctggatgctcctgtattgggtgcatatatatttaagatagttagctattcttgttgcattgatccctttaccattatgtaatgccctctttgtcttttttgatctttgttggtttaacatctgttttatcagagactaggattgcaacccatccttttttttgctttccatttgcttggcaaatattcctccatccctttattttgagcctatgtatgtctttgcacatgagataggtctcctgaatatagcacatcaatgggtcttgactctttatccaatttgccagtctgtatcttttaattgggggcatttagcccatttacatttaaggttaatgttgttacgtgtgaatttgatcccatcatcatgatgctagctggttattttgcacattagttgatgcagtttcttctgtgtcattggtctttatattttggtgtgtttttgcagtggctggtaccggcttttcctttccatatttagtgcttcctccaggagctcttgtaaggtaggcctggtggtgacaaaatccctcagcatttgcttgtctgtaaaggattgtattttttcttcgcttatgaagcttagtttggctggatatgaaattcagggttgaaaattccttaagaacgttgaatattggcccccactgtcttctggcttgtagggtttctggagcaatccactattaatctgatgggcttccctttgtgggtaacccgacctttctctctggctgcccttaacatttttttcctttgtttcaaccttggagaatctgacgattatgtgtcttggggttgctcttctcgaggaatatctttgtggtattctctgcatttcctgaatttgaatgttggcctgtcgttctaggttggggaagttctcctggataatatcccaaagtgtgttttccaacttgattccattctccccgtcactttcaggtataccaatcaatcgtaggtttggtcttttcacatagtcccatgtttcttggagcctttgttcattccttttcattcttttttctctaatcttgtcttcacgccttatttcagtaagttgatcttcaatctctgatgtcctttattctgcttgattgatttggctattgatacttgtgtatgcttcacgaagttctcatgctgtgtttttcagctccatcaggtcatttatgttcctctctaaactggttattctagttagcaattcctgtagccttttatcaaggttcttagcttccttgcattgggttagaacatgctcctttagctcagaggagtttgttattacccaccttctgaagcctagttctatcaattcatcaatctcattctctgtccagttttgtgtccttgctgaacaggagttgcgatcatttggagaagagacattctgttttttggatttttcagcgttgttgtgctggtttttcctcatctttgtggatttatctacctttgatctttgaggctgttgatctttggatggggttattgtgtgggggtcttttttgttgatgttgatgttgttgctttctgttagtttttcttctagcagtcaggcccctcttctgcaggtctgctgcagtttgctggaggtccactccagacccttttcacctgggtatccccagcggaggctgcagagctgcagaacagcaaagagtgctgcctgttccttcctctggaagatttgtcccagaggggcaccagcctgatgccagccagagctctcctgcatgaggtgtctctcaacccctgttgggagttctttcccagttagaaggcacgggggtcagggacccacttgaggaggcagcctgtcccttagcagagctgttgtgctgtgctgggaaaatccctcttatcaggatcagctgctctcttcagagccagcaggcagaaaagattaaatctgctgaagctgtgtgcccacagccaccccttcccccaggtgctctgtcccagggagatgggaattttatctgtaagcccctgactgggactgttaccctttcttcagagatgccctgaccagtgaggaggaatctagagaagcagtctggccacagctgctttgccatgctgtggtgaactttgcccagtccaaacctcccaccctccttagcactgtccagggaaaactctactaacgcctcattaatcacggatgcgcctcccccaaccaagttccatcattccaggtcaacttcagactgctgcactggcagtgagaatttcaagccagtggttcttagcttgctgggctccatgggagtgggacctgctgagtgagatcacttggccccctggcttcagccccctttccaggggagtgaatggttctgtctcactggggtttcaggcaccactggtgtacaaaaaaaaatcaactcttgcaactagctcggtgtctccccgaacagctggctagttttgtgcttgaaacccagggccctggtggtgtaggcacacaagggaatctcctgatctgcagattgcaaaaactgtgggaaaagcgtagtaaccgggcgagtagcatagttcttcacggcttcccttggctgggggagggaggtccctggctccttgcatttcccaggtgaggcaatgccccaccctgcttctgctcgccctccatgggttgcacccactgcctaactagtcccgatgtgatgaactgggtacctcagttggaaatgcagaaatcgcccaccttctgcattggtctcgctgggagctgcagagcggagctgttcctatttggccatcttggccccgccccttttttaattttaaaaaattttatgtagcgatgaggtctccctattttgccatgctggttttgaactcctgggctcaagtgatccttccacttggcctcccagagtgctaagattacaggcgtgagccaccatgcccaaccaaatttgtattttctcgatgagcagtgatgctgagcacctgttcatatctctgttggccatttgtatattctttctcgcctaacagctcccttgaaaatgcgtgtgcctcagtctatgtcttctggagaactggcacagcttcagaatattagcaccccaaaagagtattttacttagagcataagaagactaaaaataaatcattattatatgtggatgaggtttttcataaaatataactgttaatatattcttggttaaaatgcatgtgtgcttttcttctttaggttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaacaggaggtgtgagccagcaatcagatggagattctagtgctcatgaaagtttgaagaacactggtaatgtgtggagtatcttggtgtattttgctactgttgatatggattgcttatgttatataaacgattttcattaa

SEQ ID NO: 1401 - DNA, 15764 bp, Homo sapiens
caagttactaaggttctttagtaacatctcacagtagagggtatgagaggcccctgaattgtcttaggaattttcttcagtgagcatttgcgaagactcggatgaaggttaggttaaacttttgtcatgggtccattggcaggctagtcacaagtgcctcctggatctttgggtcctggcggaaaacgatgccagactctcaaattgccacaaggtagcctggaaagaacgccacagtccagaaggagcctcgaaagtggtttcatgaggtggaatttactcctggtgaagatgctgtgaacgctgtttaaactacaacagaggatttacaatattgacgcacgtagttaagaaagcagtggcagggtttgagaggattggctccaattttgaaagaagttctattatgggtaaaatgctatcaaacaacatctcatgttccagagaaatctttcgtggaaggaagcgtcagttaatgtggtaaatttcattgttgttttaacaaattgttacaaccacttcaatatttagcaaccaccacccttatcagccagcagccaatgacattgaggcaagactcctcaccagcaaaaaagattacgactccctgaaggctaagatcattattagtatttttagcaataaagtatttttatataatttctttttaaaaaataatggagcttcaaataagggcatcaggtattttttcttttaatagatggggttttgccatgttgtccaggctgagctcaagcaatccacctgcctcggcctcccaaagtgctgggattacaggcgtgagtcaccccacccagccagcatcaagtgttttaaaattaaagtatgtgccttgtttcctagacataacaccattttacactttattagactacagtgtagtgtagtgtaaatgtaacttttttttttgagagggagtctcgctcggccacccaggctggagtgcagtggcgcgatcttggctcactgcaagctccgcctcccaggttcacgccattctcctgcctcagcctcccgagtagctgggactacaggcacctgctaccatgcccggctaattttttgtaatttttttttttagtagagacggggtttctccacgttagccaggatggtctcgatctcctgacctcgcgatctgcccgcctccgcctcccaaagtgctggtattacaggcatgagccaccgcgcccggccataacttctttttttaaatagagacaggatctccctatattgcccaggttgacctcacaactcctggtctcaagtgatcctcccccttccatgtcctaaagtactgggattataggcatgagccaccacacccagccaatgtaactttatattcacaaggaaacaaaaccatttttgtgactcactttatagcaatatttgctttattgtggtgggctgcaacccaatccacaatatctttgaggtatggctgtactttctaagtgtttcctgagtcagcctactttttctccattttttggtcattattctatccggttttttttttgttttgttttgttgttgtttggaaacaagaacttgctgtgtcgcccaggctggagtgcagtagcacgatcatagctcactgcagcctcaccatccctgtgttcaaaccattctcctgcctcaggctcctaagttgctgagactacagatgcacactaccacacctggctcatttttaaaaaattgtttgtagagatggggtctcatcatgttgcccaggttgatctggaactcctggcctcaagcaatccttccgcctcagccttctgagtagccctgatcaatccattgttgaagaatacatggatgttactttgcagtctgtcatcctgaatttgtgttcacttgacattgcctaattattagtttcagcttacccactttttgtcactaacacgcagaagagactgtggccttcttactgtatcatatcaggaagcatctcacattggtttgtgccattactggtgcagtgactttcagccacttggttaaggtggagttggccatatttctctgctgcaaaattactgattttccttttgtaattaataagtgtgtgtgagtagattcttttgagatgaagtatatatcttgttcttccttgaacttaaaggtttttttttaagtgaaagcaaatttgttaagaaagtaaaggaataaaagaacggctactccataggcagagcagtgtcactttaaggttatgacgtcaagtgatttttgtacaaatcaataattactgtgatgattgaaaaaagattattaccaagtttattttcattgtctcaaggtcttctgaactctggatctaggctgtgtcaacagggtagtgtggtaccccctgtacccgtctctgcctcctacagtccttttcatttattttgtttttttataatagaggcagagtcttgctatatgttgtccaggctggtttcaaactcctgagctcaagcaatcttcctgccttggcctcccaaagtagtgggattacaagtgtgacccaccacatctggccaagtcctttaccatcttcagaaggcttagcttgcagtttcagcagaaggatagactcccaggaagaccgtgagacagatttggggtccagttgatattatcaagtacactgaatttgactgtgttcaccacgttctggctccagagaaatgagagtcactagtgaagttggtgccattttgtgtatcttctgcacctaaggaggaaaaaagatagaggaaagaatgtaagagatcagcttatattcacaaacatggacgtcagccttttcccaccttttctttttttttttttttagacggagtctcactttgtcgcccaggctggagtgcggtggcgcgatctcggctcactgcaagctccgcctcccgggttcacgccatgctcctgcctcagcctcccgagtagctgggactacaggcgcccgccaccacgctcggctaattgtttgtatttttagtagagacggggtttcaccgtgttagccaggatggtctcgatctcctgacctcgtgatccgcccacctcggcctcccaaagtgctgggattacaggcgtgagcctccatgcccagcccccaccttttcaatccaatatggaacctactacctcctgggaaagccatgcccccgctgcccctggcagaccacacctgaggattcattcctcctctcactcaatcacaccttcaacagaagtgtattgagcgtttcctttgtaccaggcactggggatacaacagtgaatttgtatccatggggttgctggaatccagttggaaagtgggcagtggattcttcagaaggttcataggcctgggaagagtctttggggactgtgagcaaccccatggtaccgtggagcacttgagtggggatatcctccacctcccaggaggagctgtcggctccaccatgacgaagcactggacatccaagggctccgcttgtgaaccacattggaaacaacaggctagttaccttgcagtccctcaggaatcttgccctgctcttcttgttctaaggacgccacaggttccctttttctctggagaagtaatctagatcttcgattttggaaccaaatctaagtggtaagacaaagaaacttaatttaaacaaagaatgttgtgtaaaactcatgattgctttcttctcttttttcttttctgttttttgagacagcggtctctctcagagtagctagtgccacagctgtgcatcatcaccttaggctaacttttaaactttttgtagagacgaggtttcaccacgtggcccaggctgatcttgaacttctgagcacaaccaatcctcccaagtagctgggactagaggcacacttgactgtgcccaacccaagatagatagatagatagatagatagatacttttttttttaatacggagtctcactcggtcacccaggctggagtgcagtggcacaatcttggctcactgcaacctccacctcccaggttcaagcaattctcctgcctcagcctcccaagcagctgggattataggcgccaaccaccatacccggctaatttttgtatttttagtagagatggaatttcaccatattggccaggctggtcttgaactcccgacctcaggtgatccacccacctcagcctcccaaagtgctggcattacaggcgtgagccaccgtgcccggcccaacattattaacattttatgacatttgtgagagtctataaggcctaaagagaacacccaaaattctgaaactcacacccagtccctttgtgataggttttagatcctgaaagttcacaggtccacctcattacaataccggtgtttctctaaagtgacatgctacattgcagctcttccttctgcctgaaatttttttttctatctctttttcttcccctcagaaatgcccattttacttccaattcccagaatagagaatgtctaggaaaacattcttcatcccacaagacaaacttaatttctgttccttctttgtgcccatagattatacacataggcatgtaaaacttatgcatatatactcacataatttgaaatagcagttcatatatacttgtacgcacacactcacaaaaatccctcaccttccagcagctactatatttttgagacaaaatctcactctatcgcccaggctagagggcagtggtgcgatcacagttcactgcagcctcaacctcctgggctcaagtgatgctcctgcctcagcctctcgcgtaactgggaccacagccatgtgccagcacacccagctaacttttaatttttttcatagagttgtggtctccctgttcctcctgcctcagcctctaaaactgctgggattccagacatgagccgccgtaactggccacaactctttttattttgagacagagtttcgcccttgttgcccaggctgaattgcagtggcgtgatctcggctcaccgcaacctccgcctcccgggttcaagcaattctcctgcctcagcctccggagtagctgggattataagcatgcaccaccatgcccagctaaatttttgtatttttagtagagacggggtttctccatgttggtcaggctggtctcgaactcccgacctcaggtgatccacccgccttggcctcccaaagtgctgagattacaggtgtgagccactgtgcccagccacaactcttaatagtgtgaaaatggcagttaagtttcaacattggttttggaggagacaaacattcaaaccatagcaatcactacctagtacagtacctagcacatagtagatgctccgaataatgcaaaatgaaagaaggacagaatgaaaaatgaacacgagacgaggaaagtaaaacgaaagaaccatcagaactactaatgtgcattcatgtcctgcttacaggagggagcactggtttaaacgcacacacaccctacacagcagtctgacaattttattccatttcaagatgtgtcaggaatgaatcctcggacagactggtacatttctctgagctaaatgttaaatgtctaaagtggacctcataattttttttttcaagacggagtcttgctctgtcacccaggctggagtgcagtggtgcaatctctactcactgcaacctccacctcccagattcaagtgattctcctccctcagcctgccaagtagctgggacaacaggcatgagccaccgtgcccggttaatttttgtatttttgtagagatggggtttcaccatgttggccgggctggtcttcaactcctgacctcaggtgatctgcccacctcagcctcccaaagtgctggcattacagacgtgagccaccgcacccagcctggacctcataactctaacctcagggcataattagaagatctgaaggatacagtagacataaagacttcagtcaaataggccgggcacggtggctcagccctgtaatcccagcactttgggaagccaaggagggtggatcacctgaggccaggagttcaagatcagactgggcaacatggcgaaaccctgtctctactaaaaatacaaaaaatattagccaggcgtggtggcacacacctgtaatcctagctactcaggcagctgaagcacaaaaaccgcttgaacctaggaggtcgaggtggcagtgaggcaagatttcgccgctgcactccagcctgggtaatagagtgagaccccatctcagaaaaaaaaaaaaggctttagccaaatgcctggcttatatgcaatgttaactaatattcactcactcaacaacttctcattgggtgtcacgtgccacgcactgttcagggcccaaggaatacaacattgctcaagacagacagaaaataccagaaggggatgtgagattgagtcctgtgggcacctgggggtagaagccagcagacagggaacagctgtgaaagaccctgaaatgtgcccagcatgatgaggaactgcctgaggcccatgtggcttcccttcctgtatacctagatccctaggagatgggacaaccaccttcttatcactcacttggactcttgactctggaacaccgatttctttagcaagttcttctctggaatcaatcccaggatatgggtttttcataaatgccttgatgagagtgtgtaactgagaggcgctgtaggtggtacgacaccgtctggcttctctacctagggaaggcatggaaagatggaggggggcggtcaaggaatattgcaagggtccattcacatattcaaacacagaacccaaacttgtcactctccctccaatttcgatcccactgactcctcctgagaggatcttgtcccaggttccttccaggtggaaggttctagaggagacccaggatgatatgtctgggcttctggactccagtagaaagaaagtaggcaagaggccgggcgcggtggctcacgcctgtaatgccggcactttaagagactgagagggggcagatcacaaggtcaggagttcaagaccagcctgaccaatatggcgaaacctcgtctctactaaaagtacaaaaattagctgggcatagtggcgcgcacctgtaaatcccagctacttgggaggctgaggcggaagaattgcttgaacctgggaggcagaggttgtagtgagccaagatcaagccactgcactccagcctgggtgacagagtgagactccatctcaataaataaataagaaagcctgggaagagggcaggggagaacttctagggtacgatgaaccctttgccaccataagaccctgaacaggaggtcatcagggaggagacattcttttttcaaagtcgcagttggctccgccgtagagaagctctgctggggaacagaactaagagggttatttactttgaaactccacaccaggttgatcttgcccctggctctggcttgattctaaagtctcagcttctggtcttttctggaatccgtgcctagctcttcgattctgaaaccaaatctaagtgaggaaaagaaaaggagagaattacgtgttaatgtcatttaagctacatcactgcctgttcccaaagtgagcaattcttattgggcctaggcccaggattattacttacttctgtcacattctaccaagtccttttttttcttttttgagatagagtctcactttgtggcccaggctggagtgcagtggcgtgatctcggctcactgcaacctccacctcctgagttcaagtattctcctggctcagactcccaaggagctgggattataggtgtgtgccatcatgcctggctaatttttgtattttcagtagagatggggtttctccatgttggtcaggctggtctagaactcctgacctcaggtgatccacccacctcggcttcccaaagtgctgggattataagcatgacctaccacgcccagcccatctaccaactctttggtcaagacttggcattcacacccagggcaacattgtgtgacaccataatctctactaaaaacaaaaaagttaaaaaaaaaaaaaattagccggccaggtgcagtggctcatgcctgtaatcccagcactttgggaagccgaagcaggcagatcacgaggtcaggagttcaagaccagcctggccaacatagtgaacctcagtctttactaaaaatacaaaacaaaattagctgatcatggcggcaggcgcctgtagtcccagctacttgggaggctgaggcagaagaatcacttgaacttgggaggcgggggtttcagcaagccaagatcacaccactgcactccagcttggacgacacagcgagactctgtctcaaaattaaaaaaaattagctgtggtggcacatgcctatagtcccagctatctgggaagctgagggagggttgcttgagaccgggatttcaaggcttcggtgagccttgattgtgcccctgcactccagcctgggtgagacagtgagaccctgactcaaaaagatgaaaacaaaaataaaaataaaagattgggcattcagcatcttcacaatctgctgccaacatgatttgctctaattattaatatttaattggtaaatagctgctacaattattacatgtttaaaagccagctcaagtatctccttctctgaaggtacgcctacacgtgttctctcacctcctgtgagctcgctcatcctcagtatccacatctgtgaagtgaggctaagaccaacaccttcgtgggtttattgagggtcagttgagatactccctaccaagccctcagcacatgggtacatagtatgggctccgttaatggttctctctcctgcctttttacttccagtcctggagatattgaactttaacttacctggattctggactcttctgtattgatttctaaagcaagtttttgtttggtagcataacctgggtaaggcttttgattgaaggtattgatgaggattttcaactgttcttctgtgaattttgtgcgacagcgcctatgatttgtttttaccatctctgtaggaagattacaaaagaagaagcatgtaataggttaatttatatactcaaacttcaggttcaagctagtctctcacttcctcttcccaaatccactggaatccactccaggagaactaccctcatacaagtatggagctcttgaacacacaatggcgatttttcaacttctttagctcatctgaatgccatactaagaagtcagggatcctctgttttgaaaaaccattaaaaaccattgtgagccgggcatggtggttgacgcctgtaatcccagcactttaggaggtcaaggtggtcagatcatgaggtcaggagttcgagaccagcctggccaacatgatgaaactccatctgtactaaaaatacaaaaaattagccagtcgtggtggcgtgtgcctgtaatcccagctactcaggaggtggaggcagcaaaatcgcttgaacctgggaggcggaggttgcagtgagccgagatcgtgccattgcactccagcctgggtaacagagtgagactctatctcaaaaaaaaaaaaaaaaaaactgggcgcggtggctcacacctgtaatcccagcactttgggaggccgaggcgggcggatcacaaggtcaggagatcgagaccatcctggctaacatgatgaaaccccgtctctactaaaaatacaaaaaattagccgggcgcagtggcgggcacctgtagtcccagctactccggaggctgaggcaggagaatggcgtgaacccgggaggcggagcttgcagtgagccgagattgcgccactgcactccagcctgggtgacagagcgagactccgtctcaaaaaaaaaacaaaatgaagtaaaataaaaaataaataaaaataagaatatgtatgtcatgaaaatgccaataattttttttaaaaaacaatgtgttctgttcatatggattagaaacaatctaagtcaagaatgcatgcaatatgtcattgtagtgatgaaaccatagaaacgaagagtttgtgatacaaggaccatttcaacccctttcagtttttcaggtcaaaattccttggtattttatttttattggcatatattttatttttattatttttattttttcaggcaggatctcactctgttgcccaggatggagtgcagtggcgcaatcatggcacactgcagctttcacctccacaggctcaggtgatcctcctacctcagcctcctgagtagctgggactacaggtgcacacccccacacccagctaatttttctactttttgatagagtttcgccacgttgtccaggctggtctcaaactcctgggctcaaaagcgattccccagccttggcctcccaaagtgctgagattacagatatgagccaccacccctggccggagcatattttttttactttgacctccattgctcaatagcaataacaggcaaacagtaacagtttccaaggtatttttaaaaacaccacagggaggacaaaattagctggaaaaagaatttcatactttcagtggaattttccaataggaaaaaaaataccacatcacataatttgctggataggacatctccttgaaataaccaaatctggaaagcattttggaagataccatttcgtaacagaattagacttagtgaattgagataagaagaaaatttactagagatgctagaagttcagttaaaagaccaacagcttttttgtttgatctttgaatgcttgcccttgtcttcagtttcacacacctggtccattgttttgttttttgttttttgttttttgagatggagtttcactcttgttgcccaggctggagtgcaatggtgcagtctcggctcactgcaacctccacctcccagattcaagtgattctcctgcctcagcctccaaagtagctggggttacaggcacgtgccgccacgcctggctaattttttgtatttttagtagagacagggtttcaccacgttggccagactggtctcgaactcctgacctcctgatccacccaccttggcctaccacattgctgggattacgggtgtgagccactgcacctggcccctggtccactgtatttcactgaagggggaagtttcaacttttacaagctcaatgaattggctcatacaatccacctttgacattacccatcattcctcttgaaccttgacctcatcatacgcgacattccataccttgacctcatctccttgacctcatcatacgcgacattccacttggctttatatgttgcaatgtgtactcctgccatgatatctaacttccatctgacccccaacccggccaacttcttccttctccagagttttcacttgctcctccgtctacccacaaggctcttcacacgatgatggatgagatcaccttgctcaggtctcagcttgcacaccatcttctcagagtccctccctgaccctccggtctaaggcagtccacaccccatgctatgacctctcactttaccaccatgcttagctaagtttttgatgttttgtagagatggcctttccctaggttgcccaggctgtatgagactcctggcctccccatacaatcctcccacctcagccacccaaagtgctggaattacaggaaagagtcacatcctctctcttttttttttctttgagacagagtctcactctgttccccaggctagagttcagtggcacaatatcggctcactgcagcctcagtctcctgggttcaagtgattcccctgcctcagactcctgagtagctgggattacaggcacctgccaccatgcctggctaatttttgtatttttagtggagacgtggttttgccacgtaggccaggctggtctggatgatccacccacctcagcctcccaaagtgctgggattacaggtgtgagccaccatgcctggccaatttcttaaacttgtttaaagggtagttgtcacatggagtctgaaaacatatcaatgaacttttcttactgcgttatattaaaatacatttttgtcttacatttttttcaagtttccaacccattatcttacattttgaatggctcttttacctatcgatgattttgtagcctcttgcattgatcatttaaaataacagtttagactgggcgtaggtggctcacacctataatcccatcaccttgagaggccaggacaggtgggttccttgagtccaggagttcaagactatcctgggcaacatagtgagacaccatctaactcattctacaaggccagtattactctgatactcaaaagcaggcaaatagacacatcgaaaaaggacaatatccctaatgaacactgatgcaaaaatcctcaacaaaatactagcaaactgaattcaacagtaaaaagataattcctcatgaccacatgggatttatcccacggatgcaaggatgcctctgtaccccatacatatatacacttactatgcacccacaaaaattcaaaatcattggccgggcacagtggctcacgcctataatcccagcactttgggaggccgaagcaggcagatcacctgaggtcaggagttcgagaccagcctgaccaacttggagaaaccccgtctctactaaaaatacaaaattagccaggcatggtggtgcatacctgtaatcccagcaacttgggaggctgaggcgagagaatcgcttgaacccgggaggcagaggttgcagtgagccgagattgcaccattgcactccagcctgggcaacaggagtgaaactccgtctcaaaaaaataaaattaaaaataatttttttaaaaaaggctagatgactgtaggattttggtggaaacaaaaattttttttaagataaaaaatatttcaaaataataaaaatgtgaaaggctagttttatgctagcaattcaaataattacatacatccttcttttccagacaagcatcctattccagtatgaagcacagggtttgatgcatatgtccctttgtgttacacaggatattaaaaaggtgtaatcaagggttaaagtttaataaaatcaataattgttactgcttaaggacattcctaagtgaaaccactttttgttcttgcactgaaagtatgagggtaaccacagtaactaccagtacaatttggttatactggtttgatgtcctctgaggtaccagcagatttacccatcattgtttttgtatcatcagtgcaaaagaaaaatgtcttagtataattaggaaaattgtgtcaaccttacagttcctggaaagggctctggagctccacaggccatactttgaaaacaagtgccctaaaataaatcttctattcttccgtatatttgtaagtaacaccacccctttcaaaagaccacttcataagatttacatagacctgccctgataccttgagaaattgatcctctctgcttttgtaattaacctcagaaagccactcctaaatccattttgcttttcctcaacttctacatttctggagtaggaaaaaaaaaaaaaaaatatatatatatatatatatgtatatatatatattcattcttttgactgaattctaatttctaacactttaccttctccacacaacaaacattcacttccagaaatggctaggtaagtcctagtagaattaaccagaatattttcatctaatttttcaagtgttaaaaaattattaacgcctattaaaagccagaccctggccgggcacggtggctcacgcctgtaatcccagcactttgggaggccgaggcgggcagatcacgatgtcaggagatcgagaccatcctggctaacacagtgaaaccccgtctctactaaaaatgcaaaaaattagccaggcgtggtggcgggcgtctgtagtcccagctactcgggaggctgaggcaggagaatggcatgaacccgggaggcagagcttgcagtgagccgagatcgcgccactgcactccagcctgggcgagagagtgagactcctctcaaaaaaaaaaaaaaaaaagccagaccctattctaggcaccataaacaaaacagttaagatatccttgatctttaaggagctgaaagatatcaagcaaacaagcaaaagatgtagtgtatcagatgatgagtatttccacggcaaagaagactcaagtggcaagagtagagagtgcaggggtgaggtcacagttctaagtgcaatagttagggatgggctcactgagaaagtataacatgaacaaaggcttgaggcacattagagagtgagtaatgctgacgtttgagagacattgcaggaggtggggagaggccctgggctgggacgctgcctgtcctatttgacataaggcaaggaggccagaacatctgaaaaaaaagaataaaagggaagcagacgaggtcacagaccataccaagcgccacgttatctagggcacgatagggccaagtgcctttttgttgaaggttttgagcagataagtgacataatttaatttatgtatgtatgtatgtatgtatttttgagatggagtctcgctctctggcccaggctgaggtacatggcatgatcacggctcactgcaacattcacctcttgggttcaagcaattctcctgcctcagcctcccgagtagctgggactacaggcgcccaccaccacgcctggttaatttttgtatttttagtagagacagggtttcaccatgttagccaggctggtcttgaactcctgacctcgtgatctgcccaccgcggcctcccaaagtgctgggattacaggcgtgagccacggcgcccggccgccataatttaattaacagtttaacaacatcacatgaggtacagcgttgagaataggttggtggaagcagggagatcagttaggagaagactgcaataatctcatgcaatgggccaataatctaatgagatggaccaagaaatggtcagattccttaaatatttgaatgttaaagccatcagaatgtccagcctgactgtgttatgggggaaaaaatggagtcaggggtgttttctagatatgaggcatgacctggcacctcctgagctggagaaaacagtgcgaggaatagtttagatatgaacatagggaattcagtttttggaacacattgagtctgagatgcctgttagagacaagcaggcaattagatgaagtccaaagttcaggagaaaagttcaaacattctgtagagagaaatcaggaaagtgctttccagatctggaatccttgattccaaggatattttgagctctgaactttgtgatgtgtcccatagttgctctgttttagcatctgtctccctctcctttttttcttttccactccttcctcctctcttccttcctgaagctcaaatatgtcttatttagttcttgaatatctgtacctttctgaaattcccaatgctcaaatgcactgaaaacagcctattttcataatatcacatcagagaaaccggttttcccctatccagatacagttaaagtttaaaaatggaactctcacaacttctgacaagaccactgggtttttagccctactttttccccaaaccaacaaaagctcagtcaagcacaagggaacttactgtgtgaataggtgtcttcggccatgctggaagagagtcctgaaggctgagccactgtctgggagacaag

SEQ ID NO: 1402 - DNA, 22055 bp, Homo sapiens
ctggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcaggtgagtggacaaggtttcggccttgctgcttttctgctagttcggggaagcctcctgggcaggccggaagccaagacagccacaggattcctctttgtagttttgtttgtttacgaaacgtggagcaggctcgtcacttagtttatctcctgtcgtggtagtacctgagagactgaatattgaagcggacagtaggcagactatacatcgattatagggctgtgacgtacaatttttttgtagcaacctgcccaggaaaccagcctcctgttctgcaataaactactctggaagccagtctgccttaagttagtcttgcaaggagctagattactctctggtgacatttcaggaggctaaacggtaactcctggaacagtaggccccaaataggacttgatttgtaactgactgttctaatttttgcctccgcctccaaaagaggaccaagcagagaaagccatacgtgctcagcctaaccaatcacatacgatgccccacttctagttagcccttctgcagctttccactgctaaagtgtcaggcctctgaaagctgcttaataattgcttgaaggatggatgaagttccactccagggactcccgtcacacacatcatccgaactcagccttggcctgcaagtccctacccggtccactatggctgaccacctctgtccttgtttccttcctttcctccctggctcagcgcttcagacacaggtccactatggctgaccacctctgtccttgtttccttcctttcctccctggctcagcccttcagacatatcaatctgatcacgcagagttctttcctacccctcagccttcacctttacagttcattcagcctcagacactatcctcagatctctgcaagaccctttcacatcttgttggctctgctcaaatgtcacttctttaaagcggcctttcatggcagttcagactaaagtagtccccttctcacctgcccttggtctagcgtttttgtatagagaatctggcaaagttttagacacctactgagttgaggtcttaaaggattttgtggggacaaagagcataaataataacacaagaactgtaacggttggccttcattgagtccttgatgtgaactgagaaatgggcattatttatcatctcatttaatcctgatctccttaaagtgacattctattataaacactgctgtacacaagaggaggtcaagactccgacctgtttagttacctgctgaaagtcacatagcacttaagtaacaaactcatatttagcgtgtggaccaccagagcctttgtttttacagacagttggctgagaagccctgaggtgaactttgcagtctttccagcaagtcacagtggccattggaagcgaaaggcagacattccactagagaggactgtgtagacaaaggcaaagtgtgttggttgtttaaggaggtccaagaggacttatgaggttaccatggttccccccatccccacctgctgagacatggcctggaagggcaaaatcctgtggtcttttgttggatgttcgtcctgccttcagcctatagggcattttggccagtcataagcctgggttctcatgaccacagcctgcattatcttcagccacttgagttttctggtcctgaagcacactggccttagggatacctgctggcaggactcagggaaggaaaaggctaatggttcattatgcaatctccctggggtccaggggagaggatgagctggtccaggcactgcccctcgtcaggcatttggtacttgtgaatttggtgatgagggttttgcccacatcttggggatattttcaggagctgctaaaatagattaaatagcaaaaatatgtagaaatgcttcacaactgtattatagtagattcacgtgggtggtggaggattattggggtcacagtattaaaccctgaagcagagggacctgggttaaaatcctgtctcttatatataaatcatgcttataacatgtaaaactctggctgaacttggtgctcacacctgtagccccagtgctgtgggaggctgaggtgagaggatcacttgaggctaggagttcgagaccagcctgggcaacatagcaagatcccagctctaccaaaaagaaatagttgggcgcagtggtgcgttcctgtagtcccagctacttgggcggctaaggcagaaggattgcttgagcccaggagttcaaggttacagtgaactctgagcatgccattacactccagtctgggtaatagagtgagaccctgtctctgaaacaaacaaacagaaaacacaaaagactaggagaatctgtggagctcccttagcctcaggtcagtgactgtgacatggaggtgattggcggtggtgtttagtaatacttcaggggctgtgggaggattaataaaatcccaaagtccagtaagctctgaataactcatgtctgttattgggaaaatgggaattctgtattcatctgaaaattgaggcagagataaatgaggtccctgaggtcacaaaactggcaagtgtcagtttcaggagtttggattcaaacttgagaagtctgacttcagagtttgggacttgtagttgctttaaaacagaacatgaagcttcagcatgagctggaccagtgaggctcaggcactgtggttgtcaacattattgctattattattgtcactatttcctcatttctttgaggtcctcgaactctaattgtctacatctcgccatccacgagttattgccattgtcttctgttattctttgatggctcctatataggaggcttttctcttttacattacagtaatctgtccaaagcaatgtctgccttcctccttcagcctggtacaaagttaggccctcaggaggccctcagtgacttgggccttgatcttgttgcaccttttccagcaaagcacatgcaatagtcccacagcaaactctactacctctatttgacatttcaggtgtctgtgacctttgatgatgtggctgtgactttcacccaggaggagtggggccagctggacctagctcagcggaccctgtaccaggaggtgatgctggaaaactgtgggctcctggtatctctgggtaaggccttccccctccaccatgcaggggatctgccacctccttcgttccaccctctgactccaggcctgatgggtcaagaagtcctctcttactggccttgcctccttcccacaaattcagtcattttctacaacactcacctcttccttttttttttttttttttttttgagagggagtcttactctgtcacccaggctggatgcattagcacgaactcgggtcactgcaacctccgcctcccaggttcaagcgattcttctgcctcagcctcccaagtagctgggaagctgggattacaggtgcccaccaccatgcctggctaatttttgtattttcagtagagatggggtttcaccatgctggccaggctggtctcaaactcctgacctcaggtgatccgcccgcctcggtctcccaaagtgctgggattacaggtgtgagccaccacgcctggcctacactcacctcttcctatacagtctccatgcatcgctttggacaagaaataagagtactctttggctctcagccaaaggagagaagctggtggaaggaaatggggtgttttgcagacctcaaaggtaggattgccagctgtatgttatgaggggttgaagtaggaactgagaaccgccacgatggggtcctggtttctctgtctgggtctgctcatgtcactgtctactctgtatggttttttctgcctcagcgagttcaggggaagagtaaccaccccaggttttactgtttgtgacccctccttcccctccagatttcttgtctgtttctctggcctctgtggggcgtgtttgaggcagcaaatgctgctccacctccagctcatacttgcctccatctctcacccactgcccagcatagactggcctctgtctgcagttttttttttgagttccagagcgggatctgcctgggtgggcctggttgctcatgtatctgctccacagcccagtctgtggtgtaagggttggtgggatgttcactaagaagggttgagtcaggcaggccccaaggagacattgaccttccgtcccaccaggtgttattctaaacaaccttcacgtccttcaatcaccttcacatcctctgattctaaagtcactctgctgcagccttgctgggcttcttgctatttccccaagtgcccacccacctcaggccattgcatttgctgttctctttgatgagtgttctcagggtaattcagcatttcacatggccgccccttctcagcaccacttgcctcctcacccagcccttccctgaccaccgaatcttggggaggcccctttctcaccatagcctcctccctttacctttttaatgtctttctaagctagtgtttctcaaacagggacgatgttgagcttcagtggacactgggcaatgtgtggagacattttggttgttaaaactaagatgatgggccaggtgcgatagctcatgcctgtaatcccagcactttgggaggccgagatgggcggatcacaaggtcaggagatagagaccatcctggctaacacggtgcaaccctgtctctactaaaaatacaaaaaattagccgggcgtggtggcgggtgcctgtagtcccagctactcgggaggctgaggcaggagaatggcgtgaacccaggaggcggagcttgcagtgagctgagattgcaccactgcactccagcctgggcgacagagcgagactccatctcaaaaaaaaaaaaaacctaagatgataacattgacagctagtgggtggagatgctgctaaacatccttataatgcacaggacagatcctttctcctcctcttcccccgatctcacaaacaaagaattacctggacctaaatgtcaattgtgctaaggcgagaagctctttttcagagagtgcttggacagacactacatcagctggtgctgagagacacttgaggaagttgttcttttatttcttctcgtcttgtctccttagcatttgaggaaaactctggtttagtgctgagacttaacgtcctgcaaactgttggtaatttccccttttctacagagggagcagccttaggctcacagccctgaacaagcagcatgagctcacagggaccaaagagcactgtttgtttgtcttgagacagagtctcgctgttgcctcggctggagtgcagtggtttgatcttggctcactgcaacctgtgcctcctggattcaagcatttctcatgcctcagcctcctgagtagctaggattacaggcaggtgccaccacgcccagctaatttttgtatacgttgttttgatttattgctacattttcatggttacctgccatcaagacaagtgactctggattttccatttaccagagtgataaggattccatttttgaagaaatctaagaaaaataaaaagtggatcacttttaagaaaagcagcccgggcatggtggctcatgcctgcaatctcagcactttgggagggcaaggcaggcagatcacgaggtcagttgatagcgaccatcctggccaacatggtgaaaccccgtctgtactaaatatacaaaaattagctgggtgtggtagcgcatgcctgtaatcccagctactcaggaggtggaggcaggagaatcacttgaaccagggagttggaggttgcagtgagctgagatcgcgctactgcactccagcctgatgacagagcgagacttcgtctcaaaaaaaaaaaaaaaaaaagaaaagcagttaacagtccagatccccagagcactgattgggtgtctcaggcctgttccaggcagtgttcatgctccatttattctcacaggatccctgtcctcagcaaagtaaggaaaatttagccactcctgtgagtccctcatccagtttaacttactcagcacagatgaaacaccttcattttatgaagctatcactgaatgtttttgtgtagaaaaaattcttctcttgtgaacttttttttttttttttgagatggagtttcactcttgtctcccagactggagtgcagtggtgcaagatcatagctcactgcgatcctcacaccttaccgtctccagtagctgggactacagatgcgagccactgcgctgctatatgaagtttctgtaaatatccttatgtcaccatatcacagtaggatgttcagtctttaaatattttaatggttcgtgaaatgctggggtctggagtcactgacctgcccctcatcctggccgctggtccctgaggatgaatcctccagctcacatctctgcctcgtcaccaccctctgccacccactctggtgctcgtggtttcctccttactgtatttcttgggagagtagggtttgaagccagaacgctggtgtccagccccagctctgctctttaaaaactccatggccttgggcaagttactgaacttgcctgtgcctcagtgttctcattgttcaaatgaggacttaaccatattcgcatcccagggctgttgccagggtcaagggttattttatgaaaaggctcagaacagcacctgggagaccaggctgcgtgcagggagccattacaatctctgtttccaccagtactattaccgtcgtcctcatcatgattattgtcgttggcatgccttgacctggcactttctgggcagcgttgtggagctttgtggttaaacagcacagacagagatggcaggacctgggtttccttattgactcagccattctccagttctgtgctcttcagcaaatcactttacctccccgagcctgggtttctttgtcaacaaaatggtgttgattatgatatggacttcctgggtataccgtgaggaaatcctcaactggaatcctcatttaatggctaggcatggtggctcacgcctgtaatcctagcactctgggaggcctaggcgggtggatcacctgaggtcaggaattcaggactagcctggccatcatagtgaaacctcatttttactaaaaatacaaaaaaattagccaggcatgatggcacgcgcctttagtcccagctactcaggaggctgagtgagcggagatcgcgccactgcactccagcctgggcaacagacgcatttagtctttggtttagaggaagagcattataaaacattgcttaggatgttaaaaaaaaaaaaaaaagacttagataagtgaagatacataccttgttctgaatgaaaataatcaatgtttaatatttaaagtgtatcactttttctctaagatattccataaatattgttcactttttaatgcatttaaatgcttggcatagtcccctggacatggttatagcctataaatactagtttttgacttactattaggagtagagattctgtggcagcatgacatgccctgcccttggtttctagatcacgtgctaactttttgttcccatggatgggtgtagcttcattccaaggtctggtccccatcctgaagtcccagactagattgaaggtctttatttcttttcacccacatccatgtgtccacttgctttctccataaacagggtgtcctgttcccagacctgagctgatctaccacctagagcatgggcaggagccatggaccaggaaggaagacctctcccaaggcacctgtccaggtaggagccaagatctgggcaggtcggagtccctgctggcttgagacttcgaggagaccactggccctgggatctcttgggaagcttctcactgtggcttctctaagggtttgggagccttggagccctttaacctgtggtttctccgtcctcccagccccatcgcacttgtcgccactcctggggaggagtgaggtgtgtgaactgagactggtcctggggctgcagccttgtgtgccggaaccctggttagccagtcatctactctgtgaccccagtgaagtttgtatatgagtttggctaagttaataccaactgctgtatccaacaaactccaaaatttaaatgattcacacatgaaaactctttttcactcataccaaggtctgtgtgggtcagcagggaactctgtaccacacagttattcaggacctagagtccttctgtcatcaacctgttgctttaaggttgtcctgacatcttcttgctggtagagaattaagggaataaggaaagtcatacccacttccagacctcccctcacatctcacccatgggaactgggcatttggctgtacttgggtccatgagtctaggaattgtggctgagctgcctgtccaaggagaagagcagatggtctggtgagcacctactcagtccactacactcagtctgttcctgaaaaatgatattagaaattatttttataaaaaacaaaaaagaaaaacattatttttatgccattgggcagtttgaagttgtaatcatgtgatacattaatgcataaaactgcatagtttctgagccatagtaagtgacttatcaaaataagctatgagtgttactcatgtcatataaacattgatgagtgatgatacgttacatttccttctgaactctggggaatagggcctttcttactctcccaatttctctttccacttatattctgcctatcagcctctcccaccttctccttccacccattccctgagtgtcaatcagacactaagaagcagtagtttgcccatgtcttcctatatctcctgttttccaaaaacctcagggtgacatttgaccttctgtgtcccacactcaggctgctgagggcactgaggccatctgtcatgtgtgtggattggtgccactgcagagccttggcctctgcccgcgtgggttccttgagctgctcatccaaccctgagtgtctgtgcagtccctgttcagcccttcagagtctgttccagattgtcccctcctcagtgccacatctgcacttgaaaatctcaaaagcacaaaactcaacatgcctaacaaggaacccatgatcttgctcactcctgccacctcccaagtttccgtgaatggttctgccatccaggcagattaggggactggccccaacctcagacaagtcaacccctccacctccatgagtccctgcatccagcctatctccacagcctttcgatttcacgtcatgcatgcctcctgaattcatccctctatcacctccatgagacctatccttctgcttttttcttttttgagatggagttttgctcttgttgcccaggctggagtgcaatggcgcgatctcggctcaccgcaacctccgcctcccaggttcaagcgtttctcctgcctcagccttccgaatagctgggattataggcatgcaccaccacatccggctaattttgtatttttagtagagatggagtttcaccatgttggtcaggctggtctcgaactcccgacctcaggtgatctgcccgcctcggcctcccaaagtgctgggattacaggcgtgagacaccgggcccggcccccttatggtcttactctaaactcttatcatcttttttctaggggatgttaatagactcccaaaacttaatctctgtatctgctttgtgcctctggtcagctctttgtcctgcgtggggtactccagcattcagaccttgttccagacagttaatatttccccagcaactcagcatatgactgctgatgtattagcaggttttcgtgttgacagtgtcatctacttctattgtttaatcggcagtccttacacattcctctcaacctctcatatcggtagcttctcttttcccctggtggaagaggtcttacccttggccacggccagttttttcaagagtttatattatacgttttcatggacgttttttcttcacttatattccgcttgttttgtaacttcatcctttctgtactcaacataaaaatatgctcaacttccttacccttgaagaaaattcaacaattcagtgttcatggttcacagtgtattcatatattcattcactgtctgagcacttaattgtttacatgtttttatatcagtgatgctgtggacatttatgtatgttgttcatctttcacatgtgtagggacacatttttgatgtttctggagtgaaataattggattatagattatgcaaatgttctagtttgcaagatcattctcattgttttctaaagggcctatatcaaaaaattcctctcaggaatttttggaaggttccattgatccatatcctatctaatacttgaaactataaggcccctcaatttttgccgattaaatggacacaaaatattatctgttgtgctcttgatttgcattttcctcattggtagggtggtttagtgtctttcatgattctgagccaatctatattttcttctgtgagatgttatttggtgataaatgcctttttttcaattaacttctttggctttctctttttgattttatttttgtacattatagatacctatcttttatcagttacatttgctgccggtatattcttctagtttttaattttgtccttccactctttttaaagtatcttttgttcaatgagttccttacatagcgtagtctgatttatgttttttttttacgtgattaatgattttgtaccttgtggaaaaaatgttgctttaccctaatgtcaaaaaggtattcttgtttattttattgtaagttgtaaaacttgccatttggcattcaagtctttatcaatctgaagttgattttgagtatagaatgtgatagaatacaatatttccattccccgtgttggtagccaatttttctagctctaattccttagtagtctctcatcactgaggtgctgtgcctctttgccatctaccaaagccccatctatgtgcaaggggatttctgagctctctgttcttctttattcccagtttgcattatgtctgtgccagagtggtacctctgccttatgagctctgtcctgagagtggcactgctcttcacagctgtcacctaggtcagaatcttgggaatcagtccccctgtgcctcatctttccctagattctcatcaccaccaccctctcatgcactgtagctcatttgcatattctttctcctaaggctatagtgtctttctcacattctctcgtgacaagtgggacttacttcactgggtaccttctattggaaaactgccttgatctttttctacccaggattagccaaactcaagataaggacacagtcctccaggactttgtcaagtctacccaaatcctcttaattccaactgcaaattcagggatttcctgaaaccaaccttaggtttcataacttgctaaaaagactcacaacactttctaaaacctattatactcacagttttgtttattacagacaaagcatacaaattagaagaggacacgggatgtggggctgaaggggttccaaacacaaagcttcctcagtaacttgttacccacccagcattgagtgtaaaatatgtgcacagagcattgcaaacccaggaaactcactggagctctggtttttagagtttgttgagcttcattacacaagcacggttaatcgagacattgcccacattgccatgtgaagtttccagccttcgtcccttttccagagttcagctgatatcttgtggctcagagacctaaccttctactcactggttggtctttctggtgccaccagacctcagccagagtcatctatttaggataaactatttaggtacctataatgagttacctttatataaatatttagtctggaattgaagcgatatctccactctaggccctgtcccctcacctggtctctctgcctggtctccctttcaaggagtcaggaatccaaggaaaataaaagaaacaaattatagatctggggttcaagatggcaaaatataacagacataaaggcaccatttataacttcattttttttactgaagtggtgagtttgtttcttctctttttacattactaacaagcccttctgtgtgttggatttctttcaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgcacattttattgtaccacttaatactgtttaggtctttgattttttaaaaaaattcttttttaatgggttttaaacactaacactgagaatttttcttgattcccatctgttggtttacttgattgctatagctgtatggtaaatctcaaaattaggtaatgtgatttcttttttcttactatttttatttaaaattcatttagcattcctagtttgactttccatatacactttaggattggtttttctgtttttcaaatattcttgcttggattttgatagaaattgagttaaatctatagatcaatgtgttggaaattggcatcttagtcttccaattcatgaacatagcctatcttttcattatttaaattttctttgatatatttcattactgttttatagtttacacagtataactcctgcacatttaaaataagaattatagctgcatagttttttgagtgattgtaaatggcattgatatttaaagtttcaatattcacatgatgttggctagtatacagaaacattattttttcaatcttattttgctgtcttgcaaccttcctaaactcattatttcttgccatttcttttgggagaatccttaggattttaaatatagaaatgtcatttgcaatttgggacagttttatttcttgcttcccatctgtataccttttatttgcttttctcatgttattgtactaggtaggatttccagtgtgatgttgaatacgaatagtgacaagttatccatgccttgttcctgatattagggggaaatgttcagtttctcattattatgatgttgaaagttgcttccaaagagtttctctatcgagtttagaaagtttccctctattcctaatttgctgggatttttttggttattattaataagtgttgaattttgtcatatgctttttctccaccaattgatttaattatgtgatgttacttctatagtcagttgatatgatgtgttaccttgattgagtttcaagtattgaaccagcctcacatctttgtgataagccctacttgatcatggagtataattttgtttgtgtactatgctacagtatttcatttgctagtattttgttgaggaagctttcctctgatttcatgagtgataatctgtagttttctttcttcaactgttactgtttggttttgatgtctagatgataactaacctcctaacatgaattggaaggaattctcttctgtttttttggaagatcatgtgtagaattggtgttatttgttcctttaatgtttggtagctttctccagtgaagaagtgggacctggagattttccttttgaatgctttttaattatgtatttattttatttaataggtatagaactattcagagtatttcatattggatgaatttttatagattttcttaaggaagtgttcattttatgtaaatgttctaatttgtagcattctttgaaatatttccttttatcctcttgatggcagcaggatctgtacttatgttccttgttgtattcttgatattggaaatgtatcacttattattgtcagtctttgtagacatatgtcaatttcattgatcatttcaaagaaatagcactttatatcactgatttttctccagtctctgttcttaatttcactgatatctgctctgatgtgtattgtatcctttctcctacttgctctggttgtatttgactcagtggtttcctgacgtggatgtttaggttattgatttgaggctttttttcttttttaatataagctttaagttctatacatttttcttacactgctgttagtttcatcccacaagtcttaatatgcttttgattatcttactcagttctaagattgcctgattccttttgagacatcttctctaacccaggaattatttagaagtatattgtttaatagtgtttggagtattccctgctatttgttattgatttctaatttgttttgcatttgatgttactgttgaaatttgttgactttttttccttatgacccaggatataggctgtcttgttttacatagctgcttgaaaagaatgtgtgttctcggtcatttggtggagtttctgtaaaagtttgtatgatcctgttagttggtggtgttatttaggtctcctgtatccttgctgattttctgtctagtatttctatcaattgccaagagaaggatgttgaagtcctgagctataattgtggaattacctattcctcctttaagttctatcagtttttgctccacataatttaaagctctgttgtttggtatatacacatgtaggtttgcttagtattcttggtgtattgacccttttataattaagtaatgtccctttttgttcctgttaatactcttatcaatttttatctgatatttgtgtggtcagtcttacgttttggttaatgcttgcatgatttacacttcatcatttttttaaaccttatctatatcactatattgggagtaagtttcttgtgaatggcgtatatttgggctgtggttttatatccagtttgcgtatctttttttttttttttttttttttttgagacggagttttgttcttgttgcccaggctggagtggagtggtgcgatctccgctcactgcaacctccgcctcctgggttcaagtgattctcctgcctcaggctcttgagtagctgggattacaggcatccgccaccatgcctgactgattttttgtatttttagtagagatggagtttcaccatgttggccaggctggtctcgaactcctgacctcaggtgatccacctgcctcagcctcccaaagtgctaggattactggtatgagcaaccacgcacagcattttttttttttttttttttttgagacggagtcttgctctgtcgccctggctggagtgcagtggcgcagtctgcaacctctgcctcccgggttcaagccattctcttgcctcagcctcccaagtagctgggattacaggtgcctgccaccacacctagctaatttttatatttttagtagagacggggtttcatcatgttggtcaggctggtctcaaactcctgacctcaggtgatctgcccacctcagcctcccaaagtgctgggattacaggtatgtgtcactgtgtctggccccagtttgcatatttctgtcttttattggtgtatttagaccatttaaagtttacaataattatgttagtgctatgtctgctattttatgattagttttttgtgtttcctgttgcttctttcttggtttgtttgggtttttttttttttgtctttaacattttttagaattccatttgatatatttgtagtgttttttaaatatatttctttgtatttttgtattaattttttagtggttgctttaagtagtataatgtacatatgtaacataattacagttaatggtatgaaaaatttagcactttgatgtatagaaaccttacttggtcccttcaccttgcctgttaatataattgtctaaagtaattcctcttcaaaattgagcaccatgttggaaaatgtaatttttgcttccactgtcaaatatattttacaaaagtcacaggaagtattgcttgttgatctctttacccattccactattctttcttgaaattctaagccaccttctattaacattttctttctgtttggcgaacttgtgtaaccttttttctagggtcagtctgctggtgtctctaaaagtgtctttatgttcccttcattcctgagggatatttttgtgggataataggatttagggtctgcagttcttttagtacttgagaaacatgtttgttccttctgtccgctatggtttcagatgagaaatctgttgccatttgaaccattgttccctagttcataatgtgccatttttatcaacctgcgttcaaagtgttttgttttttttgtagtgttcagaagtttggttatgaggtgtgtgacatggaatttttttgagtgtatcatgtttggtttttgtttagctttttgatttgtcggtttatgccctttgccaaatttgggaatttttaaccattatttcttgaaatattttttcatccctactctttctcctctctgtgatatgaatggtagagcttttgttactgtctcagaggtctcttgtgctttcatgtttaccccctttttctggtctatttttccctttttttcatattggttaatttctgttgactttttttcagctcactgattctttttttctgccatatgcagtctactgttgagcttgtccaatgagttttcgttttggtttttgtatttttcagttgtttaatttccatttgttttgttttgttttgttttgtttttttgagacagactctttgctctgttgcccaggctggagtgcagtggcgcgatctctgctcactgcaagctctgcctcccgggttcatgccattctcctgcctcagcctcccgagtagctgggactacaggtgcccgccaccatgcccggctaattttttgtatttttagtagagacggggtttcactgtgttagccaggatggtctcgatttcctgatctggtgatccacctgcctcggcctcccgaagtgctgggattacaggtgtgagccactgtgcctggcctccatttggttcttttgtacatctttgatttctttgcttagtttataatactaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttga

SEQ ID NO: 1403 - DNA, 22055 bp, Homo sapiens; identical to SEQ ID NO: 1402

SEQ ID NO: 1404 - DNA, 4541 bp, Homo sapiens
aggaagtacctctctgagcggttggtgccgggtataaaagaaggccgcgcagccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagtgtgagagccagcgccagagaaaggacgcagggaaggctggggactgggccaggggtcgggtgcacagaagacacatgtgttgacatctcccctccctctcctcctccccaacgctcttcttttctccccactccctcccttccctccaattctttctttcacctctccctcccctactctctcctccccttcctttctctctgcctcttcttcacctcctcctcccctccctaccttaccttactctttcttcttccccttacctctccctccccctctccctgccttccccttccctctctttctctcctccccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgtgagtcccttgggattggtatctggaaaaggaaggaaggtgggacgtggggatgaagaacagactgggtgtgtggggtgctggctcctgggaacgagaactactgatagggctgggtctgtgtgagaagggaaagcggcagaggaaggatacaatgaaagaggaaggggagcattggcatccctgactttccctccgcctaccctacctcccaagctgaggcttttttcttcctctcctgtcaggcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacagtaaggacagtctctgcttcctctttcatctttgacgtctgagcccagcattttccccaaatactaaccccaagtaaaccctgcacttgtaccttgaagacttctctgcagttcattccatttacactacctcctaccctgggtcagacactcgaatcctggttcctgttctccgttctcccctcacttgctcccagatagggctgttgttattctggtcccagcataatttgccacttgtgtgaccaggcagtgacggtggcatcatatgataggcctcagggagaaatctgactcttccaacattaatccttcagacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgaggtgcgggtctggaggctctggggtctctgagtttactgtgggctggtgggagctctgtttgtggctgtcaggagggtccgcattgccttctgagaagtttacttctgaatgttattgtgtaaatttaatataatggcacgtatgttctacagctttatccttggataccctaattaacctcattgtatctccagaatattaataagtactgcgtataggtttggattctttggttataagcaacagaatctaactccactgccttatgtaaagaaacatattgaaaggctctgaaggagttcactgaataaatagctagaactggcttagagataggtacaaagagatttctagagggttccggaaagggaaccatggcaatgattttcccaggagcaatggtccaatcagcttgctgtgtcaggatgagtggtcttccatctttcctcctgtttctgtttcacttcctcgggcctcaagtcctgtgagagatcatctgagtggctcaatgtaggttctatgtctggctacttgctgtgctaggacaacagggaggatctgtgtccatgttaccatccatcctataagaccacataaaaaggagaggaaaaccacaccccacacaccagtaactggtgcaatttaaaaggaggaaatggagttactggaccaaaaagattccactgtaatcatacaattcatggtaagtgttccacctcagacggaaattgtggcaggcttcacttccagggtgacttttctttgcacccacagataatagaggagttggcagatgccctgacctactgccatgacaagaaagtgattcacagagatattaagccagagaacctgctgctggggttcaggggtgaggtgaagattgcagattttggctggtctgtgcacaccccctccctgaggtaggtcaggtggtggtggtagggtgagttctgagtaccagttaggaatgacccagtttaatgtatttcatgtgtccatgtgtaaaacctagatacgaacttggggtttctattggaatactgcctttttcttttcttttcttttctttttttttttgagacagagtctaactctttcacccaggctggagtgcaggggcacaatctcggcctcccaggttaaagcggttctactgcctcagtctcccaagtagctgggataacaggcatgtgccaccacactcggctaatttttgtatttttagtagagacagggttttgctatgttggccaggctagtctcgaactcctgacctcaggtgatccgcccaccttggcttcccaaagtgctgggattacaggcgtcagccaccatgcctggctgaactactgcctttttcttttctttttttttttttttttttttgagacagagttttgctcttgttgcccaggctagattgcaatagtgtgatctcggctcactgcaacctccccctcccaggttcaagcgattctcctgcctcagcctcccaagtagctgggattacaggcatgggccatcacacccggctgattttgtatttttagtaaagacgggtttcaccatgttggtcaggctggtctccaactcctgacctcaggtaatctgcctgcctcggcctcccaaagtgctgggatcataggcatgagccacgatgcctggccaatgctgccattttcaaacacctatacttgatatgtattcgtagatttaaataatgtggtccaatcaaaccttttattttctgatctttgttaatatataactataccagtaagtttgcatgtaaataaagtcattgctccacaattccaaaggagtgcatttttctgtatgaatgattttcatacagaaattttcttaccataatttatttacttggctctcattgatacaccatcagtttgttctagatctttcttaatgctgagaatattcttgtgaaaacattctggagcatgagctaaatcactgtgtgaataattccaaaatatggatttattaatagtaggccccagtacttttctgaaccttgatccatattaaaaatttgtctctccaaactcctgtgcttgggagggactttccagggtgtcctagggtctccacatctcaatgaaagctggggaaggagaatttccctcatcctgggcctctgcttagtacttattcccttttctgccttcctctaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtgggacagtcacctttgggcattcatgggggagctggtcagtgatggctgctgggctgtgggcacacacacacacagggttgtcttctgtggtccagaacagcgccttaacaaggctcaaagaagagggaggacattgatcaaagaaattaaccagacttctctttcttctttcctggcctcatcaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacca

SEQ ID NO: 1405 - DNA, 31348 bp, Homo sapiens
cattttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgagtggacggtggcttcgcggttgccgcttccttgccagcgctgaggcggtttccgaagtgggtgggagcccaggtatcccctggatttgtcttcgcagtcgtcgttcgctttggtgtgtggagctggtttgccacttaatttatacctggccgtaaggagtgttgggcctactggaaggagctccgtaggttgttgagtgaatgatgcttcctctggggactcccatcatccttggcctgcaagcattctctggtggaccaggtctcattccagcatgaattgggggcctgaggggggaaggggagggcagggcagtagcaagccgacaaatgcgcgagcagagacaaggtatgttgtatgtttaaggaggctcaggagggtgtgtaaggttgccatggttttcctgcggccgctgagacgtggagggcaacagtgtgtggtcttttcctggatgttctagccatccgcaactactgcagacattgtggccagtcagatgcccttactctcatcgctacagcctgcattatccttggccgctcgtgttccgtggccccaaagtatcctggcgtcagagacaagttctgtcggaacccagtaaggaaagaggccgatggttggttcattgtggaatttccttgggggatctgggagacccagggagatcccagagggcatgggaagctggtctggagcctgtcgttccccaagtagatgcagcccttccagtgccgctctgtggggtcagtgaggaatgctgagctttttgtgcccgtgttcacatacttttttttgttttgagacagggtctcactctgtcgcccaggctggagtacagtggtgcactctcagctcactgcagtctctgcctcccaggttcaagcaattctcctgccccagcctgccgagtagttgggattacaggcatgcactaccacacctgactgatttttgtattttagtagagactgggtttcaccatatttgccaggctggtcttcaactcctggcctcaagcgatccgcccacctcgacctcccaaagtgctgggattacatgcatgagccaccatgcccggcccacagatacgtttttcagggctaattgaaatagacttaatgttagaaatgagtggaaatgcttataacttcatcgcattagatttgctttgatgttgggggagtgttggagttacactgttagaccgtgaatcatagtaaccccatgtttagatcctatctatggtggtgagatgtgtgactgggtgaattgatagcgcttccttagcatgaagtcattgactgtgaaggtgatgatggtgttgactgcagggactgtgaaaggattaataaaaatcccagagcacactgagcattgaatactttaaatttaacaactgttactggtgggaagtgttattgtattgatccagaaatcaaggctcagagaaatgaaatgctgtctttgaggtaagagctgtcaagtgtcagtttcaagtgtttggagctaggaacttctagtcactgtgtttacacaggatgtgaagccttcaacatggggcaggcacctagctggaccagtgagactcaggtactgccgttgtaaccattattgctattattaccatttccccatttccctgtcgttttagagcccttagcttctgtatttcacagtccacaagttgtttccgttgtcctgtgtcattctctaacggccgttaaataggaggcttctctcctttactctggtattatgttaaaagcatctatcttccctcttgagcccagcacagagctaggccctcaggaggtgctctgtgattcaggccgccatcactgtacaccttttccagtggagcacagtctgtgatctcattcagcagctgaaaggccaatactactaattctgtttgactttccaggtgtctgtgacctttgatgatgtggctgtgactttcaccaaggaggagtgggggcagctggacctagctcagcggaccctgtaccaggaggtgatgctggaaaactgtgggctcctggtgtctctgggtaaggccttccttccccctccaccatgcaggtgacctgccacttccttcattccatcttctgactccaggcctggctgcacaagaaggcctctagaatctaccttgcctctttcccacagctttagtcattttccacagtaacctcttcctatctggtctcctatatctctgggctaaagacagggtactctttggctcccagccaaaggagaaggtggtaaaaggaaatggggtgttttgcaaactcaaaggtaattttcagctgtgcctcatgaggggctggtgtaggaactgagaaccaccacgatggtgtcctggcttctctgtctgggtctgctcatgtcacgtctattctctatggctttttctgccttagtgagttcaagacaagagtggccacctggattagggttctctaaagggacagaactaatagaatagatatatataaaaaggacagtttattaagtagtaataactcatgattacaaggtcccacagtaggctgtctgcaagctgaggagcaaggaagccagtccaagtcccaaagctgaagaacttggtgtccaatgttcgagggcaggaagcatccagcatgggagaaagatgtaggctggtagtctaggccagtctagtcttttcatgtatttctgcctactttatatgctggcctcgctggcagctgattagatggtgcccacccagattaaggggggggtctgcctttcccagcccactgactcaaatgttgatctcttttggcagcacctttacagacacacccaggatcaatacgttgcatccttcaatccaatcaagttgacacattaataaaaatcccagagcacactgagcattgaatactttctctttaaatttaacgactgttactggtgggaagtattattgtattgatccagaaataaaggctcagagaaatgaaatgatgtttttgaggtaacagctgtcaagtgtccgtttcaagtgtttggagctagggacttctggtgactgtgttaacacaggatgggaagccttcaacatgggccaggcacctagctggacctagctgttaaccatcacaactccatcccttgtcaacttgaacccatacacatctcctgagatcatacataatcttcaaataaagacaataaggtcataattatgcttaacataatacaagtatcgttcatgcaaccgaaacacactaatccccaacccaagtgctattacataaaggtagcaatacttaaatgctgatatgaagtcagtaaatcttacgtcacatgataaaggaaataaaatgcagatgttttcttagtacaagtgtatacatcacaaacatgtttttaataaaagaaggaggaaatacaacaattacagtcctcatttctgcaactggtcacttggtcgtagttggtattaatgactaccttcttctcctgcacattctgtattcactttgccttcagcaagcacctcagcaggtcatggttttttttcctggtggagtgacccaaaccttcattcctgaagggtctgggccatttgtagtcctgcctggattgggctgttgtagcttcccattgaccttaatcacagggcatggtaatactaagagatgccctaatggatcttctgtattccatgcatactcttccttacctccattgtggagtagtagactgatttcatcttgatagtctgggtcattcatcccagccaacactgtaactcccttcttaggctattgacttaaaggtaggaggagcccaaagtgtccaggtggcaatcttaacttccagtttaatggaatcgttgtgtctcctggtggcagcattcctccctctgaaactaagacttctaggccaacggaatgtaatgtcgcgggaataggaagcaaaattttgctagttgatcactagggatgatgttgagtggtgccatttgcacttccaccccttgattcctggacccatgaatcctggctatgggagaaacagtaccatatattggatgctaattcagagcatacatggcctactggagaactttgccccagccctgcaaagtattgtcactagttggagtaattatgactacaaaaggtcattccaccattctgtcaatccagttgcttcaggactatggggaacatggtaagatcagtgaattctgtgagcatgagcccactgctacacttctttagccataaagtgagtgccttggtcagaggcaatgctgtgtggaataccattacgatggataaagcattccatgagtccgtgaatggtagtcttggcagaagcactgcgtgcaggataagcaaacccatatccagagtaagtgtctattctagtgaggacagacctctgccctttccatgatggaagaggtccaatataatcaacctgccgccaggtagctggctgatcaccccgagggatggttccatattgagggctcagtgttggtctctgctgctggcagattgggcactcagcagtggctgtagccaggtcagccttggtaagtggaagtccatgttgctgagcccatgcgcaacctccatccctgccactatgaccattttgttcatgggcccattgcacgatgacaggggtggctggggaaagaggctgagtggtgtccacagaacaggtcatcctatacacttgattattaaaacctttctctgctgaggtcttccattggtgagcactcacatgggatacagatatcttcacagtttttgaccactcaggtccatccacatccctcttccccagatttctttgtcaccaactttccagtcatccttcttcgaagtccctgaccatccagccaaaccattggctacagcccatgaatcagtatataattacacatcttctcatttctccttccatggaaagtgcacagcgaggtgcactgctccaagttctgcccactgggaaatttcccttcgccactctccttcagggatgtcctagaaaggggctgtagtgctgcagctatccactttcaggtggttcctgcatatcatacagaaccatctgtgaaccaggccctagtcttctcttcctccgtcaaccgatcatagggaacttcccatgaggccatcggtgcaggctgggggagagaaggtggggtggcaggagtggagtctgtgggcatttgagccacttcctcatgtaacttgtgccttcaggatccgcttgagcccaatcacatatataccactttcatctgatgatggaatgctgctgtgcgtgacccacttgatggctagctgggtcagaaagcacccagttcatggtaggcagttcaggttgcatggtgatttgatgacccatagtgtaacaggccaagagctgtctctcaaaaggagagtagttatctgcagaagatggcagggccttgctccaaaatcctagaggccttcgctgtgattcacctatgggggcctgccaaaggctccaaacagcatccctatctgccactgacacctcaagcaccattggatctgctgggtcttaggggccaagtggcagagcagcttgcacagcagcctagacctgcctgttgcagagccttctcctgttctggatcccactcaaaactggcagccatttgggtcactcgataaatgggctggagtggcatacccaaatgaggaatgtgttgcctccaaaaaccaaataggcccactaggcattgtgcctctttcttgattgtaggagggaccaaatgcagcaacttactcttcaccttagaaggcatatcttgacaggccacacaccactggacccctagaaattttactgaggtagaaggtccctaaattttagtcagatttatttcccatcctctggcacacagatgtcttaccagtaagtccagtgtgtttgctacttcttgctactggatccagtcggcataatgtcataaatgtaatggaccaatgtgatatcttgtggaagcaaaaagcgatcaaggtctctctgaataagattacgacacaaagtcggagagttgataggcccctagggtaggaccgtgaaggtatattgctggccttgccagctgaaggcaaattgcttctggtgggccttatggacaggaatggagaaaaaggcatttgccaagtcagcggctgcataccaggtaccaggagatgtgttaatttgctcaagcaatgaaaccacatctggtatagcagctgcaattggagcaaccacctggttaagctttctataattcacagtcattctctaagatccgtctgtcttctgctcaggccagatgggagagttgaatggggatgtggtgggaatcaccacccctgcatcattcaagtccttgatggtggcactaatctccacagtccctccagggatgtgatactgtttttgatttactatttttctaggtagaggtggctctaatggcttccatttggcctttcccaccttaatagccttcaccctaacagggagccagtgtgggggttctgccagctgctaagtatgtctgtgcctattacgcattctggcactgggaaaatgaccacaggttgagtctggggacccactggacccactgtaagtcaggcctgagctaaaactcctgacctccataagcccctactttaactggaggaccacaatgatgttttgggtcccctggaatcagcgtcagctcggagccagtgtcctgtagtccccgaaatgtctgatcatttccctttccccagtgcacagttaccctggtaaaaagccagaggtctccttagggaaggatgagagaaagattaacagcataaattgtcagtagtgtagtggggtccttcctcaagggacctggcctccccttcattcaaggggttctgggtctgtaaactagcccaagtctggaaattgaagggccatgattctgtttttgtaattcaaattagtcttttgtccattcgacctggaagttttctgcttatataaattaaataggattgcagtaggcttcctatcagtttcatttctgggaacactgtgattaattagccaacgccagagatctacatgagtcagactattctgattgctgctttgtctctgttgtccattatgatagctatgcctaccttgcctttgatggttgagtgccaccacttggcccctgccacctcgggatccaattattcccaatgtattaaatttttgtaggtgagtgactgaaattccaactgctggatctggcaattacagggctcttcaaagatgcaggtgctgccctcgcaaatctattttgcaagccattggttaaggttatgtcttatggaccctcccagctgggatgagtaggtctaaagtgactaatctactccatcatcccaatctccctaagcctttggatcccttcctctacattagaccaagggagatcaagcattcccagctcacccatgatgggccatcttttaatccatatttcagctagccaagcaaataagctattggaaccttttttaactcctcaggctgcaacattaaatgcaggatccctaattagtgagcccaaatcaataaattcagcctgatgcatctgtatgttccttccagcattatcccacacccttaatatccattcccgtgcctgttctccaaatttctgcttatataaattagaaaactcaattcaagtgtagctcacctccccatgggtcacactctgaacctcacttctgtgggcccatcgggactttagttataggtctagaagcaaacaaaggtgttgagggtgctagaggagaatcgatattatcttgcctggcaactgcctcaggggaggccatcactgttgcctcaggcagcacagggtttatctcctcagacaaaggtggaaaggctgatggcagcatgggtcggggagaggatgttgccactattggggatgccattttcctttctctttcttctgcctattaaacctccactcctaaaaaaaaaaaaagaaaaaatgatgaactcagggattctaactcctggcttcagaagcagatactaagcctcaaatctgctaagattgccctgagtgagtcttatctcctgtagagaaaaagctgaaattgtagaaaaacagacataagctagtcatgtgagtggctgacctgcaacaaaaggtgcatgcacagcctcaccaggtgtctactgttaaagtgagggcactgattggaaaagaatgggaccctgaaacttggaatagggatgtgtgggagaaccctgatgaagctggggacactgagcttgtaaactctgatgaaccttttttgccatcccccaaatgccatcccagcgctttgggaggccaagatgggaggatcacttgagcctagaagtttgagacaaagcctgggcaacatagtgagaccctgtctctaaaataaattgaaaaaaaaaaaagccactcagtaccctgttttactcccccaccccaccccgacctttgggtcttgtctttttctttgtctttgtctcttgtctcttgtgtcttgtgtcttgtcttgtcttgtcttgtcttgtcttgtcttgtcttttctcttttccttttctttcgttttcttttcttttctttttctgtcttgctgtcttgcccaggttggaatacagtggcacaatctcggctcactgcctttgcctcctaggttcaagcaattctcatgcctcagccacttaagtagctgggactacaggtgtgtgccaccacacccagttcgtttttgtatttttattaaagacgggattttgccatgttggccaggctcgcctcgaactcctgagctgaagtgatccatccgcctcagcctcccaaagtgctgggattacaggcgtgagccaccacacccaccctttactttttataataaaattttttttatacatttgttatatatgtgctatatataattaccatatatgatttgttataaacattagtatataaatgctggatttctaattggatcaaattatggacattgttttaatttacttattgtatgtgtatatatatacaacttatttatgtgaagatatttatatatatagtttttaagactaaataagggtggtattgtgtttgctaggcctggcatttgtatggtacataaggtttaaaagttcactttcttttttctgccccttgggtttgtagctgcctttttctttttttcgttatttctctctttgtgttttaggcttttggcatccagaagtagtggatcttagtttctgtccctgggtagtaaaaagaagctggggagaggaagaggtttgatgcctccaggcagctgcctctccctggtacagcctctgtcccaagtgtaatcagtcccccgctaaatgactagtctcttacaggatgggaagagagaataaataactcagttaagcagcccaccagtgactttggtgttggcttggttgattggacttgtatcccaacacaatccatcagaggaagtctctactcactaccttttgtgaggagcctcagccttgtatattaccccgtaaaccaacccagaaactaggtgtgtttatgttggaaaagtagactaaggagatcagtctgtcccagaacggtgccagctggggaattactgcccttgcgtatctagactgtggcatctttaaacactggaaggatctgaggagcactcctttaggattcctacagcactttaggccagaaacccatggcagcaaatgccagacgcagctgaagcacaaggctgccagcatctcgcagccttccccgggcagaactttctgtgtggtacaatcccttagtgagctgatcttcagccttcccatgagcgcagagtcagcctgctgggtgcaccagttgtattaatttgtatctatgggccaagtgtggtagctcatgcctgtagtcccagcagtatgggaggcaagagggttgcttgagcccaggagtttgagaccagcctgagcaataaagtgagacccagcctctacaaaaaaaatcaaaaaaattatctgggcgtggtggcacatgcctgtagtcccagctactcctaaggctgagatagggaagattgcctgagcctgggaggtagaggctgcagtgagccatgatcacaccactgcactccagcctgggcgacagagtgagaccctgtctcaaaaaaaagcaaatttgtacccatgggattttaatttatagcagtgacttagtgatgacacagagaggttaataacattgaaagaagaattcattatttacaattcgtgaaagaagagggcatatgctgggcctcatggggatacagctggaagcacaggggaggagaaagcctttaactgggtgtggtattctgatacatactggtttttgtccaccgttcctgattcataacccctatagcccttttgttaaaatgctgggtatgttaggcctcagggtcaggcctctgacctcctgccctcctttcgctctaacgttcctccacctttctgactgtgggtctcatgagtgggtccaaccctataccctgggaaaggaatgttgatgttttgaagcttccataaagactccaagaggtcacagttgagtgagcttccaggtggtccccccaggaagggcatggaagctctgtgccccttccgccacaccttgccctaggagtctcttcatctgtatcctttgcaatattctttataatacactggtaaacatgagtgtttccttgagttccgtgagctgctccagcaaattagttgaacccaaagagggggtcgcgggaaccccaactcaaagcccattagtcagacattttggaggcctggacttgtgactggagtgcagggtggggcagtcttgtggactcagccctcaacctgtgggatccgaagctatccctgcgtggatagtatgggaacagaattagaggacaccccccactggtgtctgctgcttggagtttggggaaaaccccccacacatttggtcatagaagtcttgttctgtattgtcatggtgtgagagtagagaaaaaacatgattagagagagttttccctgcgtattgggtttcttctggaaaagcaagacagggcatggtaaacagtttagagctggctagtttgagtaatttcagtgaggtttggggcatagggactatctctagttgtctggcacttggccctgggttgatttagggcaggggaaatactggcttggtatgtgagagtttgttaaagaagtggttgggggtatggtttggggttaggtggattgcacatgaaaggcatgtgcttgttcccaggggagtttattatcctagaaattacctgtccctgagaggagcagtctctcccaaagtctgaaaaggcttcaagatgttctgagcaacgtcaagaaaatatgactactgtattttcatctgacatgaacctaaacttactcggtttagaagataaaccttcatctatgaagctgtcctttgagggttttttgttgttcttgttgttgttttttgttttttaaagtagaagtcctctttttatgaaatgttggtgagagtagatactatttgatgtttctgtaaatgtccttatttaactctatcacagtagaacgttcagttttttaaatttttaatggttcatgaaatgcagaggtctggaatcactgaacctgcccctccccctggctgctggtccctgaggatgacctccagctcacatctctgcatcgtcatcactacccaccacccactctgtggtgctagtaatttcctccttagtgtggtgtttggaaggggagcccgaaccctggtgtccagccccagctctgctctttaaaaactgtgtggccatggccaggcgcggttgcttacgcctgtaatcccagcactttgggaggccgaggtgagcagatcatgaggtcaggagatcgagaccatcctggctaacacagtgaaaccctgtctctactgaaaatccaaaaaaattagccaggtgtggtggcaggcgcctgtagtcccagctcctcgggaggctgaggcaggagaatggtgtgaacccgggctgaggcaggagaatggcgtgaacccgggaggcggagcttgcagtgagccgagttcacacgccactgcactccagcctgggcgacagagcgagactccgtctcaaaaaaaaaaaaaaaaaactgtgtggccttggtcaaatgactgaccttgtctgttcctcagtgttctcattggtgagatgaggatttaccacatctgcatcccagggttgttactggggtaaagggttattgatagggtttggctctgtgtccccacccatatctcaccttgaattgtaataatccccatgtgtcgtgggaggtaattgaatcatggggacgggtttttcccatggtgttgtcgtgatagcacataagtctcatgagatccgatggttttataaaggggggttcccctacgcatgccctcttgcctgctgccatgtaagatgtgcctttctccgccttgtgtcatgattgtgaggcctccctagccatgtgaaactgagtcccttaaacctctttctctttataaattacccagtctcggatatgtctttattagcagcgtgagaacagactaataaagttattacgtgaaaagggctcaaaacagcacctgggagaccacgctgtgtgcagggagccattgcaatcctgttgccatcagtactgttattgtcatcctcatcaagatcactgtcgttggcatacctggacccgggactttctgggtagcgttgtggagctttgtggttaaacagcaccgacagcagagatggcaggacctgggccttactgactcagccattcaccagttctgtgctcttcagcaaatcactttacttcctgatcctgggtttctttgtcaataaaatggtgttgatcacgatgtggacttcctggggatgctgtgagaaaatcctcagctggaatcctcattttttctttagtctagaggaagagcattataaaacattgcttaggatgtaaaaaaaataagacttagatcaatgaaatcacataccttgtttggaatgaaaagagtcaatatttaatatttaaatacatcagtttttctctaagatactctatcagtattcacttttggaattacataatgcatttatgtaattatggaaaccttggtttccaggtcacatgccagcttttcattcccatgcacaggagcagcttcactccaaggtctggtctccatcctgaagtcccaaactagattgaaggtctttatttcttttcacccacatccatgtgtccacttgctttctccataaacagggtgtcctgttcccaaagctgagctgatctgccacctagagcatgggcaggagccatggaccaggaaggaagacctctcccaagacacctgtccaggtaggagccaagatctgggcaggttggagtcccttctggcttaagactggatggagaccactggccctggaatctcttgggaagcttctcattgtggcctctctctatataactcttatataactctatcacactagaatgttccatttgagagccatggagccctttgacctgtgttttctctgtcctcctagccccatcacagtgtcaccatgcctgggaagaagtgagatttaagaactaagatgtgttcaggggttccaactgtgtgggcctgaaatgtggcttgccagtcacctgctgtgtggccctgatgaagttgcaggatctcctgtctttgtatataacttcagctaagttaacagtagctgctgtatcagacagattctaaaatctcagtggttcacatatgaaaactctttcccactcataccagggactgtgtgggtcagcgaggagctctgtacgacacagttattcaggacccaggttccttctgtcatcagcctgttgcattaagattatcctaacgtcctcgagctggcagagaattgagggaataagggaagttaaacccacttccagaaataccaactcccctcacattccacccacaggaactaggcatttggcttgggtccatgggactgggaaatgtggctgagctgcttgtccaaggagaagagcagaaggtttggtgagcacctactctcagtccactacattgagtctgttcctgaaaagtgttattagaaatctttttttttttgagacggagtctcgctctgtcacccaggctggagtgcagtggcacagtctcggctcactgcaagctccgcctcccgggttcacgccattctcctgcctcagcctcccgagtagctgggactacaggcgcccgccaccacgcccagctaatttttttttttttgtatttttagtagagacggggtttcaccgtggtctcgatctcctgacctcgtgatccacccgcctcggcctcccaaagtgctgggattacaagcgtgagtcaccgcgcctggcctagaaatcatttttatgtcattgggcagtttaaagatgttatgtgatacattaatgcataaaactggatagtttctgagccatagtaagtgactcatccgaatgtcattattaaccttaaagagtgatgctatgttacatttccttctgaactctagggaatagggcctttcttactctcccaatttctctttccacttatattctgcctatcagcctctcccaccttctccttccacccattccctgagtgtcaatcagacactaagaagcagtagtttgcccatgtcttcctatatctcctgttttccaaaaacctcagggtgacatttgaccttctgtgtcccacactcaggctgctgagggcactgaggccatctgtcatgtgtgtggattggtgccactgcagagccttggcctctgcccgcgtgggttccttgagctgctcatccaaccctgagtgtctgtgcagtccctgttcagcccttcagagtctgttccagattgtcccctcctcagtgccacatctgcacttgaaaatctcaaaagcacaaaactcaacatgcctaacaaggaacccatgatcttgctcactcctgccacctcccaagtttctgtgaatggttctgccatccaggcagattaggggactggccccaacctcagacaagtcaacccctccacctccatgagtccctgcatccagccaagtagacagtttttgtctccaggcacagatgtctcagcatgtgagtgctgatgtgttagcaggctttcaggttgaaaagaaagtctcctgtcttgtattgcttgatcagcagcccttacatgttcatctcaacttctcttttccttactggaagaggtcttgccccagtcatggccaattcctataccagggtctagaacacacttcctttcatggacatcctttcttcatttatattctgcttgttttgtgattctctactcaacctaaaaatatgcttgtttcttcttttttcttttctttttttttttttttttttttagagtctctctgtgtagcccaggctggagtgcagtggtgctatcttggctcactgcagtctctgtgcctcagcctcccaagtagctgggattacaggtgcatgccattacacccggctaatttttgtgggtttttttgtttgctcgcttgtttgttttttgttttgttttgttttttgagatggagttttgctgttgttgcccaggcgggagtacaatggcgcaatctcggcttactgcaacctccgcctcccaggttcaagcgattctcctgcctcagcctcccgaatagctgggattataggtgcatgccaccacgcccggctttttttgtatttttaataaaaatggggtttcaccatgttggccaggctggtctcgaactcctgacctcaggtgatccacccgccttggccttccaaagtgctgggattacaggtgtgagccactgcgcctggccatatttttagtagagacagggtttcactgttgttgcccaggctggtctgaaacccctggcctcaagcagtccatctgcttcggcctcccaaagtgcagggattacaggcgtaagccactatgcccagcctcgagtttcttacaattgaagaaaataaaacaaatgcttgtggctcatgatatatttatatattcattgatacattcatttactatgtgggcatttaattgtctagatttggctggcacagtggctcacaccataatcccagcactttgggatgctgaggtgggaggattacttgagctcaggagtttgagaccggcctgggaaacatggtgagaccccgtctctgcaaaattaaaaaaattagctgggcatggtggctcatgcctgtggtcccagctattcaggaggctgaggtgggaggatctcttgagcccaggaggtcgaggctgaagtgatcttattcatgccactgcactccagcctgggtgacagtgagctcctgtgtcaaaaaaataaataaataaaaataattcatgagagaccatgaaccagaggcaaaaaaaaattaataataattttctatgtttcattcacagaaacagtgatactgtggatattcatatatgtatttcattttccacttgtggaggtgcattttttgatcattcttggagtgaaattattggtttgtaggctatgcaaatgctcaagtttgcaagatcattccctttgttttctaaagagcttatgccaatttgcacttaaccaggaaagagaggttccgttgacccatatcctttccattataaggcttatcaatgtttgctcatcaaatggacacagaatagtctcgtgttcttgatttccctttctttcactgctgtaatgttttagcaacttactatgatttttggttgatttatattttcttctgtgaaaatagaaatcattttttattttatgatgaatgcctatttccattaacctgttttcctttcactgcttggtaggggttcttagtacattcttatccttaccttttatcacttatatatgctgaaaaatattttctagtttttaattttgttctcttactctctttaaagtatctttctccaaaaggtcttaatttactgtagtctaacttatgacttttcttatataattaatgatttttttgtcttgtataaaaaatgttggtttacctcaatattaaaaatatattttattctaaaagttttaaaacttggcatttgacattttttcagtgaggttgatttggaatatatagtgtgatagcaatgcagttattttcgttctccatgtggctacccaatttttctagcttcgtttccttaatttaacagaccatcaagttccatagttaagtatagttggtattttacagggaattatattgaatttatataatttgggtcgaattgtcagttcgtattattaaattcttcattgatctagatcatctttattgtcttcaaataagattttataattttcttcatcttgatcatgtgtatttggggttttttgtttgttttaagagaaaaggtcttgctctgttgcccaagctgggtgcagtggcacagtcatactttgctgcagtcttgaattttgcggctgaagcaatcctcccatgtcagcctcccgagtagttgggactacacaggcttgcaccaccatgcctggctaatgtgtttttagttttgtttttaaaaaattttttttagagatgggagcttgccgtgtttctcagagtggtctaaaacttctgggctcgagtaatctgctcacctcggcctcccaaagcactaggattacaggctttggggggctgaggtgaaaagatgagcaccatacacagcagcctggccattggtcatgtgtatggtgctaatcttttcaccaggctgttcctcaggcatacaagactcattgtgtcaagccaggtcctcttacctctttccttatgagccttcaattgatataacatcagtcatatcaccttcactgtcacccagctcggaatcatgggaatcagcctcccctctgtccctggattgtcatcaacaccatcctgcagtttctttgtactttctgtctctttagactacagtgtccagtgtccttcctgctttctctttatggcaactcttcttcacaagcataggactcacttcattgagcacctcttactggaaaactgatttcttcctacccaggattagccaagctcaaggttaaggacacagtcctctaagactaccaggtctaactcttccgacacggactacaggtttgggtcccaaagccgttgtcaggttcactaattagctttagactcacaaaattctctaaaacctgttttagttacagtcatgtttattacagacaaagggaacaaattagaagtgacacagaatgttgggttggaaaggttcccaacacaaagcctcagtgttttcaggaactcgctgtgccccagtctggcatatggcaatatgagcttagaatgttgccaacccaggaaactcaccagctcttcattgtccagaattgtactgaagcttcattacataaccacagttgattgtctcatcacctgtgtggctcggtctccagcgtgccatcctttccagagattcagcatttaaattatgacataagccctaaccttctaatcacgtggtttagctttctggagtggccagaccttaacctgagtcatctcttcaggataaactgtggaggactccatagtgagttccccgtttgcataaactgtcagatagggccattgggtcccaccataagtaaaaacattttggaactactcagtgtttacaggttactttccatgacttcacaggaaaagcgtacttctctttggggattaatttttgttactcacttcctgtcttccatgtgggctcattaggtgctccttcctcgtgttcttgtagcaacacagcatgtccttgcttagttgcttacaggaagcttaccatgcacggtgtcgtcgttactctgtctacccaggtccaatctgtaattgtgaaggtggctccacgaacagacgcattgtctcctgacccagcctctgcccctaggtctcccatgcagaatatcccgagtccaaggaccaggatagaaagaaattgcaaacccaagaatttgagatacagaaaatagcaacacagaggcaatatttttatctatggtttttcacagaaatggtaatattcttttttccatgttgtcctttactaacaggcccttttgtgtgctggatttctttcaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatataccttttatttcctttttgtttgtcttattgcattgcacaagctgggacttccattatagcgttgaataggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaattctctagctctctatgccttgttgtatcctcaggaaggagtcacctctcttccaggatcactcttgccttttgttattggacacattttcctacctcctgcccagtcttttttaggctctctgtcatacttcctcgcctagtctttaacttgtctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcagtgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctagccaacatggtgaaatcccatctctacaaaaatgaaaaattagccgggcgtagtggtacatgcatttagtcctagctacttgggaggctgaggcaggaaaatcgcttgaacctgggaggcagaggttgcagtgagccgagatcatgccactgcactccagcctgggtgacagagtgagactgtgtctcaaaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctctatatatatatatgtatatgtgtgtgtacatatggaccacttcaagctacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaa

SEQ ID NO: 1406 - DNA, 13585 bp, Homo sapiens
tgaaacagtgtggggcctagagcgctgggtgggcgcgttctgcggcctgagcagggacgggtagtgaagcggttacgccccttcttcgcgtcttggcgggagcctgacgccccgcttctcccctaacgaggtgtcccaccggcgcccgccgaggcctaggcctccgcagccgccctccgtctcctcagccccgacgctgcgccttgggccttgtgcgcatttttttcgggggaaaactgaggctcggagtgcgaaagtcagccgaggtcgccccgcccaggacagagaagggctgtggtcggctgatccgcggcattcccgggatggcggcggcgtggatggctccggcgcaggtgagtggacgaggtttcggccttgctgctgctgtgctatttctagaggcctcgtgggcaggctggaagccaagacagccacaggatttttctttgtcgccatcgtttatttaagagaaatggccgtggcttgtcatttcctttatccgcagtcctgcaacagtgttggcctctgataggtgttcagtccgtggttgaaggagtgatgcttccttctagggatctcatcacacttcccctaaatccaaccttctctgttgcctgccagcccgtaccccatccacctggccaaccacccctgaccttgtctgtttgcatttttccctggtcctttgctcttcagagccaccaacctgaccgtgcagtcctcttccattttccaggctttctccttgcacttccttttacttcgaacactgcccctgtaactttgcagggcctccctttcacatccttttggcatctgtccaggtgtcacctatttggaggtgccttttttggcaattccggctaaagtggcaccttacacccttgcccagagtctggtatttttgtgtagataatctgatggtattaaagaagcttgtggatttgagtttgtcaaggatgtaatgggaacaaagaaaaataattgcaaagaatgatattaactgtcattgagtccttgctgtgggctgatcggtgagtattatttaaccctcagttcgtttaaccctgaaatttttttttttttttttttttttttttgagacggagtcttgttctgtcgcccaggctggagtgcagtggcgtgacctcggctcactgcaacctccgccttttgggttcaagcgattctcctgcctcagcctcctgagtagctgggactacaggtgtgcgccaccacgcctggctaatttttgtatttttagtagagacggggttttaccgtgttggccacgctggtcttgaactcctgacctcaggtgatccacccatctgggtctcccaaagtgctgggattactctttagaattaggttctgttgtcatcattgttttacacaagagcaatttgagggtcacatacgtccaattacctgccttacatcactgtagctcttaagtttcttaagtcagaaactaacaactggtgtgtctaacatcatagcctgtgtttttaccctcttctttacccgcagtggttagggaggcctgggggtgagacctaaagtaacctttgcaagatgaggcctccttctagccagtgatcttgggcatgaggagtcatggcctttcatactggtggaactgtgtagacttaaaaaatggtatattggttgtttaaggagttctcaggggacctgtgtggcttccacggtggttttatatgtggttccccttactcccttacctgctgacatattctgagagggcacgtttgtatggttatgttgctgaatgtaccctcctactcagccaggatagatgtaatctccagatgggcccatattgtcttggctacaacctgctgtgccctctatgactcttgttgcttgctcatggaatcttctggcctcagggatgcctgctagtaggacttaggtagaaaaggaagcgatggctcattgtgaattctccctggaagcaggtccaggccctaacacctgatcaggtgtcaccacgtcaggtgattctttggtgaggtggatgatgatgactacacttctctgcccttgtccatgggagtggctgaaatgtatatgtggatttgaaatgcttcattctcattaactgcattaactttgctaatagagaaatgtcaggttacataatcagaccagagggccctgggcttaaatcctgcctctgttgataagacctgtgactttgggctgggcttggtggctcacacctgtaaaccctgcactttgggaggctgaggtaggtggactgcttgagcccaggagttcaagaccagcctgggcaacatgggaaaaccctgtctctacaaaaagtacaaaaaattagaccggcatggcatcatgtgcctgtagtcccagctgtgcaggaggctgaggtgggaggatcactagatcacaggaggtcagggttgcagtgagccgacattgtgccactgcattccagcctgggtgacagagtgagaccatctaaaaaaaaaaaaaagagagagacatgaacacatgagactttgggtagactggtagagcggagggtaggactgaggcccaggtctcaggtccctgagtgtgacatagagatgatgatggtaaattcagatgctgtggcctttgcctcagtgtttgtttgtttttttttttttttacaaacagtttttctttctttctttgttttgatggagtctagctctgttgccaggctggagttcagtggtgcgatctcggctcactgcaaccatcgcctccgacgttcaagcgattctcctgcttcagcctcccgagtagctaggactacaggcacacactaccacacccagctaatttttgtatttttagtagagatggggtttcaccttgctagccaggatggtctcaatttcctgacctcatgatctgctcacctcagcctccgaaactgctgggattacaggcatgagtcaccgtgcccagcctacaaacagtttttctttagttcttttgactattcttttttttttttttttttttttttgagacagaggctcgctctgttctggagtacagtgacacagtcttggcttactgcaacctctgcctcccaggttcaagcgattctcctgcctcagcctccctagtagctgggattgcaggcttgtgccaccacacctggctaatttttgtatttttagtagagatggggtctcaccatgttggccaggcttgtctcgaattcctgacctcaggtaattcatgtgcctcagcctcccagagtgctgggattacaggcatgaaccaccgtgcccagccttgactattcttgatgaagtgggaaacacggttatattgacctggaaatggaggctcggcgaaatgaaatgaggtccccaaggtcacatagcaggcacacgttgatttcaggaatttggttttaaacctcaggagtctggctcctgagctggggagtttcagtcactttaccatggcatgtaaacctgtcagcatgaggcaggcacacagggaggattggtaagactcagatactgttcctgttattgttgctggtggtgatgtttttattattattatttcccattcctctaatatgtcagagcacttactgtctgtgcctctcagtccacttgggattgtcctaaccttatttctgtgttaagttcaagtggcttcctgcctaggaggctttatttatttatttatttatttattttttatttatttatttatttttttttgagacagagtcttgctctgttgccaggctggagtgcagtggcacgatctcagctcactgcaatctccgcctcccaggttcaagcagttctcctgcctcagccgcttctgtctcctcttcactgctgtaatccatgcaaggcagtgtccacattccccttgatcctagcacagatcttggccctttggaggtgcttggtgatttggcctttgattctctgtgcatcttttgcagtgctggagtgacaggttctaatcctattccacagttgcaaaggaaacattactggttctttttgacttttcaggagtctgtgaccttcgaggatgtggctgtgacatttacccaggaggagtgggggcagttggacgtgacccagagggccttgtacgtggaggtgatgctggagacctgtgggcttctggtcgcactgggtaaggcctgtcctctcctctccaaaatcaggggcaccagaaagcagcttcattctagccttcatcctggctccaggcctggctagtggaataggtcttgggagccagccctcctgtttcccaaagctttactctatttttttttttttttttttggagacagagtttcgctcttgttgcccaggctggagtgaaatggcgtgaccttggctcaccacaacctccgtctccccgattcaagtgattctcctgcctcagcctccagagtagctgggattacaggcatgtgctcccatgcccagctaattttgtatttttagtagagaaggggtttctccatgttggtcaggctgttctcaaactcccgacctcaagtgatccacccacctcagcctctcaaagtgctgggattacaggcatgagctaccacgcccagcctcatttttttgactcaccttattcttcctgatctctttgtgtcttacttagaaagggttggctacgaaatatagtttgcttttggtcacagccaaaggagagggatgtgttaccaggaaatgggatgttttgtagaacccaaaggcaggatttgcagccaggcccccctgtggcactaatactggttgtctggtgctggcttccctttatgggtctgctcctgtcactgtctttttataatggctttttctggctcagctattgtgtggaacgaagtgaccgtctagtcttgttctctgaggctcacacattccttggcactactacttcctgcatatttttgttgtctctctgttgatactcttctcacttaattctcccagcatccccatcgtcagtgagtaaggataatagggccattgcaatgaacacctcagaaacttaattaattcagtttaagagataaaccttcattgtgagatgctgttcgttgcattttttttcttggtaaaggttctttcttttgtgatgtgttgattttgatgtttgtgcaaacgtctatatgtggccaaatcgctatttggagttccctcccagttttttatttttcagtggttcatgaaatgtcgaagcgtggagtcaccacgtctacccctcactctgctgccctgttcccttaggattgagttcttccactcatgtctcccattctttatggcctccttgttttgagactcctggcaccacacgggggtgttcttcatttcctctgagcacagcacttgggagaccaaggtctgatgcctcagagtccaattccagctctactttttgtcagctgtgtgttcctgggcaaagtactgaactcctctgtgccttaattttctttttagaattttttatttctttatacccatgccagtgcagaaaagtgcctcaattttctcatgggtaaaatgggacaatatgtgccaaaaaaggcatacgtttgtttcattgtactttgctttactgcaccttgcagttactgtatttttagaagttgaatgtttgtggcaaccctgaattgagcaagtctgtcccgcaccatttttccaacagcatgtgctcactttttgtctgtgtcacgttttggtaattcttgcagtatttcaaatatttttattaatattatatctactgtggtggtctgcgatcagtggtgtttgatgttactattgtaattgctatggggcaccatgaactgcaccatgtaagacagctttatcaataaatgttatgtgtgttctgactgctccacttactggccattccctctctgtctctctccttgggcttccatattctctgagatacaacaataatgcagtcaagtcaattaataacactaaaatggaagccagatgcctctaatcccagctactccggaggctgagatgggaggattgcttcaggccaggagttcgagactaggcttggcatcataataagactccatctttttttactttttgaataagctataactcatatgctgtgttgtgcaaaaatcctaagaagtccaggccaggagtggtggctcacacctgtaatcccagcactttgggaggctgaggcgggtggatctcctgaggtcaggagtttgagaccagcctggccaacatggcgaaaccccgtctctactaaaaatacaaaacaattagccaggcgtggcggtacacacctgtaatcccagctactcgggaggctgaggcaggcgaatcgcttgaactcaggaggcagaggttgcagtgagccgagatcgtgccactgcactccagtctgggcgaagaaggagactctgtctcaaaaaaaaaaaaaaaaaaaagtccactcactgaatttttgcttatgtataaacccaagtaactaccacctacatcaatacataggctatctccagctcctcatcagggttttatgccctcgatagcttctttgattctattagctcatatttagacttcatcagcacagattggttggctgttgttgaactgcacagtgtgctctctgacatatctgtcttcttttgatcatcatgtctgtgttattcttttgaggtgtttatatacagtcggagttggttcattctcaatatgttgtagtttctcattgtatgtgaaactgccatccatttgtccattaccctgctgatggatgttcctgttgttttcaggttttggatatgttgctgagagtattattgttcatattttctggtggatgtaaatactgatttctgaattgtgtgttaacagtaaattctgttagaatatactcgtgtgtacatatcaggtcatggagtaggttgtatattcagctttctttttttctttattattttttgtagaaatggagtctcactatgttgcccaggctcatcttgaactcctggcctgcactgatcttccctccttggcctcctaaagtgctgggattataggcatgagccacactgtgtgggtgtgttcagctttaaaagaaactgcccagcagttctgcagaatgtaccatttcactttctgaccatggacatgtgaaagtttccattgctccacatcttcataatcacttgataacatcattcccctttgggaggtctaggcgggcggatcacttgaggtcaggagttatcagcctggccatcatggtgaaaccccatttctactaaaaatttaaaaattagctaggtgtggtggcaggtgcctatcatctgagctactcaggaggctgaggtaggagaattgcttgaacctgggaggtggaggttgcagtgagccaagatcacaccactgtactccagactggacgacagagcgagaccccatctcaaaaaaacaaacaaacaaaaaaaaccatcatttcattttactgtttgagtccctgtggtaggtttctctatatcacagcacagaaaccattgtaaggtcactcctttcattcctaattttcaaatacaacagtgaccataatgataactgatgatggcccacaatttaccgatctcttatgtagtgtctagcactgtgccaagtgctttatagaaattttccccttttttaagagacagggtcttcctctgtcgcccaggctggagcgcagtggcaccatcatagctcactgtagcctcaaactcctgggctcaagcagttctcctacagagtagctggaactacaggctcatgctacaacgtccggctaatttattaatttttttgtagagatgggatattgctatattgcccaggctactcttgaactctgggcctcaagcaattcttctgccttagtctcccaaatgtaacgggattacaggcatgagccaccgtgcccagccaagaattttcctatttaaccctcatcacagcctatgaaacagaatctgagagtttctgtttttcagatgaggaagtggagactaggatcaactaaatcatttctctggcatcagctgacttggtacaggcaagatttgaactgagatgttctgactccagagctacactcttaacctcccttcaatatgaactcacgattcagcacagagttttcatattttgtgcttgagcattgggccgtcttagattctctttctctgttctcactgggctttggttctctttttactctgatcttcacttttatgttggcttcatcagttatctcatagcccatcctttttactcttacatactctccaaggctaatccacacattctttttatttattattattactttttttttttttttaagagatggatctggctatgttgcccaggctggtctcgaactcctgggctcagcttcccgagtagccaggattacaggcagtacctttcagattgtgtctttttctagtattttcaggttattgtttctcagggttgtattgaatttctggatcagtttttagagaattgataattttatattatcaatttcttcattcagttagatctttattgtcttgaaataaagttttattattttctttttcaagatccagttgtttgttagccttttcgcctacctttcaccttgacagtggattctatatgtctaccaggattctgttcaccctctgtcctaggagctctgtcctaagagtagctgtggccatcactagctgtccctcaggcagaatcttgagcatcagcttcgtctccgccccttcctgtctctgaatcctgatcaaccttaacttcttatggggctgcctcctctcactgcagtcctctggattcgctgaagactctgtgtctttgtatattctatgtcctaaggctaatatgtccttctaactttaagctcatgaagcatcctctctgggaagcctccttgacctcttcctgtccctgccccttctaggctacattaagtgccccttccctggcctcttgtagctccttgacatgttcttgagcaagcttatgatagagtgtcatcattatgatgtccacctagtctcatcttgactgtgagtggggatctctattccagaccatctgtactctgcttgagcttctccctctgggtttctctttaaaaatttcaagagttggccaggcacggtgggtcacgcctgtaatcccagcactttggaggcagaggtgggcggattacttgagcccaggagttcgagaccagcttgggcaacatggtgaaaccccatctctattttaaaaatacaaaaaatttagccaggcggggtggctcacacctgtaattctagcattttggaaggccgaggcaggcagatcacctgagttcaggggttctagaccagtctggccaacatggtgagacctcatctgtaaaaatacaaaaaaattagcccagcatggtggcgcacacctgtaatcccagccacttgggaggctgattcaggagaattgcttgaacccaggaggcagaagttgcagtgagctgagatcatgccactgcactccagcctaggcaacagagtgaaattccatctaaaaaaaaataaacaaaaaaaagccaagcgtggtagcatatgcctgtagtccagctaccttggaagctgaggtgggcagatcccgggtgatccgcctcagcctcccaaaccaaagtgctgggattacaggcatgagccaccatgcctggcctttttttgagatgggtttccctctgtcacctaggctggagtgcggtggctcagtcttgactcactgcagcctccacctcccaggttcaagcgattctcctgtctcagcctccccagtcgctgggattatagccgcccgccaccatgcctggctaatttttgtatttttagtagatatggggtttcaccatgttggccaggctggtctcaaactcctgacctcaagtgatccgcctgccttggcctcccaaagtgctgggattacagggatgagccactgtacccagcccatcaaatcatagctattttcaaatcatcactattttcatcttattgttctcaccaaaaaggtggtttcatttcttctgtactatcttaataagttcttttgtgtattgtgttcccttcaggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatcttacttgctgtaattttgtatttgttaaccaatctctatctgcctctctgctgtccttcccagcctctggttaccaccattctcaaccttttatgcttgcatatgagtagaaacatggagtatttctctttctgtgtctagcttatttcacttaatgtctttcaagctcattcatgttgctgtgaatgacaggtttatttttcatggctgagtagtattccattgtgtatatatgccatgttttctttcttcattcatctgataatggacacttagactgatttcttagctattatgaatagtgcttcaataaacataggagtgtagatctctctttg

SEQ ID NO: 1407 - DNA, 4490 bp, Homo sapiens
gccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagtgtgagagccagcgccagagaaaggacgcagggaaggctggggactgggccaggggtcgggtgcacagaagacacatgtgttgacatctcccctccctctcctcctccccaacgctcttcttttctccccactccctcccttccctccaattctttctttcacctctccctcccctactctctcctccccttcctttctctctgcctcttcttcacctcctcctcccctccctaccttaccttactctttcttcttccccttacctctccctccccctctccctgccttccccttccctctctttctctcctccccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgtgagtcccttgggattggtatctggaaaaggaaggaaggtgggacgtggggatgaagaacagactgggtgtgtggggtgctggctcctgggaacgagaactactgatagggctgggtctgtgtgagaagggaaagcggcagaggaaggatacaatgaaagaggaaggggagcattggcatccctgactttccctccgcctaccctacctcccaagctgaggcttttttcttcctctcctgtcaggcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacagtaaggacagtctctgcttcctctttcatctttgacgtctgagcccagcattttccccaaatactaaccccaagtaaaccctgcacttgtaccttgaagacttctctgcagttcattccatttacactacctcctaccctgggtcagacactcgaatcctggttcctgttctccgttctcccctcacttgctcccagatagggctgttgttattctggtcccagcataatttgccacttgtgtgaccaggcagtgacggtggcatcatatgataggcctcagggagaaatctgactcttccaacattaatccttcagacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgaggtgcgggtctggaggctctggggtctctgagtttactgtgggctggtgggagctctgtttgtggctgtcaggagggtccgcattgccttctgagaagtttacttctgaatgttattgtgtaaatttaatataatggcacgtatgttctacagctttatccttggataccctaattaacctcattgtatctccagaatattaataagtactgcgtataggtttggattctttggttataagcaacagaatctaactccactgccttatgtaaagaaacatattgaaaggctctgaaggagttcactgaataaatagctagaactggcttagagataggtacaaagagatttctagagggttccggaaagggaaccatggcaatgattttcccaggagcaatggtccaatcagcttgctgtgtcaggatgagtggtcttccatctttcctcctgtttctgtttcacttcctcgggcctcaagtcctgtgagagatcatctgagtggctcaatgtaggttctatgtctggctacttgctgtgctaggacaacagggaggatctgtgtccatgttaccatccatcctataagaccacataaaaaggagaggaaaaccacaccccacacaccagtaactggtgcaatttaaaaggaggaaatggagttactggaccaaaaagattccactgtaatcatacaattcatggtaagtgttccacctcagacggaaattgtggcaggcttcacttccagggtgacttttctttgcacccacagataatagaggagttggcagatgccctgacctactgccatgacaagaaagtgattcacagagatattaagccagagaacctgctgctggggttcaggggtgaggtgaagattgcagattttggctggtctgtgcacaccccctccctgaggtaggtcaggtggtggtggtagggtgagttctgagtaccagttaggaatgacccagtttaatgtatttcatgtgtccatgtgtaaaacctagatacgaacttggggtttctattggaatactgcctttttcttttcttttcttttctttttttttttgagacagagtctaactctttcacccaggctggagtgcaggggcacaatctcggcctcccaggttaaagcggttctactgcctcagtctcccaagtagctgggataacaggcatgtgccaccacactcggctaatttttgtatttttagtagagacagggttttgctatgttggccaggctagtctcgaactcctgacctcaggtgatccgcccaccttggcttcccaaagtgctgggattacaggcgtcagccaccatgcctggctgaactactgcctttttcttttctttttttttttttttttttttgagacagagttttgctcttgttgcccaggctagattgcaatagtgtgatctcggctcactgcaacctccccctcccaggttcaagcgattctcctgcctcagcctcccaagtagctgggattacaggcatgggccatcacacccggctgattttgtatttttagtaaagacgggtttcaccatgttggtcaggctggtctccaactcctgacctcaggtaatctgcctgcctcggcctcccaaagtgctgggatcataggcatgagccacgatgcctggccaatgctgccattttcaaacacctatacttgatatgtattcgtagatttaaataatgtggtccaatcaaaccttttattttctgatctttgttaatatataactataccagtaagtttgcatgtaaataaagtcattgctccacaattccaaaggagtgcatttttctgtatgaatgattttcatacagaaattttcttaccataatttatttacttggctctcattgatacaccatcagtttgttctagatctttcttaatgctgagaatattcttgtgaaaacattctggagcatgagctaaatcactgtgtgaataattccaaaatatggatttattaatagtaggccccagtacttttctgaaccttgatccatattaaaaatttgtctctccaaactcctgtgcttgggagggactttccagggtgtcctagggtctccacatctcaatgaaagctggggaaggagaatttccctcatcctgggcctctgcttagtacttattcccttttctgccttcctctaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtgggacagtcacctttgggcattcatgggggagctggtcagtgatggctgctgggctgtgggcacacacacacacagggttgtcttctgtggtccagaacagcgccttaacaaggctcaaagaagagggaggacattgatcaaagaaattaaccagacttctctttcttctttcctggcctcatcaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacca

SEQ ID NO: 1408 - DNA, 4541 bp, Homo sapiens; identical to SEQ ID NO: 1404

SEQ ID NO: 1409 - DNA, 10780 bp, Homo sapiens
tgcaacgcctcctggggttgtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggtgggtgccgcgtcccagggcgccccgcccgatccctcctccgagtgccgaagccccgaggaggggccctgcaggtcaggcccctgtgtcccaaagagaggagcgttcttgtgtggggtaccggtgtccgcggtgctgtgaggcgggggagctcctgtcagggacctgcacgtgcgaggcttagaggtgctgcagagcgggcggcactggggagcccgagcgtctttgtctccacggagctgagggtgaggcggagtctcgcctgggagggcagcggagctgctgaaagccgtagaaggctgtgcaggaagggttatgcccagaggtagacgtttaaagttgggaaaaacaggatgttaaaccaggacaaggggaccgctgaggagaccccttgagttatggtagggatgggccagaggggttgcagtagaggggaagtgtgatgagattctggatggatctcagagatagagtcgacaggatttcctgctgcatcaaatgtagcagtgagggtagtgaagggtctattccatggattttgttttggcctgaaaatctgaaagaatggagttggagaagtcagcttagggagcaggtttcagagaggattatgagttgcattttggagggctgagttttggagggcagatcatgggtgggtccataagcctgacgctacctttagaaaggcgcagacctgtcataggagggattctggctcatatctgcaaaaacggagttctgaatgggttaaggaactggcctaggctggagactgaggtgtgaggtggtttagatttctgcacctgcagacccagcagccccccaggcccactctgtggaacaataggaaggtcatccagactagtggggacattgggtccagacgggggtagggctttctcacatctagtcaagggcctccagcaagcttccagcaactgaatttgtagcaggcaggcctggttgctgatgggaccagtaactgacctgcttgcttatcccctccctgcaacttatttatttatgaatgtgtaaaacattttttttttttttgagacagagtctcgctccatcgcccaggttggagtgcagtggcgcgatctcggctcactgcaagctccgcctcccgagttcaagcaattctcctgcctcagcctcccgagtagctgggactacaagtgcccgccaccacgccaggctaattttttgcatttttagtagagacggggtttcaccgtgttagctagtatggtctctatctcctgacctcatgatctgcacgcctcagcctcccaaagtgctgggattacaggcatgagccaccgcgcccggccgaatgtataaaacatttatttaaccactaatgaaccagtatccttctaaatatgtacacataggtcggcagttagaaatgaatgtaaccaatagttaaatttattcacttaataattgttgaatgttgatttttcttttttctttttttttttgagacggagtctcgctctgtcgccaggctggagtgcagtggcgtggtctcggctcactgcaacctctgcctcccgggttcaagcgattctcctacctcagcctcccgagtagctgggattacagacatgcgccaccatgcccatctaatttttgtatttttgatagagacagggtttcaccatggttggccaggatggtcttgatctctgcacctcgtgatccgcccacctcggcctcccaaagtgctgggattagaggcttgagccaccatgcccggctgaatgttaatttttctatttgcttgcaatggaaagttttatgtatcacatttccttaacaccgtaagaagtgggaaaaatacacacccaaaatttcaaaacccttccatgtcatttgtaccgaaaacatgtaaaaaatatttaatccagtagaaagaaattgctgatacatagtgtgtactacttatatttgatgcccatataagccctattagttggcaatccttttaatctctattttacacataagggcaccgagacttaaggaagttcagtcctcatcaagacactgaaccctgaggacttactgtgtaccctcagataactttgctctagttgcagggccagaggtggttgtacagtcagcctgtaggatgctgcaatgctgtcttaatcctcatggcctgcctcttcccacagggttcatagcagtggcagcaatgcttatggatgctggacaggtgagtggagagtgtttccagctttcacccatcccagatggtttcagcatgctgatatagggaatggtgttatcctgagactgttcaccttttcttctctctcccttgggtccaaggagagcctgtagttccaccagacctgggttccaaactcagtgcctggttatatagagtggttctagttctcacaactgatggtttgagatttggcaaggcatctcaaacacaggatctagaatgttcaaatgcttggtggtgagacttagatgggatgcttagagaactgtagcttaatgttctagctggcaaggataaggagcacagcagcagggcaggaggtcggggcatgcagggatcaggcatggaatggcagcctgaggttgtctaggtttttgtttttgttttgttttgtttttgagacagaatcttgctctgtctccaggctggagtgcagtggcgcgatctcagctcactacaacctccgccttcctggttcaagcgattctcctgccccggcctcccgagtagctgggattataggcacccgccaccatgcccggctaatttttgtattttttagtagagatggggtttcaccatgttggccaggatgttctcaatctcttgacctcgtgatctgcctgcctcggccctcccaaggtgctgggattacaggcttgagccaccacacctggccttgtttttttttttttttccagacagaggctaactctgtcgcccaggcgggagtgcattgatgtgatctcggatcattgcgacctctgtctcccaggttcaagcaattctcctgcctcagccttccaagtagctgggattacaggcatgaaccaacacacccagctaatttttgtatttttagtagagacaggatttcaccatgttggccaggctggtctcgaactcctggcctcaagtgatctgcctgcctcagcctcccaaagtgctgggattacaggtatgagccaccgtgcccagtggttctaggtctttaatctgaggggggtagtagctagggaaggtttgagaaagaaaaaagaggtgatttgacctagattctttttttttttttttgagacggagtctccctctgtcgcccaggccagagtgcagtggcgtgaactcggctcactgcaagcttcgcttcctgggttcacgccattctcctgcctcagcctcccaagtagctgggattacaggcacctgccatcatgcccggctaacttttttttgtattttttagtagagccagggtttcaccgtgttaggatggtctcgatctcctgacctcatgatctgcccgcctcagcctcccaaagtgctggaattacaggcctgagccactgcacccagccagatttgacctagattctaagaggcttcctctgcctgcagaatggaggacagagtgagagttagggaagaaccaaggatacctgggtgataattcctgccacagtccagtggaggttggtggtggctggacacgagtggcggctgtggaggtgggaggggtgggtggcttctgtaggttttgatctagagctgctcacattttttgatgtacagagcgaggaagctcgggaggtaggatgcaagagggagtcaggaatggccccattgttttggccttgttgagaaggttggatgttccagcaactaagatgtggtaaattttgtagtagggggagtttaatagagcatatgaagaacgaggtttgggctaagtcaaaaatgttccagagactcgagtagaggtgccagactggcagttgaacacacaggaatggagttcaatggaggtgttcaggatggagacatctactatatgatagccagcgtgtacaccatggtaaatctgtgggtcagatttaggaatagacatctttagattctggaggcaatgctgttagggagaaggaaggggaaggaaggggctgaggactggatctttctgttgggcacctggatggggttgctgggcatcacaaagacagatgagggagtggatggactgaggatatgtgtgtgtgtatttgtgtgtttatgttggagatggcctttggaaaataaaggcttttgagggggagagtgcacataaaagttggatggtgaggcatctccacaaaagaggtgagatgatagtgaggtctgggaggggcttagtaccctattatggactcaacagggttttgtggcaaatattggttgtacctgggtagtttcacgcgaactctgagactattttggcagaagatgggatcatctagaagcattgctagtcctggggtggggatggtgttggggaggtcagtgtatctgggctttggattagagttgggggatagagaaagtcgtgactgcttatgggacaacatatacatgtagaagggggagacagccaagatctggaactcaaaggaggtgtgcaagaatatgtgggtttggaaagctgaggtcaaagaaagaaacaggattgggttgggagacgttcaaagcaatgtttcctaaacattgcattctggtcattctaggggcaaatacgattctggttgcatttgtcatgcactgcaggatttcatgtgcagagtggcatggtaacacgccatggaaatactcccagttgggctgtggtggttgttagtgttgccaagagtggaggtgttggatacatgagggaggtgccatccaaagcctgagtggaggagcatgaatagatggttccacctctggcactgggcacttaagggaggagggtgagtccaagtttggttatctgagaggcaagatctgggtgactctagggaaattgagtgacaaaagaaaggtaggcccccatgtgccaggtgttttttttgttttgttttgttttttgagatggagtctagctctgttgcccaggatggagtgcagtggcgcgatctcggctcactgcaacctctgcctcccaggttcaagcagtactctgcctcagcctcccgagtagctgggattacaggtgcctgccaccatgcccggctaatttttgtatttttagtagagatggggttttactatcttggccaggcaggtcttgaactcctaaccttgtgatctacctgcctcagcctcccaaagtgctgggattagaggcatgagccaccatgcccggccatgtgccaggttttgatggcgcttttcagtctctttcccccacccatctttgttctatactggagtcagtgatcagtggcaatgaggggagagcaggtacaggtgccatgaagacctagtgtctcttcctccttcagaagtgggtggaggctagcagggtgtggatgtgtgtgggtgtggtgaggagcactgaaggtcctggagagggaagtgtatcagtgattgtacccacaggatttcaatctgtgaacaagagtgagtgattacagaaaagccaatgacattgaaataattttttttttcaattggtgagaaatcatacctggatgaaatgatttttattcctttcatttcctgagtgcagggagcatgccacatcacataaagccacagaggaaatagcggatttggtcaggtggcagatgcacagttgaagggagagcatatatcagtggctttattggggttttggctggaaaggcatgcaggggagagtgaagagcttaagactgggtagtttgcatgattttggcagccttggggtatagggactatccctccttttgtggtacaagccttgtgttgatttagggcaggagaaagaatcatgtgtgattgttagataggaggcagttcagtctatgggatctggattataagagaaatgttaaaatgctggttgttattttggtcctctaattcttagatttcaagtagataaatacagatctaaggaaacagaataagaagttgctcatgggccgggcgtggtggctcatgcctgtaatcccagcaatttgggaggccaaggcaggcagttcacgaggtcaggagttctagaccagcctgaacaacatggtgaaaccccatctctactaaaaatacaaaaattagccagtcatggtggcacgcgcctgtaatcccagctactcaggaggctgaggcaggagaatcacttgaatccgggaggcggagcttgcagtgagccgagatcacaccactgcactccagcctggcaacagagcgagactccatctcaaaaaaaaaaaaaaaaagaaagaaaaaaaaagttgctcacagactaaactgttataattttggcaggattatatggtttttgaggacgtggccatacatttctcccaggaggagtggggaattcttaatgacgttcagagacacctgcacagcgatgtgatgctggagaactttgcacttttgtcctcagtaggtaaggccctgacacctacgtcagtgtcttgtgctgggcaatgttttttcacttttttccttggcatctccgtctcacaccaggtcatggatgctgcatcctctcctggtttcctggcatatgtgttgtggcagctacagctgggctgtgtgatctgtatcaattttccttaagaagcttagctcttgtcactctgaagccttataaggctcaaaagtcagaagtcctcaggtttctcaagaatatcctaatgaccttgcctgtccctggttagtttactctgtccaaatgcatgacactttctctgtgcaaggctttctccattcttcttgctgacatagggataccctgtgtcaggaatttcagggacctacctcgtcactgcttgtgaggactgtgggcttatttctgcaggactctccactagaagttctggtaactttagaatacagcatgtcctgggtttattgctctgtgtacatgctgttgacaccctccctttccctgtctttcccctagcttggctaacgccacacctagatagttgctcaccttgagcaaggtagaggtccctgggtgcctgacagagtggacattactccattgaaggcaagagatgctcaaaaggacttggccctggtggatgggagctcagaaggggtgtgatgacagggctgggttcacatcacactgggaatcaatccagtttgatgcccctgccagtggccacaccgcatgtctctcttttcttccctattgtgatctctcttttgactttcatctcctggctcccacctctgaccctacgtctctggcctccacctctcacctgttcccgttttttgttttttttttgtttttgtttttgtttttgagatggagtttcgctcttgcaatggtgcgcgcgatcttgactcactgcaacctctgcttcccgggttcaagcgattcttctgcctcagcatcccaaatagctgggattacaggcatgcgccaccacacctggctaattttgtatttttagtagagacggtgtttctccatgttggtcaggctggtctcgaactcctgacctcagctgatccgcctgccttggcctcccaaagttctgggattataggtgtgagccactgcacccagccacctgttccttttactgttccctttgtagtgccctcaacatatgacctgtacttaaggtgttgtgaggtctggatgtatatatttcagcagtccctgaacaccagctctactgtcacatcagatctctctgggtctggacacagtcttctacacattgttcaccagaagctatggcctgttgaaagccattcactgaggagtaacttggggactccacttctgtgctctgcactgtaccactccctatgttgttccccatcatcaggactctttcgttatgggtttctgtcagtcccggttctgcccagtaggctttcctctcactggctttaatgtcccatgcctgtcaccaatcccatggtcttatttgtgagttggtctgacagacatttgttatggggctgcctcttccctccaaagtcatcatgcacttcatgagcatttctgttttaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtg

SEQ ID NO: 1410 - DNA, 10500 bp, Homo sapiens
gacttctggcggcgccctcatggttgcgttagcatggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggtgcgtgcagcgtcccaggccgccccgcccaacccctcctcccagtgctgaagtcccaaggagccgccctgcaggttaggcccttgtgtctctaagagaggggcgttcttgtgtggggtgcccgggactgggactgcggtgcgatgaggcgggggagctcccgtcggagaccgacacgtctctggggcttggaggcactgcagaacgggcggcactggggagcccgagcgtctttgtctccaaggagcagaggttgaggcggagtctcccctggaagggcagtggagccgcagagagccatagagggctgtgcagggaggacgaatgggagggtcacgcccagagttagaagtttaaagttggggaaaacaggatgttgaacgggggcagggggaccgctgaggagaccccttgagttatggtagggctgggccagaggggttgcagtagaggggagatgtgatgagactctggatggatctcagagatagggtcaacaggatttcctgctgcatcaaacatagctgtgagggaaagtcggtagtgaatggtgtcttccataggttttgttttggcctgaaaaatctgaaagaatggaattagagatatcagcttaaggagcgggtttcagacagaagatcctgggttggattttgggcgacatcacatgggtaggtggacgtaatttccaaaggtgagggaaggtagctggcctggagctttaaatgagttagaagttgtgcacttgagaagttggcctgtggatcagattgagaaggaagaatcctacatcgttttttcatatgggctgaggtaggggagggctcagatttggaggaaagaccatggtagggagggcatctctgatactccctgcagaagggagcagatatgggctaagagtctggtctgtttctgttgaaaaagaggcctggatggataaggagttgccctggaatacagagactgaggcatgagataattgtagtcactccacccttctaactcagctggccctgagggccactctttagggaacaagataaggccatgcagcaactgggtccaaaactgggcagggctttctcacatcctccaccacagttaagggcctccagcaagctccctttactgcattatatggcaggctgacctgtttgctgaacggaccagtaactgattgactgctcagccccatcctacaactcattaacttagggatgtaaaaacaggtaattgacttaaacagtaaggaactatatcaatcttaaataaccaagcaagtcagaatctagtttaaagagagtttattcaagttcacatgttgatgatagccatctgggaccatagattcaagttgtcctgaatatacacttcaattaccacagtgacaagtgtttgctttttttttaaggaaaaaagaagcagtttctgagttgtttaccaataacttatgttaaaataagataagtttttattggctatacattcttatttatattatagattacagaaacatgaagataataggtgagacagctagtcaggaacagaatgtcttaaaacagttgtcctcaggcataggttcagggatgtgactgacatctcatatattcttgcctctctgagcctgatacattttgtgtaggtcagacaggtctgggctatttttttttttcctcagccaatatccttctaaatatgtacacataggcaattggaaatagatgtaatcaataatttaaatgtattaaaatatttattgttagaatgttaatttacctgtaactctgcttatagtacaaagctttatatatatatcacatttccttaaaacattaagaagtgtgggctgggcacagtggctcatgcctgtaatcccagcactttgggaagcgaaggtgggcggatcacgaggtcaggagtttgagaccagcctggccaacatggtgaaactctgtctctactaaaaatacaaaaattacctgggcgtggtggcgggcgcctgtaatcccagctacttaggaggctgaggcaggagaatcgtttgaacccgggaggtggaggttccagtgagctgagattgtgccattgcactgcagcctgggcaacagggcgagacactgtctcaaaaaaaaaaaaaaaaaagggaaaaatactcaaattttcaaaacccttctactttgtgctgaaaacatgtacaaaaccattaatcctatagaaagtaatgcttatacatagtgtgtactacttatgcttcttgtcaatatgagccctgtgaagtgggaacccttttaatctccattttacacataagggcactgaggcttagggaggttcagtccttgtccaaagacacagagctgctaagaggcagcactgaacttaggacttgctgtagcttcagattactttgctccagtacagggcagagatggttgtacagctcagcctgtaggatgccacagtactgtcctgatactcatggcttgcttcttcctgttacaggccgaaagaatgagggtcgtgatcaactcagtatgccactggaggctatatgagtaaacagcaaactgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaacagtttctttcgtcttaagttttcatttctacgttcgtcccccttcattcagtctcgtaatgatggtctcaagtagtaacagtaactgtcgtagtgatggtctcaagtagtaactgtacaagtctgccacatcttcccacagggtccattgcagtggcagcaatgcataaggaccctgcacaggtaagtcaaggatttctcaggctctctaccccaggcccccaccacttatctctccgttattttaggcatcctgatatagggaaaggtggtgtcctgaaacttcatgtttttcccttccttgggtctgaagactgtggttccacgacaaccaggagtcagaactcagcctctggttatagagtggtcctagttccgacaactgatgggataagatgtggcagggcgttcaggcacgggatatagaaagttcaaatgcttactggtgcgacttagctgggatgtttagtgaactgaaaatccatgttgtatctggtcgtgatagagtatggcagcagggtaggaggttggggcatacagggcatgcgggatcggcatggaatggcagtctaaggttctgggcctttcatctgagggcgatggtaactagggaaggtttgaggaggggggaaaaagaggtgacctgacccaggttttagtggctccctctgcctgcagaatggaagaccacgtgcaggtgagggtggagccaccgatacctgggtgatgggtccagcaacagcccaggtggaggttgttggtgactgaacgagagtggcggtggtggaagtgggaggagtggggggcttctgtatgtgtttgatctagagctgcctgtattttataacgtagagagcaaggaagcttgggagctgagatggaagagggggtcaggaatggccccacagttttggccttatttggaaggatggatgtcccagcaactaagatgtagtaagttctgtagtagggggagtgtttatatagtagagcatatgaggaaccaagttttggccaagtcaaaaatgttccagtggccaggcatggtggatcacacctgtaatcccagcactttgggaggcagaggtgggaagattgcttgaggccagcctgggcaacatagggagactctgtccctacaaataataataaatagctgggtgtggtggcgtctctctgtggtctcagctaatcggcgtgctgaggcaggagggtcacctgagcctgggaagtaaaggctgcagtgagccatgattgtgcccctgcactccagcctgggcaacagagtaagacaaacaaaaacaaaaatccaagccaaaacaaaaacaaaaatacacaaaaaatgtttcagagactttgagtggaggtgccaggctggcagttgtacacacaggaatggagttcattggaggtgttcaggaaggagacatccactacatgatagctgaactgttgtgaaactgggtcagatttaggaagcaatggtgttagtaggaaggaaggagaaggaacagactgaggactgggtgtctccactgggcacctggatggtgttggtgggtgtcacaaagacagatgagagagtggatcgactgagggtatgtgtgtgtatgtttgtgtgttatgttgggggcagcctgtggagtataaggaagggcttttgaggggagagtggccatgagatggatggtgaggcatctccacaaactcaccagggtttcatggtgagtcttgcttggacctgggtagtttcatgcaaactgtgagactactttaggggaagatgggatcagcaaggagcattgctaggcctggggtggggatagcattggggaggtcagtgtatctgggctttggattaggattagggggatagagaatgttgtgactgcttatgggaaaacatgtacattgcaaaagggggagacagccaagatctggaactcagaggaggtatgcaagaactgtgaggttgtcacttgggttttgggggggctgaggttaaaccagaaaacaggactgggaagggagaccttcagaacagggctcggtgctgccccaggcgctagggaacattatattctgggcagcccaggagcaaatagggttctggtgcactgcaggactccatgtacagagtggcatcttgggaggccatggaaatgctcctggttgggccagggctgctgttagtattgcaagagtggaggcattagatacatgagagaggtactgtccaaagcgagatgcgaaggtgaggaggagcatgaatgcgtggtcccagccctggcaatgggcacgtaagggagaagagtgagcctgagtttgggtgtctgggaggcaagatctggagaccccaaggaaatggggtgacaaaagaaggtagggccggccgggcgcagtggctcatgtctgtaatcccagcactttgggagaccaaggcaggtggatcacgaggtcaggagttcgagacccgcctgcccaacatggggaaaccccgtctctactaaaaatacaaaaattagccgggagtggtggcaggtgcctgtaatcccagctactcaggaggctgaggcaggagaattgcttgaacctgggaggcagaagttgcagtgagccactgcactccagcctgggtgacagagcaagactcttgtctcaaaaaaaaaaaaaaaaaaaaaaagagggtagggcgccctgggctaggcattgatgatgcttttgctttctccccacccatctttgtgctgtgctggactcagcaatcagtagcagtgggggcgagagaagtgcgaatgctaccaggatgtggagtctcttcctccttgggaagtgggtggaggctaagcaggggatggatgtgtgtgggtactggggaagcactgaagattctggagagggaagtgtatcagtgattgacccgctggattttcatttttggaaaagagtgagtgatgacagagaggctaatggcattgaaataattttaattactttcatttccttagtgcagggggaatgccgtgctgcaccaggccacgggaaatactagatttggttaggaggcagaggcatgactgaagggaaagcatatatcagagactgtattggggttttggcaggaaaggcatgcagggtgggatgaggagcttaaaactcagtggtttgcataagtctggcagccttagggctaagagattatcccttattgtgtggtgacagggcttgtgttgattaggacaggagaaataatcatgtatgagcattagatagtggttcagcatatgggatctggatcgcaagggaaatgtaaaaacattggctgttagtttggccctccaattcttagattttaagtagataaatacagatctaaggaaacacagaataagaagttgttcatagactgaagtgtcataattttggcaggattgtatggtctttgaggatgtggccatatatttctcccaagaggaatgggggatccttaatgatgctcagagacacctgcacagcaatgtgatgttggagaactttgcgcttttgtcatcagtaggtaaggccttcatacctactctggtgtcttgtgctgggtgctgtttttttgctcttttccatgacaactctgtctttcccacaccagattgtgagtgctacgtcctgtcctctcctggtttcctggcaaatgtgataaggcagccagagctgggctgtgtatactgtaccacctccccttaagcagccccagcttctgttgctctgaaactttacaagataaggctcggaagtcagaaatcttcaggtttctttaagatatcctaatggcggtgcctgtccctggtttgattactctgtccaaatgtgtgaaacctctgtccaagggtttccctgttccccttgctgacatacttggagacagtgtctgtgctaggaatttcaggcacctccctggtcaccacttgtgaggattgtgaagttatttctgcaggacgctctactgggtgttctggtagctttagaatgcagcatgtcctgggtttattgctctgtgtacatgctgtcccctccctttccctgcctttcccgtagctggacttatgccgcagctagatagttgctcaccttgagcaagggggaggtctctgggtgcctggcagagtggatagtcctctattaatggcaagagacactcagaaggacttggccctggtgggtgaaagctgggaaaggatgtgatatcaaggctgggttcaaatcacattgagaacttaccttgtgaccactattgtttgatgcagggccactggccactcgtcactcttcctttccttccctgttgttatttttactctgacttctgacccctggcttccacctctgacccctcctctccagccttcatctctccaccattctcttccacctctccctttgcagtgctgtctaatgtatgacctgtactttaggtgttatgaggtctgcgtgtatccttcagtagtccatgaatactcgctctcacacaatcagatctctctggatctggacacaaccgtcatggcctgttgaaagccatttatagaggagtgagttggagaccccacctgccctccctgcatggtacttctcccttgtgtccttaccaccaggattcccccactacacacacttcacaggcccacctctgaacactgggccttcctctcactggccttatttccttgcctgtgaccagtcctgtgccctcatttgtgggtgtgtctcacagacatttgtgatggggctgtctcctccctccggagttcacgtgcacttcaccagcatttctgttcttacaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttcaaggtgaacagaatgatttcaactccagccaaggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaaaattcacagtgaaggctttctttcaaaaaggtctgaccccattgaacatcaggagattctcagtagaccaacaccttatgaatgcacccagtgtgggaaggcctttcttacacaggctcatctggttggtcaccagaaaacccatactggagaacagccctatgaatgcaacaagtgtgggaagttttttatgtataactccaaactcatcagacatcagaaagttcacactggggagaggcgttacgagtgcagtgaatgtgggaaattgtttatggacagcttcacactcggtagacatcagagagttcatactggagaaaggccttttgaatgcagcatatgtggaaaattctttagtcaccgctccacactcaatatgcaccagagagttcatgctggcaaaaggctttataagtgtagcgaatgtgggaaagcctttagcctcaaacataatgttgttcagcatctgaaaattcatactggagaacggccttatgagtgcactgaatgtgagaaggcctttgttagaaagtcccacctagttcagcaccagaaaatccacactgatgcattttcaaaaaggtctgacctcattcaacacaagaggattgacattaggccaaggccttatacatgcagtgaatgtgggaaggccttccttacacaggctcatctggttggtcaccagaaaatccatactggagaacggccttatgaatgcactcaatgtgcgaaggcctttgttagaaagtcccacctagttcagcatgagaaaatccacactgatgcattttcaaaaaggtctgacctcattcaacacaagaggattgacctcaggccaaggccttatgtgtgtagtgaatgtgggaaggccttccttacacaggctcatctagatggtcaccagaaaatccagactggagaacggcgttatgaatgcaatgaatgtgggaaattctttttggacagctacaaacttgttattcatcagagaattcacactggagaaaagccttataaatgcagcaaatgtgggaaattctttagatatcgctgtacactgagtagacatcagaaagttcacactggagaaagaccttatgagtgtagtgaatgtgggaaattttttagagatagctacaaactcattattcatcagagagttcatactggagaaaagccttatgaatgcagcaactgtgggaagtttcttagataccgctctacattcattaaacatcataaagtttgcactggggagaagcctcatgagtgcagtaaatgtagggaattgtttaggactaaatcgagccttattatacatcagcagtctcacactggagaaagtccttttaagttaagggaatgtgggaaagacttcaacaaatgtaatactggtcagcgccaaaaaactcacactggagaaaggtcttatgagtgtggtgaatccagcaaagtgtttaaatacaactccagcctcattaaacatcagataattcatactggaaaaaggccttagtggagtgaatgcaggaaagtcaccaaaactgtcacctcattcagcaccaaaaggttcacatcggaccaagaacctattaatatatgtaaatctaatgttgaaagagttcagatggaaatctgcgaggatttcctgctgggaactacattaaaaacatttatgtccaggcgtggtggctcacgcctgtaatcccagcactttgggaggcagaggtgggtggatcacctgaggtcaggagtttgagaccagccgggccaacatggtgaagccccatctctactaaaaatacaaaaattagctgggcatggtggcaggtgcctgtaatcccagctattcag

SEQ ID NO: 1411 - DNA, 10281 bp, Homo sapiens
caggattggccctggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgagtggacgaggttttggccttgctgctgctctgctacttctggaggcctcgtgggcaggcagaagccaagacagccacaggatgtttctttgtcgccgtcgtttatttaagagaagtggccgtagcttgtcatttcctttatccgcagtcctgcaatagtgttggcctccgacaggtgctcagtccttggtagaaggatgaatgatgcttccttcatggatctcatcacacttcccttaaatccaacctcctctgttgcctgccagcccctaccccatccacctggccaaccacccctgaccttgtctctccatttttcccttgtcctttgctcttcagagccaccaacctgaccgtgcagtcttcttcctttttccaggctttctctttgcacttccctttgccttgaacactgcccctataacttcgcagggcctccctctcatatctttctggcctctgtccagatgtcacctatttggaggtggctttcttggcaattccggctaaagtggcgccttacgcacttgcccatttttggcaatgtgtggcatttttgtatagagaatctgacgatattaaagaagcttgccgtttgagttggtctaggatgttatgtgaacaaagagaaacgaaataattgcaaagagtgacagctgatcataaagagtccttgctgtgggctgattggcaggcattatttaaccctcagctcctttaatcctgaactccttagaattaggttctcttgtcctcactgttttacacaagagcagctggaggctcacataggttcaattacctgccttacatcactgtagctcttaagtatcagaaactaacaactggtgtgtctaccatcacagcctgtgtttttaccctcttctttgcccgcaatggttagggaggcctgggggtgacacctaaagtaaactttgcaagttgagcaggcttccttctagcaggtggtcttggacatgaggagtcatggcatttcatgctggtggaactgtgtggactaaaaaaaaatggtttattggttgtttaaggagtccgcaggggacccgtgtggcttccacagtggtttcctgagtggttttctcctataccagctgacacatgtcttgggacacaagattttgtggtcttttgctagatgtgccttcctccttagccaggacagacatagccagtcaggggcccatgttctcatggctacaacctgctgtgtcctctgtgactcttgttccttgctcctgaagtatcctgacctcagggatacttgttggtaggactcaaacaggaaaaggtagtgatagctcgttgtggattcttcctatgagaatgggcatctgtgaggcccagaagtgtccgaggcagcagatgcaggtccaggccctgccacttttgaggcaggtgccaccacctcaggtgactcttctgtgaggtaggtgattatgactatgctgctctgcccaggtccatgaaaatatttcaagtggctaaccccagcacagtggcatgtgtctgtatatccagcttgggaggctaaggcaggaggatcatgagttcaagcccaacctgggcaaaatattgagaccctgtctcaaaaaaaaaaaaaaaaatcctgaaaatattttcagggtggctcaaatggatgtatttcaatgtttcccatcctcattaactgtgcattaactttgctaatgaaggagtgtcgggttgcatgattagaacatagaccatagggccctgggttcaaattctgtctctcctgataagagatgtgactttgggtagactagtggaggtcctggacctcaagtctctgagtgtgacatggagatgatgatggtgaactcaggagctgtggccctttgccccagtgtttcctttacagcttttcttcagatcttttgactattcttggtgaagtggaaaaccctgttgtgttgacctggacatcagggctcagataaatgaaatgagatttccaaggtcacatagcaggcttgtgttgatttcaggaatttggttttaaacctcaggagtctgactcctgagctggggacttttagtcactttaccatggcatgtaaagccattagcatgaggcaggctcacagggaggatcggtaagactcaggtgctgttcttgttgttgttgctggtgttgtttttgttattattctttcccattcctctgatgtctcagagcacttactgtcttgcctctcagtccccttaggattgtcctaaccttatttctgtgtgaagtggctttctgcataggaggcttctctctcttcactgctgtaatttttttttttttttttgagacgagtctcgctctgtcacccaggctggagtacagtggcacgatctcggctcactgcaagctccgcctcccgggttcacgccattctcctgcctcagcctcccgagtagctgggaatacaggcgcccgccaccgcgcccggctaatttttttgtatttttagcagagacggggtttcaccatgttagccaggatggtctcgatctcctgacctcgtgatctgcccttcatggccccccaaagtgctgggattacaggcgtgagccaccgcgcctgaccgacactgctgtaatttatccaaggcaatgtccacattgccctcatgcctggcacagatcatggccctctagagatgcttggtgatttgattcttgggtcactgcgcatcttttgcagtgctgaagtgacaagttctagttgtattccacagttccaagggaaacactactatctctgtttaattttccaggtgtctgtgacctttgaggatgtggctgtgacattcacccaggaggagtggggacagttggatgcagcccagagaaccttgtatcaggaggtgatgctggagacctgcggacttctcatgtctctgggtaaggccccttctggtcctgtgctcccttaggattgagttctcctactcatgttcccctctctcctccacagcccacttgttctgaggctcctggcaccacgcaggggtgttcaccattggctctgagcgtagcacttgggagaccagggtctggtgtccaggagtccactcccatctccactgctcatgatccctgtgttcctgggcaagttaaggaatccctctgtgcctcagtttttctcatgaataaaaagggccaggccaggcacagtggctcatgtctgtaatcccagcactttgggaggccgacgcggacaaatcaggaggtcaggagtttgagacaagcctgggcaacatggtgaaatcccgtctctactaaaaatacaaaaaattagccgggtgtgatggcgggtgcctgtaatcccagctactcaggaggctgaggcaggagaatcacttgaacccgggaggcggaagttgcagtgagctgagatctcatcactacactccagcccaggcgacagtgtgagagagactccgtctgaaaaaaaaaaaaaaaaaaggccaatatagtatttgtttcatagggctagtgtgagggcaaatggttcagtagagtgtgttgtgataggtggctgggcgcaggttagcaattgtgacctctgttgctgtcactattgtcactgctgtctaaatcattgtcctcataatcagcagtatcacacttggactccgcagtttttggaacaactttgtatagttttttagttaaattggccagatgcttttgatgactagactcaggtgtacattttggcttggccattcgccatttcccagattttggcaagtcactttatctgcctgagcctcgatctcttcatctataatgtggtcctgattgcagtacattcttaatgtgcatcctgtgaagaaatcctaaaatagaatttttcatgcagggaccataggagtagcaatgtaatgctttgcttagaatgtaaaaaaaaagccttaggtcagtgaagaaacttacctttctcctgaatggagactcagtatctcaaatatgttatttcttttctaaactaatgactaaatttaattgagtgtttataaaatacaatgcatttaaattgcttggcatattccctaggttatagttacattgtataaatatcagttattgacatactattaggagtaaagttctatggccaggtggcatattgattaaggacttggatttgagagccacagcagcaaagtctctccaagaagtgacatttgagctgagacccaaagagtgagttgattagaaggagcaagatagaggagcaagtagtattccaagtaggcaggctggcatgtgcaaaggccctgaggtggtgaagagcatgatcctgacaaagctgaaggaaggtctgattcccctttttcactgcactgtcattgaacccagtgccaagcacatagcaaaaatgagtgaacatttgcttagagatgactgatgaatcccaccctgtgtttttgtgggtcctactgcctgtgccattaacttctccatagagtacttatgtcttttacccccttatattttgaaaagttttgggctatatgtgcagatcagctcatacagtcttaaccctgaaggaaatatattatctcacctaataagcttagtggtaaggctggctcctgggttggtgggtgtcaagccagttgtctttctttgctcccactttcttttttcttttttggagacagggtctcactctgtaacccacactggagtgcagtggtacgatctcagctcactgcagcctcaccttccagtctcaagtgatcctcccacctcagtctcctaagtagctgggaccacgggtgcatgacaccacacccggctactttttgtatttttagtagagatggggtttcaccatttgccctagctggtctcagactcccaaagcgttgggattacaagcgtgagccactgtgcccagcctctttgctccctcttcttggtaaggtttttaggcaggttccctcacagaattcccaggatgctgcatggcagcaggagtggcagcctccctcatttagcccttcctgaaagagaaggttttttctctctttggagtggctggtataggtcacctgcctacctcagagtacagttgatcagggttgccatttgcaagatgatggagaccaggacttttctactgccatggggactaattataaaatcccttcagaaaatttgtcttaacagggttgagatttttgtaggatggagattaaaagtaattggtactatcacacagccagcactactgcttacagtctttggggcccaatgaggatgttttttttctctttttttgagacggagcttcgctcttgtcgcccaggctggagtgcagtggcatgatctcggttcactacaacctccgcctcctgggttcagcctcccgagtagctgggactacaggtacccgccaccacacctggctaactttttgtatttttagtagagatggggtttcaccatgttgggcaggctggtctcgaactcctgacctcaggtgatccacctgccttggcctcccaaagtgctgggattacaggcatgacccactgtgccctgccagatggtgtttttgtggttgttttatggtcacggttcaacgttttctttgcttggctgagaatagcttcacttcatggtcttccccatcctgcagtcccagatcagattgacaggtttctttcttctaacctaactccctgtgtcctcttttgttctccatgcacaggctgtcctttgttcaaaccagagctgatctaccagttggatcacagacaggagctatggatggctacaaaagacctctcccaaagctcctatccaggtaggagccaacagctgggaaggtgggggtcatggcagcttacacatggaaaagtgaacactgcctctgaattttgtgggcaatcttcttattgtggtctctctgggtgcttgggatccatggagcctctccccgcccgcccccccccacccgccttcagacagggtttcactctgtcactcaggctggagtacagtgatgtgatcatagctcactgcagcctcaacctcctgggctcaagggattctcccacctcagcctcccgggtagctgagactacaggcatatgcaccatgcctggctgagtttttaaaattttttatagagatggtcttgttatgttgctgaggctggtctcaaactcctgggttcaagctctcctcctgcctcagtgttcgaaaatgctgagccaccaagcctggcctcttacatcttaaatttaagtacttccaagttaggtcccagatgtatatatttcactaacgcataataaaaaattatggctaacatgtatttatttcttactcagtgccttgctctctgccgacgatagtatatgtagtgtttcacttcatcttcactatagtcttacaaggcagactctatttttggccctttttgtttgtttgtttccgagatggagcctcccactgttgccctggcaggagtgcgatggtgcagtcttggctcactacaacctccgtctcctgggttcaagtgattctcctgcctcagcctcctgagtagctgggattacaggcgtgcaccaccatgcccagctaatttttgtatttttagcacagacggggtttcaccatgttggccaggctggtctcaaactcctgacctcaggtgatctgcctgccttggcctcccaaagtgctgggattacaggtatgaatcactgtccctggcctttgttttttctataatgccatctctaataagcctttttgtgtattgtgttcgttccaggtgacaacacaaaacccaagaccacagagcctaccttttctcacctggccttgcctgaggaagtcttactccaggaacaactgacacaaggagcctcaaagaactcccaattagggcaatccaaggatcaggatgggccatctgaaatgcaagaagtccacttgaaaatagggataggcccccagcgggggaagctgctggagaaaatgagttctgaacgtgatggtttggggtcagatgatggtgtatgtacaaagattacacagaaacaagtttcaacagaaggtgatctctatgaatgtgattcacatggaccagttacagatgccttgattcgcgaagagaaaaattcctataaatgtgaggaatgcgggaaagtgtttaaaaagaatgccctccttgttcagcatgaacggattcacactcaagtgaagccctatgaatgcacagagtgtgggaaaacctttagcaagagcactcatcttcttcagcacctcatcatccacactggggagaagccctataagtgcatggagtgtgggaaggcttttaaccgcaggtcacacctcacacggcaccagcggattcacagtggagagaagccttataagtgcagtgaatgtggaaaggccttcacccaccgctccacttttgtcttgcatcacaggagccacactggagaaaaaccctttgtgtgcaaagagtgtggcaaagcctttcgagataggccaggtttcattcgacactacatcatccacacgggagagaagccctatgagtgcattgagtgtgggaaggccttcaaccgccggtcatacctcacgtggcaccaacagattcacactggagtgaaaccctttgaatgcaacgagtgtggaaaagctttttgcgagagtgcagacctcattcaacactacattatccacactggggagaagccctataagtgcatggagtgtgggaaggcgttcaaccgtaggtcacacctcaagcagcatcaacggattcacactggggagaagccttatgaatgcagtgaatgtggaaaggccttcacccactgctccacttttgtcttgcataaaaggacccacacaggagaaaaaccctatgaatgcaaagaatgtggaaaagcctttagtgatagggcagacctcattcgccacttcagcatccacactggagagaaaccctatgagtgcgtggagtgtggaaaggccttcaaccgcagctcacacctcacgaggcaccaacagattcacactggagagaaaccctatgaatgcatccagtgtgggaaagccttttgccggagcgcaaaccttattcgacactccatcattcacactggagagaagccgtatgaatgcagtgagtgtggaaaggcttttaatcgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgctatgcacttaggaaaactttcagccacatctttcttcttagtttacagtgaaatattatctcagggatattttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcctggctaattttttgtatttttagtagagacggggtttcaccgttttagccgggatggtctcgatctcctgacctcgtgatccgcccgcctcagcctcccaaagtgctgggattacaggcgtgagccaccgcgcccggccatctcagggatatttaaacaaaggaagaggaaatatagggaagagaaagaaaccacagcttcttttagacttgtctgacaagcctatggcaattttgtcgtccctttgttattttatgtgggagagggaaatgtttcagaaacgaaagatctcatcccctttatttttctgtgtatgcattcactgctgcccagtgtcagaacagttatacaaacgagggcttgaaaacattttgtgaaaacttgcttagtcctgcaacgttctccactctcgaggtgcagaagcatacatctttataaaaaatatggaggcttgagttatgaaacacttttataaggagataaggatgtacatatgtttggacacattgtccacttcagatgcttgtttaaaaaaatgtttcaccatgtgtctttacccaatacacatactttttcttgatgtggatttactttttttttttttttttaagttttcctgggatagggatgatagtgtaattgttcatgcccacagtaatcctgggaatcttagttttttcctatgattgtggtttctcagcttctttacctctcctttgagttaggtccacctcagttttctaaaggtcaaattaaggcccccccaaaaatacagtatgtagctgaattcctttgaaagatcatgataaactcagaagaacaaacatagaaggaatgtcatttttaatctttttaaagagtgtgtgaaaattcactttaactggaattttaacaggcaagccggcatgcatatatgtagggatgtgtgactttcacagttgtcaccatggacttaggcttgattaaaatgctacacatttagagcgttttgtaattccttttttatatttttaagactagattttgagccatgtgatagttttacctcatattaaatatattgtacagaagtaaaaataatcatgtattcactttgaactcctc

SEQ ID NO: 1412 - DNA, 16036 bp, Homo sapiens
gaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggtgggtgccccgtcccaggcccccccccacctccgcccgacccctccttccagtgctgaagcccatagaaggggccctgcaggtcaggccccttgtctcgaagagaggggcgttcctgtgtggggtccccgtatcagctggtttgatgcagcctcagagctcccttcggggatctcaggttcagagcatggaggtgctgccaagtgggccgcgtcggggagcccggagtgtgggttgtttctgcgggaaagagagggttttgtgaattttctcttggaatggcagcctgagcagccggtataaccatggaaggttgtcaagggaagaccagtgggaggggcaggtccagagttagaacgagcaggatggggaattgacacagagagacccagaagaggccactgcagtggatcccagaggctgcaccagagccgtggtataagagggacaatgtgatgggattctggatagacctggaagatagagccaacaggttttcctgccgtatcagatatgtctgtgagcaaaaatagggagtgaagggtcatttttttttttttgcccgaacatctgaaagaatgaagttggggaagtcagcagcatgagaagtaggtttcatggagaagatcatgggttggagtttggccagtgtgattctcaggcgtctcaagttgaaaatgtcacatgggtagggggacagaaaggtgtggagtctacagaggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatcaataataattaatttctttcttttttttttttttttgagacggagttttgctcttgttgcccaggctggagtgcagtggcacagtctcgtctcactgcaccctccgcctcccaggttcaagcaattctgcctcagcctcccgagtagctgggattacaggctcccaccaccatgcctgcctaattttttttgtatttttagtagagacggagtttcgccatgttggtcaggctggtcttgaactcctgacctcgtgatctgcctgcctcggcctcccaaagtgctgggattacaggcatgagccaccactcccggccatgaaatatttttacttaaaaattgggaataagctttctttttctttctttctttcttttttttttttcttttgagatggagtctggctcctgttgtgcaggggctggagtgcagtggcacgatcttggctcactgcaacctccacctcccgggttcaagcaattctccttcttcagcctcccaagtagctaggattacaggcatgcaccaccacgcctggctaatttttgtatttttagtaaagacgggatttcaccatattggtcaggctggtcttgaactcctgacctcgtgatccgctcgcctcggcctcccaaagtgctgggattacaggtgtgagccactgcgcctggccatgaaatattttttacttaaaaattgggaataagcttttttgtgtgtgtgtgtatgtttttgtttttttgtttttgagatggagtcttgctcctgtcatgcaggctggagtgcagtggcacgatcttggctcactgcagcctctgcctcccgggttcaagcagttctccttccgcctccagagtagctgggattacaggcatacgcctggctaatttttgtatttttagtagagacagggtttcgccattttggccaggctggtcttgaactcctgacctcaggttatctgcctgcctcggcctcccggagtgctgggattacaggtgtgagccactgcgcctggctgggaataagctttcgacttgcccaattcagataaattgttttttttttttttttttttgacgtggagttttgctctgtcgtccaggctggagtgcagtggcgcttggctcactgcaacctctgcctcctgacttcaagcgattctcctgcctcagcctcccaaagtgctgggattacaggtgtgagccaccatacccggcccagataggttgatcttataacaatccagaaacaaatgtcatagtcaagatttggtagatagatttaaaactaaaatattctgccattggaagtgaaatgtcatagcacatacgtggacgttatgcatttagagatgttataaaaatgtattggcagtatacatagcactactcaagaagccaaagaaacacttgtgcagtgctaagtgtcacatgtctgcttctgccagaggctaggaatagtgatcttgctataatgtgagaacctgaatcatgtttgtaaaataggaggctgggagcagttccaggccacagtgaagtgtgttgcttctgtcactttatattcttatatttcctttccctcagacaatcaactgttgatgcctgtacttgtgaaaagttgtaaggcaatttttagggttgttgtcaaagaaaagcttggattacattaacatttgtactcagccttttaggcaatacaccagagggggctgggaattgtctgtttgttcctatgataagtagatcttactgtaaaatagtaaatgtccattgaaaagcaagtaacacaacctgtgctaactgggagcacttgaacaattttgttccattctgaataacttttcagcaagtaattctaagctttgtcttatatccttgtgtaaaattgctaccttcatttttaccctatttgatttcttaaatggtttgttcaagaaaaaaaaaaaaaaaaaaaagaatagagggtgtagattggaccgggtcctgaggatccaatttggtagggaagtctaaaggtcattgcctgcaagctatgtggtgagggaggagagagctgatacttggggttcacaccataggtggagccataagccagatgcttactttagaaaggcgcagacctgccataggaaggattttgtcctctgcctagaaaaagggaggcgtgggtgggataaggaatgggcttgggatggagactaaggtttgagatggtttatattctgcacctacaggcttggctgaccctcagggccactctttgtgggaaaagaaaaaagttatccaggctagtggagcagctgggttctaaactagggcactgctttttccccttctccacatatcaaggcaagattggatgatctactgccccagtcaaggtctgccagcaagctcccctcagagccttatgtaacaggcaggcctggttgcagaggaccagtagctgacctacctgctcagcccttccctacaactcattaagaatatatgaaacacttattggtataagcactaaccagtgtccttctaaatgtgtacacataggcagttagaagtgaagctattcattgagttaaattcctgcaaacactacataattgatttgacccaaatttgcctataattatcaacataccatggaaaattttagtatcctctaaaattttaaaagctaaaaatatacacctcagtttttgaaattctactacatcatttatactgaaaacatatagtaaaccattaatccaagaacagtaatagctgatatatatgatgagcaacgagtgtttgacaccggtaagagtcctatgaggtgggagccattcttacaacctatttacagatgagagcactgaagctccagcaggttcagttcttttctagagtcacagtgctgctaagagccaacagtgaagtcggaggagctgagtttatacaatcaacttgagatcagtttgctttagggtaaggaagaagagatggtggtccaactctgcctgtaagatcttcccatcgttgcccatttctcacggtttccctcttccttcagggtcccctggcgatggcagaaatgaaccctgcacaggtgagtggagtgttttctacctttcacctaccagttatctcatagatggttttggcacctccatgtaaagaaaagtggtgtccagagactctctttctgtctttctccctctcttatgtctgaaaagtgagtgattccaccagttctagtatcttaaattaggtctgggatttttgtttgattgttttaagtttactgtgacaccttacctggatggccctggattatgtggagtggctcccatttttgacagttgacgtggtaacatctgtcagagtgtcatgggcacaagattaagaatgtttcagtgtttagaggagagactgaactggatttttagggaactgcaagtgtctgttatatcggataggaatagggagcagagtgggaggtggctagagacacacaaacatcaggcctggaatgacagcctaggtcctgggtctctaatctaagggaggtggtagatggggaagatttgaagcagaagagggcagtgataggaccctagcttaaggaactttctttggcgtctgagtggaggacagactgtggaggtgagggtaatggcagggagatctgagaggatgttcctgcagcagtctaggtggatgttggtggtgacttgtcaagagtagcggtggcttcaggatgtgttttgaactggagctgcccacattttatgatgtagagagtgaggcagctgggggggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctggtggaggagttcaggttggagacgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggagggtaatagggtgaggtcggagagttgctaagcatcagttggaatgagatgaggatgggaattctattagtctgttttcatattgctacaaagaactacctgagactgggtactttatgaagaaaagaagtttaattgactcacagttcttttttttttttttttttttttttgagatgtggcccaggctggagtgcagtggcacaatctcggctcactgcaatctctccctgccaggttcaagcgattcttctgcctcagcctcctgaatagctgggacgacagactcaccccactacgcccagctaatttttgtatttttagtagagatgggctttcaccatgttggccaggatggtcttgatctcctgacctcgtgatccatcctcctcagcctcccaaagtgttgggattacaggcgtgagccaccgcacccagcccatagttcttcaggcttaacaggaagcataactcggaggcctcaggaaacttacaatcctgtgtccatgaggcaggacacagctgagagtatgtgaagtcctcacatggtttgggcacctgacagtgaagtgagaaacagggccatgtagggaaccttcaacccagggcttagggctgcccccggtgctagggaactttggtgttctggggcaggactgggagtgaattggatgctgagcgtatttgccgtgcaccacctggtttctgtgtgcagagtggcctgttaggaggtgaaggaaatgcctgtggtgtgggctgggaggtgtctgtggaattgactggagtggaggtgtgagagatgggattggagtgctgtccaaagagtgatgtgcaggcaggaggagtgtgaatggagggcctcaggccctggccctggtagctcaagggaggaggatgagtctgagtttggttgtcttgggaggcaagatctgggtgactccatggaaactggctggcaggagaggatggatccccccacgggaggcccacattccttttctaccttatcttccatctgtttcctctgtgtgctggacacggtggccaatgtcaatatggagagaaaagtcactcatgccacctggatgtggtttctcttccacattgggagggtgtagagattgaggaaggaaaggaggtgtaggggagagggatgagttcctggagagagaaaagtagcagtgattgtacccattggggttttttgtttttttttttttagatggagtcttgctgtgttgtcacccaggctggagtgcagtggcatgatcttggctcactgcaacctgcacctcctggattcaagcagttctgcctcaatctcccaagtagctaggactacaggcatgtgccgccatgcccacctaatttttgtatttttagtagagatgggatttcactgtgttggccaggctggtcttgaactcctgacctcaggtgatctgcccgcctcagcctcccaaagtgctgggattataggcatgagccactgtgcctggcccccatggagttttaatttatggatgtgagtgagtgatgccagggacaggccaatgacactgaaagaagatatttattccttacgtttccctaaggaggttacataccacataacacagggccacacggtgaaacaccagatttgatcaggaggaaaattggagtgagtttagtttagtccacagatgctgttggggtttccaagggaaacaaggcagggctggctgtcaggatagtttggctagttttagtaattccaggacacctgggctattgggactgtccctagttgtgcagtacctgtccctgggttgatttagagcatgggaaatactgacttggtttgagaaagttagagatggagatggttaagaatatgtgcccaggatggtaggggagatggaaacacatttagctgttagtttgtccctgtgtttaatgggtggtaaatataagtagaaaataaatagagaacttaagtaaatacagtttgaaaagctgctcatgtattcatctttcccaatttggcagggtcatgtggtttttgaagacgtggccatatatttctcccaggaggagtgggggcatctcgatgaggctcagagattgctgtaccgtgatgtgatgctggagaatttggcccttttgtcctcactaggtaaggccctcacacttgcccagtgtcctgggttgggctgtgttgtctccttttacctgaaggcagctctgcgtttcccacagtgagaccatgggtgctgcttcttttccttgtttcctgacatatgttccatgagagtcaggactgcaatatgtgctgtgtgcttcctttttcctggcagccccatcctctgctgttctgaggcttgcaagaaagggctcaggatccagaaatgttgaaggtgacatagagacccactggccctgtgttctattcaaatgcatgagacctctgtgctctgttgttcccttgctcttgccaatatttcttggtcccttcttgttcctggaatttctggcactgacctgatcactaatttggtgaaccactggcttgattgtgtaggatgtagaaatcttctgtgaagttctggtgattatcgaatgtgagatatcatcaggtgatctctctgggaatgtgctgtcttgtctctttctgtgtctttcccctaggactggtctctttcaggtctcacagactgtcaccttaagcaatggggagggccctggtacccaagagggtggatattactccctgaagggctgtagagactcagagggacatgatcctggttcctgggagttgggaaaaggtgtaatatcacagctggggtcatattactaggaatctgtctggtgacccctgttgtttagttgaagactggttgccacaactcactcttcttttccttcccccgttgtcatttttactctgacttctaatccctggcttccagccgttacctattttcttcaactgctccctctgcagtgccatccactgcatgacctgtacttaaggtgaggtctgcatgtatttgtcagtagtccctgaacaccatctcctctgtcacaatcagatctctctgggtttagacacagccttctacacactgctcactagtcaccagcagccatggcctgtggaaagccatttgcagagaagtgacttggagaccctcctcctctctgcactgtacccctctcttgtgttcttacccatcatcagggctctcccattatgggtatttgccaggtccaactctgcacagcaggccttcttctcattggccttagtgtttgtattacttcattctcactctgctattaggaaatacccaagactgggtaatttctaaaggaaagaggttaattgactcacaggtccccattgctggggaggcctcaggaaacttacagtcatggcggaaggcaaaggagaactaggcatcttcttcacagggcggcaagacaaatgagtccaagcagggaaaatgccagacacataaaaccagcaaatttcatgagaatttactcagtttcatgagaacggcatgggggaaactgttcccatgattcagttctgtccacctggtcccacccttgacacgtggggattatggggattacaattcaagatgagatttgggtggggacagagagcctaaccatattattccaccccggccccccccacccaattttatgtcccttccacatttcaacaccaatcatgccttcctaacagtcctccaaactcttaattcactctagcattaacccaaaagtccaagtccaaagtctcatctgagatgaggcaagtcccttctgcctatgagcctgtaaaatcaaaagcaagttagttacttctaagatataatggggatagaggcactggataaatgtacctattcctaatggaagaaatgggccaaaacaaagcctacaggccccatgcaagtccaaaacccagcgaggcagtcattaaatcttaatgctctgaaatgatatcctctgactccatctctcacatccagggcacagtgatgcaataggtgggctcccactgtcttgggcaactctgcccctgtggctttgcagggtacagaccccccctcagctgctttcatgggctggcattgagtgtctctggctttttcaggcacacgttgcaagctgttggtggatctaccattctggggactggaggacgtggccttcttctcatagctccactaggtagtaccccagtagggagtctgtgtgggggctccgaccccacatttcccttcctgcagtgccctagcagaggttctccgtgagttccacccctgcagcaaacctctgcctggacatcaggcatttccatacctcctctgaaatctaggtggaggttccctcccaaatatcagttcatgacttctttgcacccacaggcccaacaccatgtgcaagccaccaaggcttggggcttaaactctgaagcaatggctggagctgtaccttgccccttttagccatggctggagttgaagcagctgggatgcagggcgccatgtcccgaggctgcatagagcagggggacccagggccagcagctgggatgcagggctccatgtcctgaggctgcactgaacagcctgggccaggcccacaaaaccatttttccctcctaggcctctgggcctgtgatgggaggggctgccgggaaggtctctgacaggcactggagacattttccccatcaccttcgtggttaacattccactcctcgttacttatgcaaatttctgcagcagccttgaatttctccccagaaaacgggtttttcttttctattgcatagccaggctgcaaattttccaaacttttctgccttgcttcctcttgaacactttagcacttagacatttcttctgccagataccctaaatcatctctctcaagttcaaagttccacagatatgtagggcaggggcaagaagctgccattctctttgctaaagcatagcaagagtcacctttactccagtccccaacaagttcctcatctccatctaagaccaccacagcctgggcttcatggcccatattgctaaatcagcattttgatcaaaaccattcatcaagtctctaggaagttccaaactttcccacatttcctgtcttctgctgagccctccaaactgttccagcctctgcctgttacccagttccaaagtcacttccacattttcgggtatccttacagcagtatttcactacctcagtaccagtttactatatttgtccgttctcacactgctattaagaaataccctggctgggcacagtggctcactcctgtaatcccagcactttgggaggctggggcaggtggatcatctgaggtaggagtttgagaccagcctggccaatatggtgaaaccccatctctactaaaaatacaaaaattagccgggtatggtggcaggtgcctgtaatcctagctactcgggaggctgaagcaagagaatcacttgcacccagggggtggaagttgcaatgagctgagatcgtgccactgcactccagcctgggtgacagagcaaaactctgtctcaaagagatacgcgatacttggccaggcttggtggcccactccggtaatcccagcaccttgggggggctgaggtggacgggtcacttgagatcaggagtttgagaccagactggccaacatggcgaaaccccgtctctactaagaataacaacaacaacaaaaattagccgggcatggtggctcatacctgttatcccagctacttgggaggctgaggcaggagaattgcttgaacccaggaagcggaggttgcggtgagctgagatcaagccactgcactccaggctcggggaaagaatgagagtttgtctcaaaaaaaaaaaaaaaaaaaaaaaaaagacatacccgagactggataatttataaaggaaagaggttgaattgactcacagttccgcatggttgggaggtctcaggaaacttaccatcatggtagaaggcaaaggagaagcaggcatcttcttcacaggacagcaggatggagtgagtgcaagcaggggaaatgcaagatgcttataaaaccattagattggccgggtgcagtggctcacacctgtaatcccagcactttgggaggccgaggagggcggatcacctgaggtcaggagtttgagaccagcctggcaaacatggtgaaaccccatctctactaaaaatacaataattagccaggcgtggtggcacgtgcctgtaatcccagctactcaggaagctgaggcaggataatcacttgaacccaggatgcagatgttgcagttagcagagatcgtgccactgcactccagcctgggcggcagagcaagactcagtctcaaaataaataaataaaacccatgagatctcaggagaactcatgatcatgagaacagcatggggcaaccgtccccatgattcggttaccttcacctggtcccacccttgacacgtggggattatggagattacaattcaagatgagatctgggtggggacgcagagcctaaccatattgtttccagaccaaaccgagggtggggctgcttattcttgcagcccaataatgagatgcagatgaactggggaaaaagagagtttttatttctgtaaccggttacagggagaaggcctggaaattattgccaaaccaactcaaaattacaaagttttgcagagcttatataccttctaagctatttgtctacatgtgggtttgcattcatctaaagatataagtgattaacttctctgtaaccaagatctgagtcctgaagaccttcctctggagcctcagtaaatttacttaatctaaatgggtccaggtgctggggtgattacccttatcttgtctccttttaaatcatggaggtttggggagtttccttagaaccccaataaacttattcgtggaggcctggggagtttcttcagacccccaataaaatgtatttaatcctaaacgagtcctgttaagaattccttcattatcttttcatcctttaaggcccaggaaaggcctaggcaaaactcttggtgggcttttgttacattccagcctgtacatgagggcactggctctatcagcttttaatcaacttaaccactcagtcagtgctgaaaccgttgtcatggaagcctgcctgctcagctgttagtgagacctggcctgccacagtaccagggttcatgcctgtcaccaattccatgatcattttcatggggtgtctgactgacatttgtgatggggttgcctccgctcatcacagtcaacatgcacctcaccagcatttttattcttacaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgacgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccacattcttcagtccctggcgaccaccatatttttaagtcattatgactctgactattcttggtacttctcagaagaagaatcttagagtgtttttcattattttttttcacttaggataatatcctcaaagttcattcattttttagcatgtgtcagaaattttaaggctgagcaatatttcattgtttgcatttaccacatttcctttatttctgacatctattcatggacacttgggttacttctacctctggctattgtgaatattgctactacaagcataagggcacaaatatctctttgagaccctgctttcaattcttattgggtaccccaaaaagtggaactgctggatcacatggtacttctaactttaattctttgatgaactgagaaacttttccataaaacttgcaccgttttacattcctaacattccacaaaagttgtgatttgtcctcattctaatccatagaaggcaacatttctaacaggtttctaggtgattttgttgttgctgatgtagggactacattttgagaactgtcctatcccatttttataacaatgcagagcttctctgtaaataccccttgtttctatgttctatcctgtgagccttttcattttgttaatttttcccagtgtttacaaccaggaaatagcttgtcatctttgatacaaaacagaaatctttgcaa

SEQ ID NO: 1413 - DNA, 12703 bp, Homo sapiens
agggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgaggtgggtgtcccgtcccaggctcccccgcccgaccggtcctcccagtgctgaagccccctgaaggggccctgcaggtcaggccccttgtcccgaagagaggggcgttcctgtgtggggtccccgtatcagccgatttgatgcagcctcagagctcccgttagggacctcaggttcagagcatggaggcgctgccgagtgggctgtgttggggcgtcaggggtgtgtgttgtttctgcgggaaagagagggttttgtgaattctcgcttggaatggcaacctgagcagccagtaaccatggaaggttgtcaagggagggacagttggagggggcaggtccagagttcgaagtttcaagttaggaaaaccaggttaggaatggacacagggagacgcgaaaaggccctgaggccactgcagtagacccaggagaattatggttggggctggaccagtgacagtagagggagatgtgatgagattcttcataggcctgaaagatagggcccgtaggttttcctggtgcttcagttatgtctgaacaaaggcagtgaagaaccgtttcaagtgtttgttttgttttttgttttctgtttgaacgtttggaagaatggagttggggaagtcagcataaagagcagatttccgggagaagatcacaggttggattttggacatggtgattctcaaatgtctcaagatggatatgtcacacagacaggtggacataaaggtgtggagtctgaggaaggggattgggttggcgataccagacggatggagggcttggactgggccagagaatggtctgaggatcagattgagtaggtcggtctcgggttttttttgtttgtttgtttgcataaatttaaggagtcaagtgcagttttgttatatggatatatttgcatagtggtcaagtctgggcttttaatgtatccatcgcctgaataatgtacattgtatccattaagtaatttttcatcactcatcttcgtctcatccttctacctgtttggagtctccaatgtttgtcattccacactctttgtccatgtgtacacattattcagcttccacttgtaagtgagaacatttggtatttgactttctgtttctgagttgtttcatttaataatggcctccagttccatccacattgctgtaaaagacatagtttcatgcttttttttttttttgtggcctagtggtattaccttgtgtatatatatgccacattttctttacccagtcatacattgatggataattggttaattccctatctttgctattgtgaatagtgctgtgataaaaatacatgttttttttaatgtaatgatttattttcctttgggtagatgcccagtagtggaattggtggatttaatggcagttctattttcagttatttgaaaaatcttcatactgttttccattgaggttgtacttatttacattctcaccaacagtgtgtaacctttttctcttctccatatcctgggcaacatcagttgttttttgacatttaaatgatagccattctgactggtgtaaggagatactgtggttttaatttgaatttgtctgatgattaatgatgttgagcatttttttatatgcctgcttgcgatttatgtgtcttctttttgaaaaatgtctgccctgtgcttactgttttttttttttttttttttttgaaatggagtctcgctccgtcgcccaggctggagtgcagtggcgcgatctcggctcactgcaacctccacctcccaggttagttcaagcaattctgctgcctcagcctcccaagtagctgggattacaggtgcccaccaccacgcccagctaattttttgtatttttagtagagacggggtttcaccatgttggccaggctggtcttgaactcctgacctcaggtgatccacctgcctcggcctcccaaagtgctgggattacaggtgtgagccaccgcgcccagccctgtgcttactgttaatgagattttttgttgttgtttttttgttatgttttgtttgtttgttgttgagttctttgtaaattctggatattagtaccctgtcagatgcatagtttgcaaatatttcatcccatttttcaggttgtacatttacttggttgattagtccttttgctatacagaagctgtttagtttaattaggtcctgtctacttttgtttatgttgtttatgcttttgaagtcttattcatgaatttttttgcctagaccaatgtccagaaggggtttccctgagttttcctttagtattcttcgttcaggtcttacatttaaatctttaattcatcttgagttgatttttgtatatggcaagagaaattggtccagattcattctttttcatatggcaatccagttttcccagcacattttattgaaaagtgtgtcctttccgtagtgtgcatatttgttgcctttctcaaagatcagttggctatagatatgtggctttatttctaggaactttgttctgttccattgatctatgtgtctatttctgcagtcaaatgctttaccactgagctgtacaccttatgtgtctatttctatccattaccatgctgttttggttactaacaacttgtagtataatttgaagtcagatggacttaatttgagggaaatcttgaggttgtcatttcaggtgggctctgtgttgagagaacagggggctgagacttgggggccagaccattggtggctccacagacatcatactctgtccagaacggtgcagacctggcataacagggattctggattgcatctgtaaaaagggaggcctggactgggtaagcatatggcctgggatggaggctgaagtgtgaggtggtttcgatcctgcacctgcaggcttggttgaccctcagggccactctctgttgaacaagagaaatgttattgaggctggtggagtagctgggttccagatcagagcactgctttttccccttctctacatgtcagggctacaggggatgatctactgctccagccaaggtctcctggcaagctcactttagaagattatgtagcaggtagacctggttgcagaaaggaccagtacctgacctgcctactcttcccttctctataactcattaacttaataatgtatgaaacacttattgatttaaaccccaattagacagtatctttctaagtgtgtgcaaacagataggcagttaatagtgaagtcattatgttaaatttctaaaagtgagccgggtgtggtggctcacacctgtaatcccagcactttgggaggccgaggtgggtggatcacctgtggtcgggagttcgagaccagcctgaccaacatggagaaaccctgtctctactaaaaatacaaaattagccgggtgtggtggcgcatgcctgtaatcccagcttctcaggaggctgaggcaggcgaattgcttgaaaacaggaggcggaggttgcagtgagccaagaccacgccattgcactccagcctgggcaagaagagcaaaactctgtctcacaatagaggagaggagaggggaggggaggggagggcagaggaggggaggggggagggcaggggaggggaggggagaaagtggttcataattggtttgatgttaatttatctcgtttgctttccttggaaaaagttaatatcgcatcctctaaaatcttaagctaaaaacatacatgaaaatttcaaaaccccactctttcatttgcattgaactcatgtacaaaaccattaatcttggaccatagccgctgatatatatagtacatgctactgatgtttgatactaatatgagccctgtgagggggcagctattcttgcaatctatttacagatggagacactgaagctcaggtgggtttggttcttttccatggtcacagagctgcagcactgaggcctgaggaactttattcaatgaattgagatcagtttgctcccaggcagggcagacgaggtggtggtccatctcagcctgaaggatccttccatggctgtcaatttctcacggcctttctcttccctcagggtcccctggcgatggcagaaatggaccctacacaggtgagtagagtgtttcctactattcacccaccctggttatctcccagatggttttggcaggtgacaaaacctcttttcctgtctttctcttatgtctgaagggtgagtggtttcaccagttagtttcagtattacaagttggctgctgggttacatagactggtccccgtttttgagaattgatctgataagatatgtttgggcctcttgggcacaggattcagaatgtttcaatgtttggaggagagactgagctaggtttttagggaactgcaaatgtctgttacatctggtaggaatacggagcagaatgggaggtggctagaggcacacaaacatcaggcctggaatgacagcctaggtcctgggtctgtaatctaagggaagtgggagacggggaagatttgaagcaaaataggtagtgataggaccccagtttaagagactttctttggcttctgagtggaggacagactgtggaggtgagggtaatggaagggagatctgagaggatgttcctgcagcagtctaggtggatgttggtggtggcttgtcaagagtggtcatagcttcagttttaactagagctgcccacattttatgatacagagagtgaggcagctggggaggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctgatggaggagttcaggttggagatgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggggggataatagggtgaggtcggagagttgctaactatcagttgggaggaggtgaggatgggagttgtattaatccgtttccatactgctgtaaagaactacctgagactgggtaatttatgaagaaaagaggtttaaccaactcacagttcttcaggcttaacaggaagcataactgggaggcctcaggaaacacaatcctggcggaaggtgaaggggaagcgaggcacatcttcccatgatggagcaggagagagggagagaatgaagggggaagagccaaacacttttaaacaaccagatctcgtgagaacttactattatgagaaaggcaaggggaaaatatgccctcatgatccagtcacatcccaccaggtccctcccctgacacgtggggattacaatttgacatgagatttgggtggggacacagagccaaaccatatcaggagtggaaatatggaggtcagtgcagctgggcttggaatgaggttttggtggagagcaattttcctgactgtttatgggacagagtgtaccatgaggcaggacacagctgagagtatgggaagtcctcacatggtttgggcagctgacagtgaagtgagaaacagggccgtgtagggaaccttcaacccagggcttagggctgcccccggtgctaggggactttggtgttctggggcaggactgggaatgaattggatgctgagcgtatttgccgtgcaccacctggtttccgtgtgcagagtggcctgttaggaggtgaaggaaatgcctgtggtgtgggctgggagttgtctgtggaattgactggagtggaggtgtgagagatgggattggagtgctgtccaaagagtgatgtgcaggcaggaggagtgtgaatggagggcctcaggccctggccctggtagctcaagggaggaggatgagtctgagtttggttgtcttgggaggcaagatctgggtgactccatggcaactggctggcaggagaggatggatccccccacgggaggcccacattccttttctaccttatcttccatctgtttcctctgtgtgctggacacggtggccaatgtcaatatggagagaaaagtcactcatgccacctggatgtggtttctcttccacattgggagggtgtggaagagattgagcaaggaatggaggcgtaggggacagcgatgagatcctggagagagaaatgtagcagtcattttacctattgggttttaatttatggatgtgagtgattgatgctggggacaggccaatgactgaaagaagatatttattccttgcatttccccaaggggggtacataccacataacacagggccacatggtgaggcaccagatttggtcaggaggaaaattggagtgaggggaaagtttagtttagtccacggacgctattggggtttccaagggaaagcaatgcagggctgggcgtcaggatagtttggctagtttaaataattccaggacacctgggctattgggactgtccctagttttgcagtacctggccctgggttgatttagagtacgggaaatattggcttggtttgagaatatgggcccagggtggtaggggagatggaaacacatttggctgttagtttggccctgtgtttaatgggtggtaaatataagtagaaaatagagaacttaagtaaatacagcttgaaaagaagctgcttatgtattcatctttcccaatttggcagggccgtgtggtctttgaggacgtggccatatatttctcccaggaggagtgggggcaccttgatgaggctcagagattgctgtaccgtgatgtgatgctggagaatttggcccttttgtcctcactaggtaaggccctcacacttgcccagtgtcctgggttaggctgtgttacccctttttacccaaaggcagctctgcgtttcccacagtgagaccgtgggtgctgcttcttttccctgtttcttggcatatatgctgtgggaggcagggctgggccgtgtgttttataccccctttttcctagcatccccatccctgctgctctgaggcttacaagaaagggctcaagagccagaaatgttgaatttggcatagagaccccaccagccttgtctgtccctggtcaggttactctgtccaaacacatgagacctgtgttctgttgtcccctttctctcactgatatttcttggtgccttcctgtgcttggaatttcaggcactgccctggtcactgattttggggactgctgagttgactatgcaggacgcaggactcttctgtgaagttcttacgattatagaatgtgggatgccatgggcttgatctctctgggcatgtgctctttactctttttctctttctttcccctagagagggccccaggcacctgagagggtggatattacttcaacaatggcattagaggctcagggacatggccctggtgcctgggaattgggaaaagggttgatgtcacagctggggtcaaatcaccctgggaacctgtcctgtgttcaccattgtttgttgccagggccactggccacagatttctaccttttcttccccattatcatttctagtatgactcctggcccctgcacctccaatgccccacagtctgtacttctggggccaccacccttcaaccattcttttccactgctccctttgaatgcctgccaacacgtggcctgtatttaacatggtgtgaggtctgcatgtatccctgaacacaagctcctctgtcacagtctgatctctctgggtttggagagaaccttctacacactgcttgccagtctccagcaaccatggcctgttgatggctgttttcagaggagtgagttggagaccctgccttctctctctgtaccatacccctcccttgtatgcttaccatcatcagggctctcccattatggggccttgccaggcccagccctgcatagtggaccctcctctcactggccttaatgtccatgatgtccccaatcccatggccttatttgtgtgtgtgcctgacacacatttgtgatggagctgcttcctcccaccagagtcaacatgcacttctccagcatttctgttctgacaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatccaa

SEQ ID NO: 1414 - DNA, 8622 bp, Homo sapiens
tttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcagtggcataaggtgtggaacggactcgaaggcgcaggggcagttcgtacaaatgcatgcatggagaggagaatgagtttggggagttccgggaactctctgtgcctggtgagaacagggactagggggtcagaggtaggcctggaatggccgcccgaggagctggtcctctcttctgagggtgctgggagtcatgcaaggtttggtacagagaagggaggtcctctgacgcagttcttaaaaggctccctctggctgcagagtgggtagactagggattatagggtagacggggagatcaagatgaagtctactgaaatagtccaggtgagcgttgatggtctgggccagagtggtggcagcagaggttagagaatgtatgggttttgggttttgtatgtattttataaggaaggctgaccagattctctgatgagacatagtgatgatatcctgggattcttcacatgactgtcttcacttgagacagggggcagtgaatggaggtcatttctagtttagtgtcctgaatccaggccatgagttgtatggagttatgtggagaagtccccacctggcgaccaatgggatgagtactgcaaaagtatatcagacctaggaacaggtacgctcaaatgcttgtaggattgagtttggagcgctcagggaatctcaggtcttaattacctttgttggaaacaggtatcagaggaaggagttaggcaggaatggctggccgaggtgtcttgagtgtggtaaaagtcgtgggagatttggagcagaggagggagatgatctgactcagattttaacatgctctctctggctttcaggttgagaacagactgtgagcatgagggagcagctactgcagtagtgttgatggtgtctggtctagaggtgtggctgtggaggtgagagaagttggtaaattttctgttttttaaagtagggtgattggattttttgatgcgaaaggtgaaagagaggagagtcgtggatgaccctaaggttggtttgtttttgctgtagctggtaaaattatgaaaatgccatcaactgagatagagaagttggcagcaggtatgatttttagtggttatatcaggagttaggctttggtcatgtttaggttaagaggtctcagttgtcatcttagttgaggcctcaggaaaacacacaggtttttagttctggggaagggttctgttgaagaagttgaaaaaaatggtggccagtgtgtggagtgggatggggtatcttcaaatcatggtggtaatgctgttattcagtaagaaagttgaaactggacactgagagaaaactgggtctgttgcttaggcacctggacggcagtggtggatagtgtgaagacgcgagcgcttcctggacactgcttgcagagtggcatgggggatgagggatgtcatggaggtgcatatggcatgggccagtggcggtggggatctcagatgtgaggaaggtgtagtccaaagagtaatgagcacgttgggaggagtgtgaactgatgcccttaagactctagtattggcagctcatgggagaagatggagctgaagtttggttgtgtttagaggcatcgtctggacaacaccaggagaactggttggtaggcgagtatttgggacccttcatgccagacccagagttgagacagcatctgtctgcacacttgcctggttctgctctgggctggacacagtggtgagagggacatgaggagagagcagacactagtggtgccaaggtctgttatctcctcttagttgggaggctggggaggcgagggactagagagtgggtgtgtgagtgtgtagactggggaggagggggttctggggagagatgctgactgtggactcagctgtacttatcatggcagagttgtgtgaccttcgaggatgtgttcgtgtacttctctcgggaggagtgggaactccttgaggaggcacagagattcctgtaccgtgatgtgatgctggagaactttgcacttgtggctacactaggtaagtctgtgttttagttatctaatgctacatggcaaattatcccaaagcttagtaactgcaaacaataaaaatcaattatctctccagtttcagtgcattggtaatctggttagagcattttttgttgtttattattttgagggttttttttttgttttttgttttttgttttttcagagagtcttactctgtcacccaggctacagtgcagtgttgtgatcatggttcactgcagcctcaaattcttgggctcaagtgatcccccccacctcaccctcctgagtagctgggactataggtgcatgccaccacgcccggctattttactttttgtagagataaggtcttgctacgttgcccaggctggtctagagctcctgacctcaagcgatccttcctccttggcctcccaaagtgctgggattacaggcttgagccagtgtgcccagcctgatcacaccttcttatgcaggtgcttttggctctcatgaagttttaatcaagctctcagccagtgttgtggtcttacctgagaagaatccacttacaagctcactcacattgctttttgcaagatttagtttcttgtggcttgttggactgtgagcactgttccttgctggctgttggccaaagtcctccctcaggtggcctgtctgtattgtaccttatgacacagaagctaacttctctttgagcaagtgaccaaaagaatgttcaagatggaagcccaggattgtaacctaatcttgaaagtgtcatttcattatttttgccatattctattccttggaaataagtaagtccatccagcttacaatcaagtgaggaggcttacacaggggcaagagtaccaagaggtagggatcactgggaccatctcagaggctgtgttccacaggcctttacacccactccggtgtccttggtggggtttgagtcttcttctcttccccatgggccactctttctgtccatccagatccatgactcttctccttcccttctttgtttcccagagtaggtgctgtgggttctagggctggctgtgttcagtgtttctgccttcactgggtaatctgaacatctgttgccctagagctttgcaggaaaaggttaggattcgggagtttttcagtctgctaagcagattctacacagctcaggtgcccactgcctgagtccgtgtcatgatctttgcacctctttgtcctagattctgccctcatcctctggctgacatttcctggggcctgactgtgccaggaatttcaggggctgacacagtcacttcttgtggtgattacagggctgtcctggtacatccgccttggagagtattttttctaaacattctattttctctgtggagtgggtctacctgcgccactcacctgccctttgtttgcgttacagctttcattttcccagtcccatgcagttgcgcagttggagggggcagaaaaccttgggtgcctgacagggcagacatcactgcagccacagtaaaggagacctacagagggcatggccctgctgaatgggagctggaagagggtatctgttatggttgggttcaaatcgaaccttcaacttgttttgtgtttgtcagtgttttgttgccaaggcccatagtgattcttcacatctactttactttcctcattcttggcactttttccatttgtcatttctcacgtgtcttccatcctttgggtgttttcccacttttctggcctccgtgtttcaattgctctcttcaacactagcttactttaatgtgtcatgagttctgcacattaaatagtccgtgagaatgagctacttatttggagtcagattttcgtgggcatggacatacccatctgcacagagctcacctgacaccagcggccaaggccctgctgaaactctcttgcagaggaatcaggtagaggcttcacctatactccctatactctatgccattgtttttaggtctttacctcatagtcagggttcctccattctgtgaggccctatactgacaaccagcccttctttacactgatcctggccctcttgtcctgccaacaagccagtggactcgcactggtgttagacacacatttgtgatggggctgctgcctcccaccaaagtcagcatgcacttcaccagctcttttttgctttcaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaa

SEQ ID NO: 1415 - DNA, 12703 bp, Homo sapiens; identical to SEQ ID NO: 1413

SEQ ID NO: 1416 - DNA, 1844 bp, Homo sapiens
agtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggtgggtgccccgtcccaggcccccccccacctccgcccgacccctccttccagtgctgaagcccatagaaggggccctgcaggtcaggccccttgtctcgaagagaggggcgttcctgtgtggggtccccgtatcagctggtttgatgcagcctcagagctcccttcggggatctcaggttcagagcatggaggtgctgccaagtgggccgcgtcggggagcccggagtgtgggttgtttctgcgggaaagagagggttttgtgaattttctcttggaatggcagcctgagcagccggtataaccatggaaggttgtcaagggaagaccagtgggaggggcaggtccagagttagaacgagcaggatggggaattgacacagagagacccagaagaggccactgcagtggatcccagaggctgcaccagagccgtggtataagagggacaatgtgatgggattctggatagacctggaagatagagccaacaggttttcctgccgtatcagatatgtctgtgagcaaaaatagggagtgaagggtcatttttttttttttgcccgaacatctgaaagaatgaagttggggaagtcagcagcatgagaagtaggtttcatggagaagatcatgggttggagtttggccagtgtgattctcaggcgtctcaagttgaaaatgtcacatgggtagggggacagaaaggtgtggagtctacagaggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttt

SEQ ID NO: 1417 - DNA, 1567 bp, Homo sapiens
aaatctctaaagaattccctttttaaactttttgatttcctgaacttgtctgaaggacttaacacagttatatagagtgttctttgtgtaacagtatccatgactttcatttttagctctggtattagatcttcctggacaagagcattactggccatgtgtatgttgctatcacaaataactagtagttaatatttcctaaatcttagcaagagttatgataaatagctgaattccatgaagagaaaagactcatggcatgacaaccagattaggaaagagtgttttccttgtcctgcaggcaaaacagaactgagagatatgagtatcactcatgatgaggacaaaagggctgcgtgctgggaaacatgaggcgaccaacacagagttggtcactatccactggcctgggtttgcaactacagttgtccaaattgtcagaaaactatggactgaatagaaaacaaaaaaggagctcaccaggaccatgatggtgtgtgtggctctggcttcctgggaaggtctgcaggagagtctgttgctgtgattgtgttggacttgctgcttgtgtctgtagaggaagaagaccatggagccactggcccagaccatgaagcccaaactcataaaatcaggggaaaaatataagactgcatgtaatgagctaaatctctttgatgctttgtaagaacagtatccataattgttttttgcactactgtttttgctattcagtgggccattcactaatagaagaacagatgcattcatcaagacatggggggcccagcagaggagacaacagaagtcaataaaccttggggatctaatcttgatctccatccacctgcatatactggggttgagcttaatggcttggaatccattgagaaggcagatggtgctgagggaaactcttgtgcccaccctgtgataataaaagacaaacttacatccagtgtcattcagcaaatatttcaatccaaaagctgccattgtctgaggtatccctttaaagaaaaggaccatggagttagccaaggccagttggctgagaatcaagtccgtgggtctcagcttgtgtccagtgaacaaaattaagttataaaaacaaaggagaaaggaatttcccaggatcccaactccagtctgaatgaggaagctaatccctgattttacttttccaaaagccatttcatcaaaatctaggggatgttgattttcattgaggtctgaagaatcagtagaataaaaaagcagaaagaagtatcttgtcatcagtggagacagaagttttaatgtgtctccaaccatattttctcatcttaaacagaaattaagattgtccctgttcgtgcaaaggcaattgcttgtgtgtccaactgcagagaagcaggtgaatgaatgagggctcaaccgcacaacagatccacaaatcaaacctataaaactcagggcttacacacatgcaacaagtaaatacaagcaaaactagggaaatatataaaaacagaacacagaagagtcaatatcattagagtgatattatactatagtttgcaaaatg

SEQ ID NO: 1418 - DNA, 9968 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacctcaatacaccctggctgcgggaagctgggccgggcgcccgggggctgcgcggaggagggggaggcgcctccctcaagggctcagatctactgactatcccgacttactgcgctgagcgggtggtttacagcgagctctgtgtggtatttcagtccctactttaacttagtcctagagtttttggtgaaaatctgcagggccgggagccagggtactctcgttcagtggctcctgtttagtccacggcaaaggtgggacggagtggaagaacgcacagcccccagcagaagcattaccttccacttaagggtgggtgcatcagggctttagaag

SEQ ID NO: 1419 - DNA, 9635 bp, Homo sapiens
gttgcagcttagtaatagttttacttattaacttacttaaaaagagataatgaacatttgtgaaattgtttacaattgagatatccatacacacaagtcatgtgctgtgtgatgttttggtcagtgactgcatatatgatagtggtcccataaaattatgatcctatatttttactgtacttttctgttcagatacacgaatacttaccactgtgttacaactgtgtacagtactcagcacagtgatgtgttgcacaggtgcgtagcttaggagcaacaggctgtaccatatagcctaggtgtgtaataggctataccatctaggtttgtgtcagtgtactctatgatgttcacgtcacgatgaaatcacccaagacacatttctcagaatgtatccccatcattaagcaacacatgactgtatatatacatttactaatgtttgttatttttaatacagaaaagtttcttctttgctttttagaaattttatcagttacaaaaggaaataacatttagaaaacagtttcaactttcataggcaaaacatacacatgaaccacacatagggctgagtggatgtttccttattgctaagtccatagcctctagtatgatgcccaagtgtcataactacactcccacatcagcaaactcctccctcttaatatgctcagtgatttctatctcacccttccttacttcctttgcaattcaagtaagaaaacaaacaatttagatgttcgagtataggaaatatttgccgagaccagcttggtcatggagaccctaacccagaggcgctagagaaattaaagacacacacccagaaatatagcatgcagagtgggaaatcaggggactcacagctttcagagctgagagccccgaacagagatttacccatgtttattgacagcaagccagtgataaacattgtttctatagattatagattaactaaaagtattccttcccaaacgaaacaaaggcatggggtctggctagttatctgcagcaggaacatgtccttaaggcacagatcgctcatgctattgtttgtagtttaggaacgcctttaagccgttttcccgccctgggtggtccaggtgttccttgctctcattccggtaaaccttcagcatggcgtcatggccatcatgaacctgtcacagtactgcagagattttgtttatggccagatttgggggcatatccccagcaaatattggttaagtctgtgcttcagactagatttttcaagtctactggcttgtttgaaaaacgcttttagacaacacatcaggtttgtaacttttcacaagtttaaaatatttcaaaggtctttgaaaattataaaatcttgaaatatctctattttagttttccgaggggtgctgttttgacagatttgaaatttttttatttgaataaaaagccatcactctttcattcaatttagtgcctagatgtttccttagagcctgggttgttgttccaagaatctgtggagagtaccaacttagcctgctgctgcaaagacgaaggaatcctttctcagagaaaactcaagactgaatatggtagactggattttccagagatggctgtggacataggctatcaaagggtttttgggatacacagtcccacatgccccttccctcccattgcattcacaatggatcacctttcgattaaatttcaccagctcatccccggtaattttttatttgactggaaacatgggcttttaaaacacacacagggctctcctttagcctgcagaatgtgggtatatctttactattttctcctgctcataaaaatacatgcttttcactaaacgagttaaataaccacccataattcacccacaagtttggtgtactttcttccagtattttaaatatgcaaaaatatcgttttatttgtatttactacctgtgtaactatatgcttagcctttttccccccattttgagtttatttttaattcagggattaggtagccagagtctggcctagtgacttctgacctttcacttgtgatctcttatccatcttcggccagaggcctctttttgtagcccagcctcatctcttgtggaccttgaacaaatttctccagctactgtcaaatgcctgagatttgttaaccacaccatttatttttgctaacactagttaacaaataagcttttctagaagagctaggtggaatatgtcatcagagacttggaatgaaaacaaaatacccttggtaacttacttgcacctgcgtcttcctcagactgcaaagtggtcaccagcaattcagagaggctccagtaacaagcagcttcactttttatcacgtaacctaaccatcttgaggttatgtgtcaaaggaagaagacatttccttttctaaaaagtcaactgctttcttctttactaaaacaatttaggggctgggcgcagtggctcacatctgtaatcccaacactttgggaggctgaggcaggtggatcacgaggtcgagagttcaagaccagcctggccaagatggtgaaaccctctctctactaaaaatacactaggcgtggtggcacgcgcctgtaatcccagctactcgggaggctgaggcagagaattgcttaaacccgggaggcagaggttgcagtgagctgagatcacactactgcactccagccttggtgacagagtgagagagactccgtctcataaaaaaaaaaaatgtaggtttgtccttccaaattgtttatcaaattttggtagattcaggagttgggtaacacacagtaactgggcagctgatataaagtctgtatttttataactactcaagagccaggaagccagctttctgctagcatctttctcctaacataccattggcacatgaagttattatttcagagcttaattatatttcctgactacacaaaaagccaatgcattaaaaaaaggcccacctttatatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattggggtagctggctgctgtggcgattccacagtggttgttcttgtctttggctatttttacatagccattcgagccccattctggaccccagctgaaagaggagcaggttttccattttatacaaggaatcaagggaaaattggctccattaataataatagctaatacttaaacagtgcttcccatgtgtcaggcactattctaaatgctgttaatatccatttataaatgtcctgaggctgggcacagtggctcacgcctgcaatcccagcactttgggaggccgaggtgggcagatcacttgaggtcaggagtttgagaccagcttggccaatctggtgaaacctcgtctctattaaaaatacaaaaattggccaggtgcggtgcatgcctgtaatcccagcactttgggaggctgaggcgggtggatcacctgaggtttcaggagtttgagaccagcttgaccaacatggtgaaaccctgcctctactaaattaaaaaaaaaaaaaaaaaaaattaaccgggcatgtaatcccagctacttgggaggctgaggcaggagaatcatcatttgaacccaggaggcagaggttccagtgagccaagattgcaccactgcacttcagcctgggcaagaagagcaaaactccatctcaaaagaaaaaaacaaacaaaaaaacccccataaaaattggccaggcgtggtggcgcatgcctatagtcccagctacttgggaggctgaggcaggagaatcacttgaacccgagaggtggaggctgcagtgagccgagattgcaccactgcactcttgcctgagtgacagagcaagactccatctcagaataaaataaaactggctgggcacggtggctcatgtctgtaataccagtgctttgggaggccaaggcaggcggatcacatgaggtcagttcgacagcagcctggcatacatggtgaaaccccgtctctactaaaaaatacaaaaaaaattagctgggtatggtagcacatccctgtagtcccagctacttgggaggctgaggcaggagaatcacttgaactcaggaggcagaggttgcagtgagctgagatcgtgccactgcactccagcctgggtgacagagcgacactctgtctcaaaaaataaataaacaaatgaatgaatgaatatattgattcttgtgggtccttaactatttaagatactgaggcagaactggaattccactgtagcagtctgtccccacatactaccttatgtcacatctcaattaaagaatgctaattgtgagaaaatagattctgacaaccttcaaagcctgagagctggggagtgaaattcgatgacagggcatccaatgacaatagaaggatgcacacagaccactggactcccggatgatctctcagacttaacaaagaaccagcagaggcagatgtttctgcttactattccttgttgaaaaattagacagaaaaaagcaatcagctctcaaacctacaggtccacagtcctttgtctgaaacccttgaggactaatgtgtttcagaatttaaaaattttcaaaacttagtaataaaatattacaaatacatagcaataactccaaaaagcttggtacggaatcttataatcaaacattaatatttctgtgttcactctaagtagaagaaagactttcggaattttgaaattgagcttttgtgaacttgtatccaaatactgatttggaacaaaaattcccttttcaattttgagttttatacctgtttttgacgagccaatacttgctgttattcgaatttgctccttcaaagccgtagccaaccaccagaacaccatgatccaggtttttgctgctgcagtctggttcaaaataaatgcctgggagagtaaaattaatgctggggtgagaagctccaagcgacatgtgacagtaacccaccctaccaccctccataagggaggcatctctaaattcagtaaaatgtcataaacaaatgccaaataaggacccaaacaatattggccggaaaacagtaatggctgataaaggaaaaaagtcaacctcaactcactagaaatcaactaacttcaactaagttcaagatattttctaccaaaaaaaatgaaaatccaaaagataaaacctattgtttacagctaaggtgatttagatatctctgagcccaaataccaactcgcataatccctttctgttcctaggatgtcagtctaaaatagcaccaaaataaacaaacaaaaacttgaaggggattctttacagtcctaattacagtagtaaaaaactttgagaaaaaaaggcccaacaactggaaaatagtttggaaaattaggttgtctctatacaattacatagccatttaaaaatatttatgagaagtttaacataactaagtattttctcatgtcaaatgcaaacatcactatgttaaatgctcactctcaaaatactacattcctgcaaagcaggatgtcatatccaagaatcaatcacagtgatgcttcccaattctgcctaaatttctataataaaatgacacttacctgatttgtagaactggaaggacgaatggcctgcatccatagcaacggagatgggccccacagttgcgactgctttcatcagggccttctcctttccaggtgcgaccactgtgaagccagtgtcattagcaacagaattctcaggtctgtacttacagatttcatccttttaaagttaaagggggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatggtacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgatccgcctgtctcggcctcccaaactgctgggattacaggtgatccaccacgcctggccaaaggctaataatttataatgacaatactcacggtttgcagatgtagattctaccatataaaatgtgaattctgaaaaaagtatctgttatctctgaaagtgttccactttccaaaagcagagcacgaatgacaagataaggagctccatttaccactgctacatatggataggattcctcagagtccaggcctccgttctccttgacatactggaaggccctagccatgaagccaccattgcagccctgattgccttgaggacgcgaacagtccaccagattctgctcgctcagtgagacaagtttcccagttttccggaacatctgtccttcaagagcaccagtcgcactaaaagcccaacaagaaccacactgtttctaaaaagggagaaaaaaaaagctgtaaatttacaagaccaatacaaatacagtaccccataattgaattaccttaatattctttaaaaaaaaaaaaaacccatcgccacactttgggaggccgaggcgggcagatcacttgaggagaggagtttgaaatccgcctggccaacatggtgaaaccctgtcgctactaaaaatacacaaaaattagctgggcatggtggtgagcacttgcaatcccagctactcgggaggtggaggcaggagaatctcttgaacccaggaggcagaggttgcagtgagacgagatcacgccattgcaatccagcctgggcaacaagagctaaactccgtctcaaacaagcaaacaaaaaaaacaccaaaaaccaaaaatacaaaaaacccatcaccatatgttgtgccaccatctaccacagcaatgacaccaattccttcttggctttcctgtggagacagggtctgaatctgacgctgtctcacctgattcttcactggcgtcacgtagcctttctttctccaatccacagatttgggaagatcaagaaacagaggctcacggaacactttccccttcctgaatttctggtttcgaaagcaacccatcatctgcctgaattcttcattggtcttcaaggagaagtaaataaaatgttaaaagcaagactattttggtgaagaactgagaagcagcacagagttcagcaatccttgccacactcaccatgtcaccaaaagcattcatggccattgtgaagccatgtttcccttggctgtattccccattgtgcagttcaatcattttcatattcttttcccacactgctctcctccatccttcttcattctagaggcaaacatatagctggtggactttatgtctacttacccaacccatgttcaccaagccgatttgcgggcagaaatggaagagaaaccatggccagggatgggttgatacttctctgggagctgttctccaagccaagacacaatggagatatatgcccatattgcacctataatgggtgctgttaggttattgcctggtaaggtctggtgtctagaagctactctctggctatcaactcccaacagcgaggaccattctctccagagtccctctggacagtttcagatgttaccaaccgcgccatataatcttctgtgtgttgccttccactggtaccactttgtatccaaattttggtcaaattttggaacagcggaggctattcccaagcaaaaggcagccaggacgagcgaaagattcatgtttcaaaacctagaaagagaaaagaaatgagtatctgattagaccaatcctaaaaagccatcttacagcccccgtggaatagaaatatttcaattattctccctagcatttccccaaggactgtggaagaggctgaaacaggccaagtggaggtatttgatgggcccaccaaaattaaaagcagcctgcagagttggaggcgttgaaacagcatatgcgataatttagggtatgagaagggtgtgaaagatacctgacgggtgagaagcttaaggcaacaactagaaaactaggaaagagttggtccaggttttgcaccaattgtactgaggtcatccaggcaaaacctcactaatgaagacgtaccatcccaagtagatgcaagcggatccccaaggaacaccacctcacaccttcttggctgatacacagcaggagatgagctatgtcttccaacctctccttttggaataaaacctttcgggaatccctttccaggagacactgggaaggagagcacccactattcccgccgtcccacacttgggtctgtgctactcgctcccctaaaccggggcagggtcacaaggccgcgccgctggaagccaggggccccagggccagggcccggaccgaggcaggcagctcccggagctccgggcgggccaggaccggggccgcaccgcctgctctcgccctctgcacgcgccgccgcgccccgagaatgtttgcggcggtgcagggagcgggggctccgcggccaggctgggggcatgaagccgcccggtccggtccggcttcagcccacaggatgactgacctgccccgcccgggccctcccagtggtgccggcgcctccctggggtctccaaccgccctcccccgttccccacctcgaggctggcagagctccgggcagaagctctcactcccagaagcgcccgcctcctctcagtgtccctaaaggggggttccctcctccagtcccccttcgccctgtccctcggtctggtcgggggcgctcaccagcagccgtcgcagctgcgcaggcaccctcagcaaacaagcctctgagattacagacgtccgcggtctggtgcaggttcgcccgcctcgggatttaagtttccaggcggccttccccgcccccaccgccttcccgcgctgcgattggctgtgccggccactgggcggggccccgggcgcttagagcccgcgcgtgacgcagcccagtcccaacccgtctcaggtctgggcgcgcctacc

SEQ ID NO: 1420 - DNA, 16551 bp, Homo sapiens
cagtttctcttctcggccacctcctgcatagagggtaccattctgcgctgctgcaagttacggaatgaaaaattagaacaacagaaacatggtaagccacttctatttctttagcaaagctttccaacagaatatggggtttctgacccagaaatctgggttggtggcaaatggtgtgagcctagaaagtaataaatgggcaaataaggataaaaattaaagatcgaaacaactgtaaatgcaggtaaagcggcttgctatgatctttaatttgtgcacacgttagtataaaggaattagagagtaaattttgaaaatcaaatgcagtgatgatcttactaatttggacaggaaaataagaaaatttcaagttagaaattgaactggaaatattacttactggccctaccagagacaatatcctcttccagaacaacagggttggaagagaaggtgagggaaatattcttcctttgctatttctgtagaaaaggacaaactctcttccttcacatacataggtcaattgctagatcctagtgaagcctgagcttaacctactgttggaggcttaaagttcgacattaattgctacttttcttggtcagagttttaaataattaggttggtacaaaaaactgtgattacttttccaccaacctaataacatgctacaatttctgtaattattattttacactgtcaagacatagcaggtggtccgtttttgttattgtcaagaactgtcagactaaaaatgaactttacacttctttttaaatgatacattttctagaaaattcaatgaggtttaagagcaattgaaaagtctgatttcaagagagtctcatccaaaatgtactatatatttttccccaaagtccttggagttaattttgacaacaatttaaagtacacttaagtcttttgaagttaatgggtctgccacccaggttggagtgcagtggcgtgatctcagctcactgcaacctccgcctcccgggttcaagcgattctcctgcctcaacctcccaagtagctgggactacaggtgtgtgccaccacgcctggctaatttttgtatttttagtagagacggggtttctccatgttggccaggctggtctcgaactcctgacctcaggtgatccgcctgtctcagcctcccaaagtgctgggattacaggcatgagccaccgcgcccggcctgaagttaatttttatacccacctaatgttcattatggatcttgaaggtaaattaattctgcactaaaattttacaatgctttacaaaatgactgtaggtggcccatatggaattcggtcaactgggccaatgacacatatgggattgcagttgaaattatccaattcctacttgatatttgtaagctgctgtgatagccagtataattgtactgtaagaatgtggtaaatagccggggcccggtggctcacgcctataatcccagcactttgggaagccgacgtgggcggatcacttgaggtcagtaggtagagaccagcccggtcaacacggcaaaacctcgtctctactaaaaatacaaaaattagccaggtgtggtggtacgcacctgtagtcccagctactcaggaggctgaggcaggagaatcgcttgagcccatgaggtggatgttgcagtgagcaaagatcgcaccattgtactccagcctgggcaacggagtaagactctgtttcaaaacaacaacaacaacaacaacaacagattggtaaatagagtaataataaaatcaaattaaacttgcaaaaaatggccactttgctcccactggtggccaatggaggtcaaggacctggctgacctcctgcctaaaggcagaggttgttagccttcgcaatggactcaaatcagagggggagctttcaaaactcctgctgcccagactgaaccccagatcaatgaaaccaaaatctctggatacagggcttggcatttgtagcttttagagttcctaagtatctctactgtgcagccaaagttaagaatcagtgccttagaacatcaacagttttttggtccttttgttaaaaagcacagtccgtttttttaggtggctagaaatgctccaggaagagctgaaatgtatttaccagccaccttggtttgattttagaaagcaaaatagaagttctaagtatgctttctctgaaaagctgagactgcagataagagtgagggcagttgatggagttcattctcctctttcaatcactgcttctcatcctttcattataataatctaagaatctcagagattatgaaagagaaagcagtcttatggaagaccccagactcacagaatattagggtgtgtttcacagggaaggatgtcattacccacagttagtctttgaaacgcagttggacattatttgtaagtgcatcatagtgtcgcctccaggttccattgaggggaacgtcattccaatgcaacatctctgagttcatctgggttattaaatggggttgagggatttgttatttttaaattagtagccccaatttaggactactcaagaccataggacaagcctgtccaaccctcggcctgcgggctgcatatggccgaggacagctttgaatgcagcccaagacaaattcataaactttctgaaaatattatgcatttgttttttagcccatcagctactgttagtgttagtgtattttatgtgtggcccaagacaattcttcttcttccagtgtggcccagagaagctgaaagattggacacccctgctataagacacagtaatataaatacataacctgtggttctggattggcattagcagatacaggctgtgttgattttgcagaaagttacaaagagctgctagttggtgtgtatgtctaaaatcagtagatttcctgtggttctaaggaatgacaaagaatctggaagttctctgtggtagcctgctcagtgcagaaagggaacgtggaaaatccgccaccagcatttgagtcttggaggttccacatagggctatcaggtctctgctgatcactgaaaccagatcatggccaactagccccttggcttcagccctcccaattcattaactactcaggtaaatctagggtcactttcaactctaccacctaccatctgagtgaccttgaaaacattcatctctctgagcctcaggtcccatgtctgtaaagcaggggcctcatggacttctttgggtttttttgtttttgtttttgtttctgaggattaaacaaatgctccctaccctatttcccagcatccagtaacacagtttttcatatttttgtgtatgttaagtcaggacccatctctttaatgataagtgcacttaatgtggtcatgttttcttttgtcttccaaagctgttagtgaatccattgaatttgggatgggtaaaataaagtatctattattaattgtaaatttcatctaaagtgacaaatcctacctgcataaccatttcttaatttcctttcatcatgtatcagtggtcaacattgttaactgcgaatgaatcagaatccatcaaaaattagaactatttccagtctggcaaaaattcagctctggttgaatccaaacattgtgctgaagcagctaagtaattcaactgaggagattaattacatgttataatcaataggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggtaaaaagctgttaattccaggaagacagctttacgcccctcccagaccacctgcactgcacactacgtggaatttattttagtctcacatggcagcgtccctacctttgtgcccacacatctggtctccgccctggctgcagccctccccttcaggcgaattctgggtgtgtcctatctgctcattgcaactcccagcgaatgagttttcagcgaaggcagactttctgacctgttcttcaaactgcactggtcttttaaaaacgtgtttggtggccatcagcatccaatttcagaagaaagatttgggtgaggactgagagaggctgttgttgttgtgctgtctgtttccttcagaatctgcagaagaaaattggcaggtcatgtactgtggacctaaccaaaggacaaatgatgtatggaaaatagaaaaactgttgtgaaattgcttcctcattagcaataactgtatttggcagggagaggagaagttgggcacatttttttttcttttttttttcatgattcatacgttttctttaaagaagtgggttttgcttttcactgggtgctctaagacaaccccagtgaaagatctggaccacgaagacccagtcatcctcataagggtgttcattgcagcaagctcaagggcatgccaggcaaaggccttttttctggcagcttgaacttgtctcagcagagggtttcacagaacaactgtcatttacctgttctctgctcttacttgattcgtttcccaggactgctgaaacaaagtaccacaaacttggtggatcaaaacagcagaaatatatcctctcacagttctggaaaccacaagtcagaaaccaatgtgttgttggcagggttggttccttcttaaggggctagagggaaaatctgtttcatgctcctctcccagcttctggtggtagctagcaattcttgatgctctctggcttgccgctgcatctctctagccttcacctctcctcatgtgggtggccttctttcctgtgtgtctatttccaaattccccttttcttataaggggaccagttattggatcagggcccaccttaattcagtagatcccattttaacttgatgacatcagcaaagtccaaataaggttgtattcacaggtaccaggggttagaacttcaagttatctattaggggacacaattcaacctaaaaactccccttttttgattctctattctgccacttctactcaatccaggttcttcacttcatcagctcccaatctaatacttatcttatttctagtaagcatctcttccttatcttaactggtccctggggcctggcccgagccccattataccatcagctgttgacatcaagggtggacttctctttcggcacagaaggcacagggctgtaggcttcagccttctctgctttgctctgccccatctactgttcatccacctgctttccattttgctaaactttgtagaaaattcttgtcagctgttgtctcctcctacactttctttgatcttagaggattctattcttttactatggctttaatcggagcacccgactgttaggttcaaccaacagaagttggttgtgctctctcactctttctttctctctctctctctttctctctatttgcatagtggtattttttttttcctctattttattggcagaattgccatttctctaagttattgtagagttgctgtttctctattttatttgcatatttctcttctgccaggctggattgtttctattgattggttctgctgtaatgagggtgacttctcattagtatccttctcacttcatctgggaccagatgccctttgatatccttttggagccacaacttttggtagtcagaggcatgggtgtggctcaaaggaagaacttggctcagaaggtgcagctcttgctgggcctttggtctctgctctgtcttctgagatcagtggctgctgggacctggggttcccccatgccgggcatggtcacacagcactcctatggacttgagcagagcaccctgcaaagtgagcattagcaatccattccaactctgtgcagtcctgcacggaatatagaaggtggagcaatgacagtctccccaacttctctgcaagcaacctgctcaccatttcttgcccttcccatttatgtacttttcaaaatcaggttatttggaatttgtcgactcatgtttcttacttcagtacttttttgggagggcagcattagaaacctcaaactcttaactaaaaaatgtctttgggaatgttctggccattttcatggcccacaatttgctttaagctgctttagactctcccagaggctattttcatcccgaaagaacagagcagagctcaaaagactccagttttggtctctagcagcccctagaggatttccccctcaattcctctctgccttgtatgaaatagaattggatttgaaatcggatgttgaggccttacctccaggctagtgaggccacacaagatggatcctctggacccgcccaagtgtccacctaaacatgagttaccaactaacaatgttttgtttagcatgcaaagggagtggtctggaatctggccttgccctgacatattctccttgggcctttttaaaaaaataatttgtgttaatctgtagttaaaaattataataaggacctgacaaacactacctcagtcagatgatcaaggtacacataaatagtgaaagtcatgttgatagcatgcacccttcatatgatatggctagaatggccctgcacttctgtgatcttcctcccctagactcatcagctcgatctaatcataacaaaagcatcagataagtccccgcccagggacattctacataaccatttcccttcccagttatatttttctccacaatactttccaccatctaacattctatctttcaaaatgggcaagtattttagcctggtttgttcattgttttatctgcaactcaaatacagttcctgaaataaaatatctgcctaataaatatttaatgaatgaatgaatatagcattgccttatccgtttaattgccacatggtatttcattgtgtgaacataatatcgtttatttacccagactactactcataggcatttagattatttccggtcttttgctattgctaacagcctttgcaatgaacatccttgtatacagacatttgcatatatgagggtgtgtctttaggatctacttctagaattgaaattgccaactccaagtatatgtttccaattgtgatagatattacacattaccctccatcttagaggtggtgttaatttagattcctgccagcaaaatttaagagtgtttgtttccccatatcctcaactgcctaacagaatcagtgaaaaatggtatgacagtgtaatttttgagtgaggttgagtatcttttcctatgctttaagagcaatttatgtttcctttttatgtgaactgtctgttaatatattttttcaatttttctattgggttatttgtcttttcattaatgcatatacctgttacatatttataccaagtatgtattaaatactaacatattgatgaaacagagcaaaaagcctagaaatagatccaaataacagaagagttagtatgtgatacaggaagcctataaaatcagtgagcaaaagaccatccaattaataacgttagggtaaatgggtctccatttagaaaaaaataatgtgggtctacacctcacattttatacctaaacaattccagtgggataagaaaatgaaatcataaaaaattactaggaaaaagatgagaaaattgttcataaaactgaagtgtggaagatcctttatgccttacactgccctgagtgatctcattcatacccatggcttcaattgtcatgaatcccaaattcattcctctgtcagaactctcttctgagcttcagacccacatactcagctgcctactggacacctctacttgaatatcacaaactcaactcaaaagcaaacctgtcaaatttaattactagtagccctaccccaaacaatcttcctgctcagtgaatgacacccatccctccaggtgcacagaccaggaacctagaagtcactctgattgcatccctctccctcacaacctctacctccctttattcatccattgctatgtctctcaaatgtacctcccaaatatctcttgaacgcgttcttttctatctctattgccaccaccctagttcaaactcccatcatctcatgactgaagttctgtgccctcttgccagtgaacactgtagaatcaatctaaacatggtgccaccctgcttaaaaaccttcaaaggctcacatcacttctcagatgaagagattggggagacgttggtaataggacacaaaatttcagttaggcaggaggaaaaagttctattgaagaactctattgtacaatatggtgactatagttaataacaacatattatacacttgaaaatcactaagagagtccattttaagtgttctcatgaccaaaaaatgataagtatatgaggtaatgcatatgtgaattagcttgactgaggcattctacatgtatacatatttcgaaacatcatgttgtacatcataaatgcatacactttttagttgtcaatttaattaatattttttaaacctactctggcctttttttccttttttgagacgggtggtctctgtcccccatgctagagtgcagtgcgcaatcatggctcactgcagcctccacctcccagtctcaggcgattctccagtctcagcctcccaagtagctgggaccacaagcatgagccaccatgccccgctatttgtttttgtattttttgtagagatgggatctcgccacatggcccagtctggtgtccaactcctgagctccagtgatccacctgcctcagcttcccaaactgctgggattacaggcgtgagccactgtgcctggtccactctggtctttactcaagtccctggctttctctcagtctcttaaacttatgtgcttagtaagatgaggactgaaaaatgtccacagaacatagtgacatggagatactgagaacctcaacgacatctccattagccacttcctctgtgccattccagtcctctgggccccactgtggcaagcagtcctaccatggcaaacatgaaagctgatgtgccttgtcttagacccacaccatatctctctgaattcctgtcccagggcttctctggaggtacagcctgggaaactcacgggaatagacacagggcctttgcacatgctgctcccttttcctgaaaaattcctttgacatcttggttgtgccttacacatgcctactcaaccttaggattgcagttcaggtttcactccttttttttttttctttttgagacggagtttcactcttgttgcccaggctggagtgcaatggtgtgatcctggctcaccacaacctctgcctcctgggttcaagtgattctcctgcctcaacctcctgagtagctgggattatagtcatgcaccaccacgcccagctaattttgtatttttagtagagacagtgtttctctatgttggccaggctggtctcgaactcccgacctcaggtgatcggcccgcctcggcctaggttccacttctttatggaaatcttccccagttgccttgactaggccaaagtcccctcttcttaggctcttacagtgtcatgcacttcttttttatcacagtgtaaaccttgtaatgttgtgtttaagtcatatctgttgtacccatgagactgggagccaattcatatattgtgagtgtaatcgaacagacttcccaggccacccactagctaatcaaggcagggatgagtccggaaagtgactttgaaatctagcaatgttggaacttggaaatcacacaggctgagatctgctcaggtgcctgaacaaatatagcattgcctgtggcgtctccctcaaagtgccttgcatgtctgagccccgttgccccttcctttggtgtgcctgtgtctcccggtacagatgtgaagcctggagacctgtggctgcctctgcaggagctccatgttttcaagccataaatcatcttagaattcatagcatctagatatattagttttctattactgcagaacaaatcgctcccaaatgtagaggcttcaaagaatgcccattgattggccttaatttctgtaagttagaatctgggcaggtttgcctgagttctccactccaagtctcataaagccaagctgggctgtcatctggaggctctgagtaaaaatttgtttccaggttcatccagattgtcaggtgatttcagttccttgcagttgttgttcgactcactaccccaccaccaccccgaaaacctcatttccttgctagctgcctgcagagagccactctcagcttccacaggctgcttgcattccttgttgtggggccgctacctcctcaagccagaaatagggcatccagttcttctcatgcatcctacccctctgacttttccttctgccgataaccagaaaaaacgttccgccttcaaacgctcgtatgattagactaagcccatccagataaattcccatatgccatatactataatgtcatcacagcagtaatacccgggacaaaattcatgggggtcatcttaaaattctgcctatcacaccaggtatagtagaggcttgttttagtgcaagttaaacattaagcagcaacatcacgatagtgctgcatttgaaaataactactagcaactgaacatgtctgggagttctgctccactttaatttccatctcaaaaggagctgggttttccttggctgttacaaatgggcaataatgattgagcttaagaataatcaatgtccacataaaaatcttttataacatagtgagagtgtgacatataaaggtgttagttcaccggccctaaattttaggagaatttttaaaaaggcacttatctggtttaatccataataaagacatgagttgggctttagtgaaaaatctaggctggtttctgtgttcagtgaaagaagatttgagagttctcttaattacaacccttgatcaaacctaccacattaatctgtttattgcattgtatggttaccaaaagtgatatattcagccctctatttattaagaaacagttacagaaagtgaggcactctcctgtgttactgagggtgcataaaaatataaagcaccatgtgtcttccctagagaagtttcaaaactagcaagcaaatagctattaatgctaatgtttgtgtgatagggaacatatgagtagtaattattccacaaacaattttttgagtgctgtttacatttgaggcacagttcaggcacgaggatttcaaaaggagattgtgtagcatgatggcttgttaaaaatatgattttggaatcagatttgctcaagtcccagtgctacagcataccatccttcaaaaaggtacttaagtctctgagtttgttttctcatctgcaaaatataaataataagaggacctactgcgtcatgttcttgtgagcattaatgtgggtgatgaaatgtttatgaagcacttagcacaatacctgacattttgtttgttattattatcaacataaagtgcccactttccagtcatgcaagaagaaaacataatatatgtcaccatagaagtatagaacaattgtgggaaataccagtaagagagatatagctgtataaataaggtaaagatgactgcctagaagatctaggatgataccatattagaagttgcatctgaactctccttggggactggccaaagtttcatcaagtgtcatgtcagtaggttggtgctataaatatatagcttgcaaagctatagacttactataaaccatagctgtggtccagcttagactcattatggtggtggagtatcttgattaatggcctctgcagaagcttcccaggtcttctcatcatcataatctcagatagcttcatcttcaacttccttttttttgttgtttttgagacagggtctcactctgtcatccaggatggagtgcagtggcacaatcatggctcactgcagcctcgacctcaggagctcaagccatcctcccacttcagcctcccgagtagttgggactacaggcatgcaccactacgcccggctaattttttcatttttttgtagagtcagggtctccctatgctgcccagtctggtctcaaactcctgggctcaaaccatctttccacctcggcctcccaaaatgttgggattacaggtgtgagccaccacacacagcccatcttcaacttcttttagcaccatgaagctgaacatagtaaaaaagtaaaatcattctggacctaatctgatgcaatttatttaattgttaagtgaatgcacacatcaaaattcatacaagtatggggcagcgctgctaatttatttacaaaacacctggcaaatactgctactctaatactgtgcttccacttttgattttccttaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaa

SEQ ID NO: 1421 - DNA, 40485 bp, Homo sapiens
ctgatgtgttctacattcctttattgggatatttaggaccatgtaataacattatactcagaaaaattttatatacaaaagaaacttcccttaattctatcaatatcatcctctgtttccctttaattttcaccaacatccatccatccatccatccattcgtccccatccattttcaccaacatccatgtgtaagaccaggctggatggatacaacagcccttgggctcaaaacttgtacagtctggtgaatgtaacacggagccaccaaaatgtcatccagcagagaaagtggcaagtacgacagagctttccgttcagatccaagctttgctgctgaatttgggtaaatgactgagcctttatgagcctgtttcctcctctgaaaatggggattatagtaacaagcagagagaacaggagtggtgggtgggtagcgccttaagtaggtgttggtgcagaggactccatcccatctgggccacagaccatcaggaggcacgtggggacttggggacaaagaaaacaagcagcccatatctgccggcaggacctggcaaagtgggcgtgacaccaacaagttgcatcccagaggtgaccacaaagcgcccaggatttgcaaagctaaggtcaagtggaggcaggaggagacagtttcaggaaacacctgtggcctatctcacccgtgtcttccctggccagggaagggcagccgcttaaaggggccaagggaagctgcagcgtggctcctaaacatggacgcacagtagctgtcctctcaggagctctgcacccccacttaaaaccaggatcacaagagatttgtgtaaaggaagcctcttgtgcatttcttcatctgaatcgttgacttaaaagtttcttccacgtaagtcctttcactttagctttgtatatatttagcattgatttcacaacaaacaactgattccaggcacttggtgttttcccagaccttgagctttttccagggttgcacgttatttccatatgtggtacttcgcggcagccccagtatggggaagccatttgctgccttatgaattgtctggtcatccactcgagaggaaagggctgtgtccagggctggggaaggccccaagagtggttcttcaggcctactgttggcaacagcccaggaatgtgtgaagtctgtaacaacaagcgtagtaataataattccagctctgctagttgaacgctcactttgtgccagctacttttctaagagttccacgatatgaacaatttaatcctcaaagccaacatctgagaaagatactactattcttatcccaatttgacagatgagaaaactaaggctcagagaggcttgtctgctggtgatttgtgtgtctgggaagtgcacgttgtctggcaggcttgcctggcagaagcggttcatgacaggtcttctccattttggaatcaagatctgtgtcagcatggatggcaaggggaagagtaaggaaagattggtctaggagatgcccaggagcttttggcctcacagtgcagggtggggagagcagacctggccaccaaggaccagtttctgggcttgggcagaagccaatcatctggctactttacaagcagatggagcttcttcctctcagtaaccttcctgccctggtgtcaattccattttcattttcatcttttatggtactggttgtgtggagaaaactgaaggctcatttggtataagtaagtaactcatttttatgagtttgcttgacatagatactagactgtatgtgtgtatatatacatataaacatgcatatgtacataaaaaatatatatatatcatatatacatgatgatacacacacacacacacacacacacacacacacatatatatatatacgtatacaagcatgctttacaaggccaattgactggtctacaattggctgacacttggtggcctagaagccagggtatgtgagtctcgcttttctagaaagctgacaaactctccagttccaaggatccttgctcagtcaacggctggaagtcatttttacttcgctgttttttgtttgtttgtttgtttgtttttttagacaaagtctcattctgtcacccaggctagagtgcagtggcactatcatggctcactgcaatctccacctcctgggctcaagcgatcctcccacctcagccacccgagtaactgggactacaggtgcacaccaccatgcctggctaatttttgtatttttttagagacaaggttttgccatgttgcccgggttggtctcaaacccctgagcacaagtgatcctcctgcctcggcctctacaaagtgctggaattacaggtgtgagccactgcactcgatccattcttacttactttctttactttatttccaagcaaatgtttggagggaaaccaagagacttggatgcggccagccgaggcctttgggtttacaatcacaaatgtttttggtttgcccatgaaggcccaggctgcactctctgatgtcacaggaatcacctctcaaaccatgcaccaggtcttgaattcccttagggtgtgatctttagaggtccatctaggtatacccacccaagccattctttgactgctgacaggccttccttcataacaaggtgttccacagtccatttatatatggatgtcatctctgcccaccctgctgccaatttggttttctcccactcctggggtgtaaggcaagatgaaacatatcacatcccgttctaaactttattcttgtggccaggggtcagcaaactttttctgtaaagggccagatggcaaatatcttaggttttacaggccaagaagcaaatttggcatattatgtagctacttatatagtaaaataaaaatttccacaattatgtaattgatgaaactcaaaatgtaataataataatcgaaggcagtttttttgtagtataggtttaataatgagaagaatggaatcatttttggaggtgctaacattctgcttggttggaatttaaagttagtgttctgtatcagcaaatccattgccaatgttcatctaaaaatgttttcacttctgggccggatttcgttcaaaggctgcagtttgctgacctctgctcttggttacaccttttgaggcccttgctctccgagcataaaatggaatccatttatcagactaaatcgggaagattaaattttccagcctcacgaatgctcagccattgactcactcgttcatacaatgaacactcattgagcttatactacatgccaggtgctggaggaggcatggggcgcccaggagaaagatgctcgctttgcggccacagcccagtgggagggagacccatacctaccggtgctgtctcagaaacttgtggaacaaagatgaagcaatgttcatgttattcgcctacatctgtgaattacacaaggaagacgagtttgagaaatccgaagttcagtacaaatttatggtaacttttttaaaaaagaatacactgaagttttcttagtgaatggaataatgttccctttttctcccctgtacacacaaatacacaaaaactaacaaaaatacgtcgtgtgtgtctgatttgggttgtatttaaatcatttcataaatgactttttcccataacttcagtttcaaagttttaaagcacagtcaattaatgatttggcaacagctaagaaatcacaagttcccttcttttcatgtaaacttctgtaaaacacacgctacgttctgctgatggtaaatagagccatttcaggaagttagccagtttctcttctcggccacctcctgcatagagggtaccattctgcgctgctgcaagttacggaatgaaaaattagaacaacagaaacatggtaagccacttctatttctttagcaaagctttccaacagaatatggggtttctgacccagaaatctgggttggtggcaaatggtgtgagcctagaaagtaataaatgggcaaataaggataaaaattaaagatcgaaacaactgtaaatgcaggtaaagcggcttgctatgatctttaatttgtgcacacgttagtataaaggaattagagagtaaattttgaaaatcaaatgcagtgatgatcttactaatttggacaggaaaataagaaaatttcaagttagaaattgaactggaaatattacttactggccctaccagagacaatatcctcttccagaacaacagggttggaagagaaggtgagggaaatattcttcctttgctatttctgtagaaaaggacaaactctcttccttcacatacataggtcaattgctagatcctagtgaagcctgagcttaacctactgttggaggcttaaagttcgacattaattgctacttttcttggtcagagttttaaataattaggttggtacaaaaaactgtgattacttttccaccaacctaataacatgctacaatttctgtaattattattttacactgtcaagacatagcaggtggtccgtttttgttattgtcaagaactgtcagactaaaaatgaactttacacttctttttaaatgatacattttctagaaaattcaatgaggtttaagagcaattgaaaagtctgatttcaagagagtctcatccaaaatgtactatatatttttccccaaagtccttggagttaattttgacaacaatttaaagtacacttaagtcttttgaagttaatgggtctgccacccaggttggagtgcagtggcgtgatctcagctcactgcaacctccgcctcccgggttcaagcgattctcctgcctcaacctcccaagtagctgggactacaggtgtgtgccaccacgcctggctaatttttgtatttttagtagagacggggtttctccatgttggccaggctggtctcgaactcctgacctcaggtgatccgcctgtctcagcctcccaaagtgctgggattacaggcatgagccaccgcgcccggcctgaagttaatttttatacccacctaatgttcattatggatcttgaaggtaaattaattctgcactaaaattttacaatgctttacaaaatgactgtaggtggcccatatggaattcggtcaactgggccaatgacacatatgggattgcagttgaaattatccaattcctacttgatatttgtaagctgctgtgatagccagtataattgtactgtaagaatgtggtaaatagccggggcccggtggctcacgcctataatcccagcactttgggaagccgacgtgggcggatcacttgaggtcagtaggtagagaccagcccggtcaacacggcaaaacctcgtctctactaaaaatacaaaaattagccaggtgtggtggtacgcacctgtagtcccagctactcaggaggctgaggcaggagaatcgcttgagcccatgaggtggatgttgcagtgagcaaagatcgcaccattgtactccagcctgggcaacggagtaagactctgtttcaaaacaacaacaacaacaacaacaacagattggtaaatagagtaataataaaatcaaattaaacttgcaaaaaatggccactttgctcccactggtggccaatggaggtcaaggacctggctgacctcctgcctaaaggcagaggttgttagccttcgcaatggactcaaatcagagggggagctttcaaaactcctgctgcccagactgaaccccagatcaatgaaaccaaaatctctggatacagggcttggcatttgtagcttttagagttcctaagtatctctactgtgcagccaaagttaagaatcagtgccttagaacatcaacagttttttggtccttttgttaaaaagcacagtccgtttttttaggtggctagaaatgctccaggaagagctgaaatgtatttaccagccaccttggtttgattttagaaagcaaaatagaagttctaagtatgctttctctgaaaagctgagactgcagataagagtgagggcagttgatggagttcattctcctctttcaatcactgcttctcatcctttcattataataatctaagaatctcagagattatgaaagagaaagcagtcttatggaagaccccagactcacagaatattagggtgtgtttcacagggaaggatgtcattacccacagttagtctttgaaacgcagttggacattatttgtaagtgcatcatagtgtcgcctccaggttccattgaggggaacgtcattccaatgcaacatctctgagttcatctgggttattaaatggggttgagggatttgttatttttaaattagtagccccaatttaggactactcaagaccataggacaagcctgtccaaccctcggcctgcgggctgcatatggccgaggacagctttgaatgcagcccaagacaaattcataaactttctgaaaatattatgcatttgttttttagcccatcagctactgttagtgttagtgtattttatgtgtggcccaagacaattcttcttcttccagtgtggcccagagaagctgaaagattggacacccctgctataagacacagtaatataaatacataacctgtggttctggattggcattagcagatacaggctgtgttgattttgcagaaagttacaaagagctgctagttggtgtgtatgtctaaaatcagtagatttcctgtggttctaaggaatgacaaagaatctggaagttctctgtggtagcctgctcagtgcagaaagggaacgtggaaaatccgccaccagcatttgagtcttggaggttccacatagggctatcaggtctctgctgatcactgaaaccagatcatggccaactagccccttggcttcagccctcccaattcattaactactcaggtaaatctagggtcactttcaactctaccacctaccatctgagtgaccttgaaaacattcatctctctgagcctcaggtcccatgtctgtaaagcaggggcctcatggacttctttgggtttttttgtttttgtttttgtttctgaggattaaacaaatgctccctaccctatttcccagcatccagtaacacagtttttcatatttttgtgtatgttaagtcaggacccatctctttaatgataagtgcacttaatgtggtcatgttttcttttgtcttccaaagctgttagtgaatccattgaatttgggatgggtaaaataaagtatctattattaattgtaaatttcatctaaagtgacaaatcctacctgcataaccatttcttaatttcctttcatcatgtatcagtggtcaacattgttaactgcgaatgaatcagaatccatcaaaaattagaactatttccagtctggcaaaaattcagctctggttgaatccaaacattgtgctgaagcagctaagtaattcaactgaggagattaattacatgttataatcaataggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggtaaaaagctgttaattccaggaagacagctttacgcccctcccagaccacctgcactgcacactacgtggaatttattttagtctcacatggcagcgtccctacctttgtgcccacacatctggtctccgccctggctgcagccctccccttcaggcgaattctgggtgtgtcctatctgctcattgcaactcccagcgaatgagttttcagcgaaggcagactttctgacctgttcttcaaactgcactggtcttttaaaaacgtgtttggtggccatcagcatccaatttcagaagaaagatttgggtgaggactgagagaggctgttgttgttgtgctgtctgtttccttcagaatctgcagaagaaaattggcaggtcatgtactgtggacctaaccaaaggacaaatgatgtatggaaaatagaaaaactgttgtgaaattgcttcctcattagcaataactgtatttggcagggagaggagaagttgggcacatttttttttcttttttttttcatgattcatacgttttctttaaagaagtgggttttgcttttcactgggtgctctaagacaaccccagtgaaagatctggaccacgaagacccagtcatcctcataagggtgttcattgcagcaagctcaagggcatgccaggcaaaggccttttttctggcagcttgaacttgtctcagcagagggtttcacagaacaactgtcatttacctgttctctgctcttacttgattcgtttcccaggactgctgaaacaaagtaccacaaacttggtggatcaaaacagcagaaatatatcctctcacagttctggaaaccacaagtcagaaaccaatgtgttgttggcagggttggttccttcttaaggggctagagggaaaatctgtttcatgctcctctcccagcttctggtggtagctagcaattcttgatgctctctggcttgccgctgcatctctctagccttcacctctcctcatgtgggtggccttctttcctgtgtgtctatttccaaattccccttttcttataaggggaccagttattggatcagggcccaccttaattcagtagatcccattttaacttgatgacatcagcaaagtccaaataaggttgtattcacaggtaccaggggttagaacttcaagttatctattaggggacacaattcaacctaaaaactccccttttttgattctctattctgccacttctactcaatccaggttcttcacttcatcagctcccaatctaatacttatcttatttctagtaagcatctcttccttatcttaactggtccctggggcctggcccgagccccattataccatcagctgttgacatcaagggtggacttctctttcggcacagaaggcacagggctgtaggcttcagccttctctgctttgctctgccccatctactgttcatccacctgctttccattttgctaaactttgtagaaaattcttgtcagctgttgtctcctcctacactttctttgatcttagaggattctattcttttactatggctttaatcggagcacccgactgttaggttcaaccaacagaagttggttgtgctctctcactctttctttctctctctctctctttctctctatttgcatagtggtattttttttttcctctattttattggcagaattgccatttctctaagttattgtagagttgctgtttctctattttatttgcatatttctcttctgccaggctggattgtttctattgattggttctgctgtaatgagggtgacttctcattagtatccttctcacttcatctgggaccagatgccctttgatatccttttggagccacaacttttggtagtcagaggcatgggtgtggctcaaaggaagaacttggctcagaaggtgcagctcttgctgggcctttggtctctgctctgtcttctgagatcagtggctgctgggacctggggttcccccatgccgggcatggtcacacagcactcctatggacttgagcagagcaccctgcaaagtgagcattagcaatccattccaactctgtgcagtcctgcacggaatatagaaggtggagcaatgacagtctccccaacttctctgcaagcaacctgctcaccatttcttgcccttcccatttatgtacttttcaaaatcaggttatttggaatttgtcgactcatgtttcttacttcagtacttttttgggagggcagcattagaaacctcaaactcttaactaaaaaatgtctttgggaatgttctggccattttcatggcccacaatttgctttaagctgctttagactctcccagaggctattttcatcccgaaagaacagagcagagctcaaaagactccagttttggtctctagcagcccctagaggatttccccctcaattcctctctgccttgtatgaaatagaattggatttgaaatcggatgttgaggccttacctccaggctagtgaggccacacaagatggatcctctggacccgcccaagtgtccacctaaacatgagttaccaactaacaatgttttgtttagcatgcaaagggagtggtctggaatctggccttgccctgacatattctccttgggcctttttaaaaaaataatttgtgttaatctgtagttaaaaattataataaggacctgacaaacactacctcagtcagatgatcaaggtacacataaatagtgaaagtcatgttgatagcatgcacccttcatatgatatggctagaatggccctgcacttctgtgatcttcctcccctagactcatcagctcgatctaatcataacaaaagcatcagataagtccccgcccagggacattctacataaccatttcccttcccagttatatttttctccacaatactttccaccatctaacattctatctttcaaaatgggcaagtattttagcctggtttgttcattgttttatctgcaactcaaatacagttcctgaaataaaatatctgcctaataaatatttaatgaatgaatgaatatagcattgccttatccgtttaattgccacatggtatttcattgtgtgaacataatatcgtttatttacccagactactactcataggcatttagattatttccggtcttttgctattgctaacagcctttgcaatgaacatccttgtatacagacatttgcatatatgagggtgtgtctttaggatctacttctagaattgaaattgccaactccaagtatatgtttccaattgtgatagatattacacattaccctccatcttagaggtggtgttaatttagattcctgccagcaaaatttaagagtgtttgtttccccatatcctcaactgcctaacagaatcagtgaaaaatggtatgacagtgtaatttttgagtgaggttgagtatcttttcctatgctttaagagcaatttatgtttcctttttatgtgaactgtctgttaatatattttttcaatttttctattgggttatttgtcttttcattaatgcatatacctgttacatatttataccaagtatgtattaaatactaacatattgatgaaacagagcaaaaagcctagaaatagatccaaataacagaagagttagtatgtgatacaggaagcctataaaatcagtgagcaaaagaccatccaattaataacgttagggtaaatgggtctccatttagaaaaaaataatgtgggtctacacctcacattttatacctaaacaattccagtgggataagaaaatgaaatcataaaaaattactaggaaaaagatgagaaaattgttcataaaactgaagtgtggaagatcctttatgccttacactgccctgagtgatctcattcatacccatggcttcaattgtcatgaatcccaaattcattcctctgtcagaactctcttctgagcttcagacccacatactcagctgcctactggacacctctacttgaatatcacaaactcaactcaaaagcaaacctgtcaaatttaattactagtagccctaccccaaacaatcttcctgctcagtgaatgacacccatccctccaggtgcacagaccaggaacctagaagtcactctgattgcatccctctccctcacaacctctacctccctttattcatccattgctatgtctctcaaatgtacctcccaaatatctcttgaacgcgttcttttctatctctattgccaccaccctagttcaaactcccatcatctcatgactgaagttctgtgccctcttgccagtgaacactgtagaatcaatctaaacatggtgccaccctgcttaaaaaccttcaaaggctcacatcacttctcagatgaagagattggggagacgttggtaataggacacaaaatttcagttaggcaggaggaaaaagttctattgaagaactctattgtacaatatggtgactatagttaataacaacatattatacacttgaaaatcactaagagagtccattttaagtgttctcatgaccaaaaaatgataagtatatgaggtaatgcatatgtgaattagcttgactgaggcattctacatgtatacatatttcgaaacatcatgttgtacatcataaatgcatacactttttagttgtcaatttaattaatattttttaaacctactctggcctttttttccttttttgagacgggtggtctctgtcccccatgctagagtgcagtgcgcaatcatggctcactgcagcctccacctcccagtctcaggcgattctccagtctcagcctcccaagtagctgggaccacaagcatgagccaccatgccccgctatttgtttttgtattttttgtagagatgggatctcgccacatggcccagtctggtgtccaactcctgagctccagtgatccacctgcctcagcttcccaaactgctgggattacaggcgtgagccactgtgcctggtccactctggtctttactcaagtccctggctttctctcagtctcttaaacttatgtgcttagtaagatgaggactgaaaaatgtccacagaacatagtgacatggagatactgagaacctcaacgacatctccattagccacttcctctgtgccattccagtcctctgggccccactgtggcaagcagtcctaccatggcaaacatgaaagctgatgtgccttgtcttagacccacaccatatctctctgaattcctgtcccagggcttctctggaggtacagcctgggaaactcacgggaatagacacagggcctttgcacatgctgctcccttttcctgaaaaattcctttgacatcttggttgtgccttacacatgcctactcaaccttaggattgcagttcaggtttcactccttttttttttttctttttgagacggagtttcactcttgttgcccaggctggagtgcaatggtgtgatcctggctcaccacaacctctgcctcctgggttcaagtgattctcctgcctcaacctcctgagtagctgggattatagtcatgcaccaccacgcccagctaattttgtatttttagtagagacagtgtttctctatgttggccaggctggtctcgaactcccgacctcaggtgatcggcccgcctcggcctaggttccacttctttatggaaatcttccccagttgccttgactaggccaaagtcccctcttcttaggctcttacagtgtcatgcacttcttttttatcacagtgtaaaccttgtaatgttgtgtttaagtcatatctgttgtacccatgagactgggagccaattcatatattgtgagtgtaatcgaacagacttcccaggccacccactagctaatcaaggcagggatgagtccggaaagtgactttgaaatctagcaatgttggaacttggaaatcacacaggctgagatctgctcaggtgcctgaacaaatatagcattgcctgtggcgtctccctcaaagtgccttgcatgtctgagccccgttgccccttcctttggtgtgcctgtgtctcccggtacagatgtgaagcctggagacctgtggctgcctctgcaggagctccatgttttcaagccataaatcatcttagaattcatagcatctagatatattagttttctattactgcagaacaaatcgctcccaaatgtagaggcttcaaagaatgcccattgattggccttaatttctgtaagttagaatctgggcaggtttgcctgagttctccactccaagtctcataaagccaagctgggctgtcatctggaggctctgagtaaaaatttgtttccaggttcatccagattgtcaggtgatttcagttccttgcagttgttgttcgactcactaccccaccaccaccccgaaaacctcatttccttgctagctgcctgcagagagccactctcagcttccacaggctgcttgcattccttgttgtggggccgctacctcctcaagccagaaatagggcatccagttcttctcatgcatcctacccctctgacttttccttctgccgataaccagaaaaaacgttccgccttcaaacgctcgtatgattagactaagcccatccagataaattcccatatgccatatactataatgtcatcacagcagtaatacccgggacaaaattcatgggggtcatcttaaaattctgcctatcacaccaggtatagtagaggcttgttttagtgcaagttaaacattaagcagcaacatcacgatagtgctgcatttgaaaataactactagcaactgaacatgtctgggagttctgctccactttaatttccatctcaaaaggagctgggttttccttggctgttacaaatgggcaataatgattgagcttaagaataatcaatgtccacataaaaatcttttataacatagtgagagtgtgacatataaaggtgttagttcaccggccctaaattttaggagaatttttaaaaaggcacttatctggtttaatccataataaagacatgagttgggctttagtgaaaaatctaggctggtttctgtgttcagtgaaagaagatttgagagttctcttaattacaacccttgatcaaacctaccacattaatctgtttattgcattgtatggttaccaaaagtgatatattcagccctctatttattaagaaacagttacagaaagtgaggcactctcctgtgttactgagggtgcataaaaatataaagcaccatgtgtcttccctagagaagtttcaaaactagcaagcaaatagctattaatgctaatgtttgtgtgatagggaacatatgagtagtaattattccacaaacaattttttgagtgctgtttacatttgaggcacagttcaggcacgaggatttcaaaaggagattgtgtagcatgatggcttgttaaaaatatgattttggaatcagatttgctcaagtcccagtgctacagcataccatccttcaaaaaggtacttaagtctctgagtttgttttctcatctgcaaaatataaataataagaggacctactgcgtcatgttcttgtgagcattaatgtgggtgatgaaatgtttatgaagcacttagcacaatacctgacattttgtttgttattattatcaacataaagtgcccactttccagtcatgcaagaagaaaacataatatatgtcaccatagaagtatagaacaattgtgggaaataccagtaagagagatatagctgtataaataaggtaaagatgactgcctagaagatctaggatgataccatattagaagttgcatctgaactctccttggggactggccaaagtttcatcaagtgtcatgtcagtaggttggtgctataaatatatagcttgcaaagctatagacttactataaaccatagctgtggtccagcttagactcattatggtggtggagtatcttgattaatggcctctgcagaagcttcccaggtcttctcatcatcataatctcagatagcttcatcttcaacttccttttttttgttgtttttgagacagggtctcactctgtcatccaggatggagtgcagtggcacaatcatggctcactgcagcctcgacctcaggagctcaagccatcctcccacttcagcctcccgagtagttgggactacaggcatgcaccactacgcccggctaattttttcatttttttgtagagtcagggtctccctatgctgcccagtctggtctcaaactcctgggctcaaaccatctttccacctcggcctcccaaaatgttgggattacaggtgtgagccaccacacacagcccatcttcaacttcttttagcaccatgaagctgaacatagtaaaaaagtaaaatcattctggacctaatctgatgcaatttatttaattgttaagtgaatgcacacatcaaaattcatacaagtatggggcagcgctgctaatttatttacaaaacacctggcaaatactgctactctaatactgtgcttccacttttgattttccttaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggatccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaagaggagtgtatgataaatatatcatagagaaattggtctttaatataaaagaaattgccatatacactgaattttttcagaactctttttaaaaaactatttggtagaaatcaaaggggaagcagttttcatgacacttttactttaagatacttattaatagataaattctatcttgattccctactcagaagacataaagtcagaatgcctggctgttggtagcctttgtgcaattcccccaaatgaaacaactttggcaaccctttccacttctactgtccccttggttcctctgcatcagtccatagcatcctctatccagtatgaatcttgagatatctaatgaaatttacctgagaataactagaaattatccaagcataagaaaaggaagttgcttcagaatgaaaagaagataaacctccaatataccatctttcctttttagttaaatcttacagcatgagttaccttttaatatgtgcttctaagaaactgaccaaaataatgtgtcatagtgttatttaatacgcacaaagtggaaagcagtgcaagtttgccaaggacaatttaattttgtcacattgcatgctgttttgtgaccatgaagagtttatacaaagatgtttatgcttgtgcttgttgaggtatagggacaaatatctaaaagcaagatcagatgggtgtggtatctcacacctataatccttggattaaaatctacctcaattgtaggactaccagttgaaccacatgcttcccactgccctcagcaaagggcaccttagttagaggaaaggtagagcctttctatggaggaggaatttgtgaggtttgagttttatcagctacctgggagtcagaccctgatagattctccttcacactccctggaccttttcctgccaagtggaggctctcactcagaggaaatctccattcttttgatgcaggtcattcatactcagatattctgcactgttcaagcaataaaaattgaatgagcacctattatgtacaccagttggcactgtgtcaaaatgtacttgtgcagagaccttggatcattggtgacaggtcttcttctcctctgcatttttctcaagaccaggcctcagtgtagcatgtttccatggagtgaaagaggggaaggaagagtgggctttggaaagtggcagctgtgtcatagcagtcagcctctgtgtatgtgaaggactttccagagcccccccactaaagcctccatgctcctcctgggactgccacagttcttgaaactatccatacagtcttcatgagttatttttaatttttttttcttcttttctctttcctccttttccccttttccccactccctagttagatctttaaaaatgcaattgtaacctttatcttcccttcaccagacactccctacagggcaagcttatgtatacgcttacctaaaagctccagagccagaaatctctcccactcggggactgcctcaagagacagcagtcaatttacaacctaaagcatgcccacaacaaaactctctcccacctggaggatatcttgaggcaatggtcactttacaacctagttctgcctgcaatggcaccagctcaaccacctggtacataagacacaaaagcaagttgcatagacctcaccttctcactcccttccctgcatgccattaatgccaactccccctttaaaagcccctgctttctgccccaaaagcaaagtgatacccttaaagtcaggagcctatacttcttccccctaagctaatttttggaataaaagtcattttattgagaacctccataaactgttggtgggaatataaattagtaaaccatgatggagaacagtttggagtttcctcaaagaactaaaaatcgaattaccatatgacccagcaatcccactgctgggtatacacccaaaagaaaggaagtaattatattgaagagatatctgcactcccatgtttgctgcagcactgtttacaatagctgagatttgcagcaacctaagtgtctatcaacagatgaatggataaagaaaatgtggtacacatacaaaatggagtactagtcagccataaaaagaatgagatcctgtcatttgcaacaacatggatggaactggaggtcattatgttaagtgaaataagccagacacagaaagacaaatatcaaatgttctcacttatttgtgggatctaaaaattaaaacaattcaactcatggacatagagagtagaaggatggttaccagaggctgggaggggaagtggaagctaggggaggtggggatggttaatgggtacaaaaaaatagaaagaatgaattagatctactatttgatagcacaacagagtgactatagtcaataataatttaactgtactttttaaaaataacaaaaatcgtgtaattggactgtttataactcaaagaataaatgcttgaggggatggatatcccattctccatgatgtgattacccattgcatgtatcaaaacatctcgtgtaccccctaaatatatacacctactatgtatccacaaaaactaaaaataaaattttgtttaaaaagtcactttctttataccacatctcacccttgttaattggactctgcgaggggtgaacaactggacctgtgattcagttaaaattagatcctcaggcaccttctgttgagaaagaataggtctcaaatgttgcaaatctcttttacctttctcaaggttctagcctctcctatcaccaatttaggtaagaatataaaatcatcaggcctgtgttacctcaactatcttcctctttgatccaaaacgtatacttagtggacaaaggctttttggacaactaatatgtgctaagtcttaaggtgggttcagaaatggccaggatccatcaactaatcaatggataaataaaatgtgatctatccatacaatggaatattattcagccataaaatgtaatgaagcactaatactatgatgcaacatggatgaactttgaaaacatcatgctaatagaccaataacaggctctgaaattgtggcaataatcaatagcttgctaaccaaaaagagtccaggaccagatggattcacagccgaattctaccagaggtacaaggaggaactggtaccattccttctgaaactattccaatcaatagaaaaagaggggatcctccctaactcattttatgaggccagagtcatcctgataccaaagccgggcagagacacaaccaagaaagagaattttagaccaatatccttgatgaacattgatgcaaaaatcctcaataaaatactggcaaaccgaatccagcagcacatcaaaaagcttatgcaccatgatcaagtgggcttcatccctgggatgcaaggctggttcaatatatgcaaatcaataaacgtaatccagcatataaacagaaccaaagacaaaaaccacatgattatctcaatagatgcagaaaaggcctttgacaaaattcaacagcctttcatgctaaaaactctcaataaattaggtattgatgggatgtatctcaaaataataagagctatctatgaccaacccacagccagtatcatactgaatgggcaaaaactggaagcattccctttgaaaactggcacaagacagggatgccctctctcaccactcctattcaacatagtgttggaagttctggccaaggcaattaggcaggagaaggaaataaagggtattcaattaggaaaagaggaagtcaaattgtccctgtttgcagatgacatgattgtatatctagaaaaccccatcgtctcagccccaaatctccttaagctgataagcaacatcagcaaagtctcaggatacaaaatcaatgtacaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttatagattcaatgccatccccatcaagctaccaatgactttcttcaaagaattggaaaaaactactttaaagttcatatggcaccaaagaagagcccgcatcgccaagtcaatcctaagccaaaagaacaaagctggaggcatcacgctacctgacttcaaactatactacaaggctacagtaaacaaaacagcatggtactggtaccaaaacagagatatagatcaatggaacagaacagagccctcagaaataacgccgcacatctacaactatctgatctttgacaaacctgagaaaaacaagcaatggggaaaagattccctatttaataaatggtgctgggaaaactggctagccatatgtagaaagctgaaactggatcccttccttacaccttatacaaaaattaattcgagatggattaaagacttaaacgttagacctaaaaccataaaaaccctagaagaaaacctaggcattaccattcaggacataggcatggacaaggacttcatgtctaaaacatcaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatattcagaatctacaaggaactcaaacaaatttacaagaaaaaaaaaaaacaaccccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcaattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaagactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacattctggggactgttgtggggtggggggaagtgggagggatagctttaggagatatacctaatgctaaatgacgagttaatgggtgcagcacaccagcatggcacatgtatacatatgtaactaaccggcacattgtgcacatgtaccctaaaacttgaagtataataataaaataaaataacagaaacaaagcagacatagacagtatgcaaattaaaaaaaaaaaagaaaacatcatgctaagtgaaagaagccagacacaaaagaccctatattgtatgattccactgatatgaaatgttcagaataggcaaatgcacagagacagagagtaggtaagtagttgcctgaggcagtagagggttgagggattgggagaagatgggcatggctattcaggggtctggggtttcttgttgaagttatgcaaatgttctaaaattgattggagtgatgattacacaactctgtgaatattctgacagcaatatttctcttcctggcccattttttgggtggtttttctggcattgctgcaccatgtctgaagctcctggcacttacactcttgaagtcttctctatcagctttcccggaccctctgcttttttcttggaattgatcaagatttgccagatcatagtttggcactgacctctgattgttggcttctgtaaagaaccccaaactacaggaattggaatgcctggtctggtcaaaggagaggatctggttgattctggacaaatcactccacctcgctgagtatgattcttcatctatagagtggactgaatgatctccaagtactttcaaatatgaaaactactctagtttcctcaagctgccacaaactgcacggcttaaaaaacagaagtttattgtctcatagttctggaagttaaaagtctgaaatcaaggtgtctgcagggccacgctccctctgaaacctatagagaaagatccttcttgcctcttttggcgtctggtgtttgccagcaatccacagtattccttaccttgaagacgcaggactccagtctctgcctctgttgtcacatggccatcttccctctatgtctctctcctcttcttaagaacagaagtcatagtggattaaggacccaccctactcctactatgacctcatcttgactaatcacatctgcaacaacctcatttccaaatgaggtcagcttctgaggtcctgggggttaagacttcaacatgtaattttgtggggatgcagttcaacccataaccacaaccgtggcttttcttccttagaagttactgagaactccatgaaagttgaaaatgcccttgtgaatgggagagtcattcacgactattggaagaaaaaggcaattttcctgtcggctattaataaagctattatagcaatatggcaaggtttctactctgattatccttgaacttaaagtcataatagtatccattatttccagtgagtacaagggaaggtcacattactgtgttctcttcattgctgcccttaaatgctttcagggaaagggggaatagataaagccccaggccttactcagcaatcggggcaagacgtagcagtgttttgaacctgaaggagacaacccagggcttcctgtgccaatgactcagaatggaaaatggtctttataaatgtccctccagtgtgcaaagggtagagactagaatttaaaattcatcagatattaataagaaaaaccaaagcaaacaaaaaatctacttatgatcatagaacattgccattggggagctgtttattatttgagcctttttaaaatttctttttttgtgtgtgagaaacatatttctaggagtagagagaaaaggctcccctgttttatgtactcagtctttccctcctttgagattacccctaaactattttagggatagctccctggttatctcagtaatgatgaccccagaagttcagagataattaagagccatgtctgggtttgtgagagaagcccaaatgcagttattcaaaccagaaaccagagcctcgttgttgactcttccctctcaccgtgagatccaaccactcatcaaggactctccatttgacctcctaaattcttctcccatccatcccccatctttgtgtccatcatcaacaccccttgtccaagatacctgcattgctcactagcttcctggtatccactgtgttccctccaattcagttccagaagctagagtgattcttatcaaaagtgtggcttcttctgaattaggctgacaatctcaactcctggagaagacccacaatccctttgtgaccttccatttgtgcacccctccagcctccactctaagcacccccaccagttgtcttcggtttgtgctaagaacacaccaaactcccatctcagcacctacacacatacgactgccccaaggcacgtctgactccagacttcacttagctaattcctgcttaccctacagggagaggttaaatgccactgagagcagctttattctaacctccaaatcccactcagacgtcccccttatactatcttctcagcatttaccacaagttttgttggataaatgatagagaaatgaatagtgtggctacaacacgtgtcttccattagactgtaggccccaaagatcagggaaggtgacttttagtccatcactctgtccccagtattcatcaccacgcctgatacacaacaaagactttcaataaatacttttcaagtgaatgaatgaatgagcaaaggttcaggttggcttctctagctacaccctaggacagatacagtaaggtcaggccacattgtcaaatgtcccactgtagcagtcatgcataagggtaggccttctgcaccttccatgttcccattgcccactcatggtggcaagcatgctgattgtctcttgagtactacacagcaccaacaatctcaggtaccatgatgctgattccatgaggctctgagcctgggcaagaatcatttacattcttattgagtgttgggctatggttcagagcaagcacagcataagccaagaagaaggcaaaggatgttatcatgaaatggaagaagtgtgtaaattgagtgcaactatgtagaaatcatgcgatggtccataaacaaatatgggcataagagcaagtctgaattcaggctcatggaaggctggtgtggctctgccagcatgtgctagttcactagttctatgccaccattcaaagcagaatttccccaagtcaattccatacgtaagtactccattaaaaacgctcctgagttcaaacaggtttggaaacatcttagttactatagtatttctcatatgccttgtgatctccaaaagagaactatactacactgtgtcccaaacttacttgatcacgattcctttttttctttttttgcagggcatctcctagagctaatgttctctctctctctttggaaatgcagatttgaaggcctgagatttacccagcctaatgaacccctgaaaatgttcccaggtatatgatgatagtcaccatattgacatgaattgttctgttttaaaaacagaaaaaaaaaccacaataatctaggccatgtcccttgaggcctttatatcaagatgattagctccttgaactggtcctattaggtctctagaggagagattattgcttctgaagagagatgtgacaacaaggcagaatatgattcagaagcggtaaataataaaactaaaaatgatagcttctcctttggtacagggtggagaggttaatattcatttctaaagcatcattagccatataaagtataatttcagcacttgacataaactgaaaacacacataatcctcccattgagtgggctaaccttggctgtggctggatgagctctctagggacttattagggaatatggtactttcaaagatgttaaatccagtggaagtgactgaagcaattagtctctgatcttgagagaatttccacctttgaatcagcaaaccctatccaaccgaagttgagtactctagagatgatattgtttatactggaaaccaatatgaaatatgtgaatgtatgtataatgtacatatatagacacatgtagaggagtatttatatatagatagagatgttcattattgactgcttagtagatataaagaagagaataaaatttaaaaataaggaaataaggaaaatgagagcatgatgtagtaatttttctatttctatttaaatgttctttcctaacatccagtttgttgtggagtcaccaaaaagcatcacctcatcaaaacacacacacacacacacacacacaccaacaaaagacataacctaccagccaaaaaaaagcccaggaccagacggatttacagctgatttctatcagaggtgcaaagaagaaaagagctgggactctttctactgaaactattccaaaaaattgaaaaggagggactcctccctaactcattctatgaggccagcatcatcctgataccaaaacctggcagagacacaacaaaaaaagaaaacttcaggccaatatccttgatgaacattgatgcaaaaatcctcaacaggctgggtgtggtggctcatgcctgtgatcccagcactttgggaggccaaggtgggcagatcacttgagagcagcagtttgggaccagcatggcaaaaccccctctctactaaaaatacagaaattagccgggtgtggtggcttgtaatctcagctacttgggtggctgaggcatgagaatcacttgaacccaggagacggagcctgcagtgagccatgattataccactgcgctccagcccaggggacagagcaagactttgtctcaataaaaaaagtcctcaacaaaatactggcaaactgaatccagcagtacatcaaaaagctaatcaaccacaatcaagtaggcctcatccatgggatgcaaggttggttcaacatactcaaatcaatagatgtaattaatcacataaacagatctaaagacaaaaaccacatgattgtctcaatacgtgcagaaaaagcctttgataaaattcaacattccttcatgttaaaaactctcaataaactaggtattgaaggaacatacctcaaaataataagagccatgtatgacaaacccatagccaataccatattgaatgggaaaaatctggaagtattccccttgaaaacaagaaagacaaaatctgcatcattccctgaggggcatttcttttcctggctcagcacataggctaaaaagaggccaagagtgagcagatctgtgagctgtggttcaacgtctggtggtggggaagagaaaagaagaaagaattgggaaggagagagaagaaacaaggccttgtgagtggggaaagatgcaggtaggagtcagtcaagtatttatcttgaggtgtctatctcacatcagtttctctttgaggcagtggttttcaaattcggcctatatcacctaaagggcttgttaaaacacagtctggggcatgcctgacaagtgtgcagctccagtgagttaccaggtgctgctgatgctgctgattggggaacacactttgagaaccactggtctaagcatcccccaagtgcacaactcaaaatcaacaatttctacctccaccttagacagcactttgctcctgtatcatggcacttctttgttttatcttggtcagagttagtagcttgatctccctcctctgtaaattctgtaggggactgaagattgtaaattcctggaaggcagaggccacagtttactcatgcctgtatcctccagagcacaaagtacggtacgtattagttagcagttgtttaatcaatgtttgtggaataaaattctagaaagtgatctgataaatatgtgtattatgtaactgatgcatacattaacctttccagagatttacatggtttgtttactgatggcaatatcttaaaaccaaacaaatgcatttctaatgatgttcatttaagcaatgcaccagatctgttgaggggatatagttttggcaaagacgtgctgactggttcttaaaccacaacggctggatttttctggctttcctgctcctctgacttatcaggagagctttgcgtacctcccgagcctccaacagccagaagtttcaagttagccactaatctgaacacacgattatcatgttctgatcacaaaatatgaaacattacaaaaggaaggctcatttaattttcacatgtacacagtccaaagataaggtgtggctccttattcgcattactctgcgaacccaaatgcacatagggagccacaccagatgggagtggctccctatctgcattactctgtgaacccaaaatatctgagacaagcctcagtcaatttagaaagtttattttgccaaggttaaggatacacctatgacacagcctcaagagggcctgacaacatgtgcccaaggtggtttgggtgcagcttagttctatacattttagggagatatgagacatcagtatgtgtaagatgtacattggttcggtccagaaaggctggacaactcgaagcaggggaggggactttcaggtcataggtagataagatacaaaaggttgcattattttgggtctctgatcagcctttcactgaatatacaattcacatggaagaggagttcgagatcagcctggcgaacatggcaaaactccatctctactgaaataccaaaaattagctgggtgtagtggcaggtgcctgtaatcccagctactctggaggctgaggcaggagaattgcttcaacctgggaggcagagggtgcagtgagctgggatcgtgccactacactccagcctaggcgacagagcaagactccatctcaaaaaaaaaaaaaaaattgtaatcattttgactgtaaaatataatttccataaacccttttataaccttttattaaggagtgggttaacattccaagaaaacttgttaatctgacacaggggcccatatgctggtcttgcatcagtgtaccttcaatattaatggttaatttatagagaaactgaactaattttatctctcaaaattggcctttacaatctcttacaccatcctcttccatggtagtccctgggccttgaggagttgaatagttttaatttctggattggtgcctcacaaacacagcttattttgattggcatcttctaccaggtctgaagatgaggctttaactggtgtcagtgtttaagatttagcaggacttggtgtcttttttagacccaggagtcaaagccttgaaacttaatggcacaaagactttaagagcaaaatacagaaagttacatggatgtgataatcttaatttaaaacaatttttaaagtctcagtttttttctaagcaaatcaaaagttagtaacaatgacataggaattattttgataaaatgtaaaatttgtttgttagaccagtcaccaaaaggcaaaagaaaagaccttctgcagtgcaattgctgttcctatgggtgtccatttagataacctgcaagtcaaactaatgaaaagggtacatcaattaatcagacataggaagagtgtttcttgggtaataagtgaaaatttttggattcatagaacaatttaaagccaagagcacagaatgttatgttggaataaaatatttcctttagacatttataaaacatttttagcatcagacttcaacaaacagttagaacctaagggaaaaaaaatcttacaggaactgaaaatgagttgaaggatagagttattatttcaggccttttaaaaagggagagaaagctgaaaatagcaagacacaaaaaagttgaactttgggttcaaaaaaattaaaatctctggtaattttattaagaataaaccaataccttaagaaaattccaggccaggcgtggtggctcacacctgtaatcctagcactttgggaggctgaggtgggtggatcacctgaggtcaggatttcgagactagcctggccaatatggtgaaaccctgtctctactaaaaatgcaaaattaaccaggcatggtggcatatgcctctaatcccaactacttgggagactgaggcaggagaatcatttgaacctgggaggcggaggttgcagtaagccactgcactccagcctgggcaacaagagcaaaactccgtctcaaaaaaaaaaaaaaagaaaattccattgttctacccaattctttagtgtataagtgctctttaaatattaaagcccaatctctagaaagaccatcataaataatttccctttaattttaggcaacttgatcataaagaccctttttttccataaattctctttttacaaaccttattacagcttacacaggccattcatgatattcatgacatgcttggactttgtggattgtcctgaacatatctctttcttaaacaaccagtcattttattctaggacaaaaatttaccatacaatattttttctcatataaaattattttgtttttaacctttcttgccaaaaatacctctttacatttataactttttttacattgcttttatttactggttaccattactttgttttataaataacttttaaataaactttgaattagacaaaaattattttcttttaaataagaacacatttcttttttttagaaaaaatgttttcttatcacttaaaaaaattggaaatgacccagacattcaatgaatatctattatttaactttagattttaaattttataagtttatttataagcatttatctcattacatttacctaattaatttttaacatagtttaaccagattacttataaaaactgtgatagttatcatttaaagttatttccctgttaaccattttataacctgtgaatttcaggttttcctaagtgagaaccttaaggttagataaatagtttttttggtgtgtttttttttttttgccaataactcaggatttagctgttttcattaattgaacaatattaaatgatttatcaaagtttacataaagataattttcctttgggctgcattcatagctttacaaccctcatgccaaattttaacatgtagcagcgataaaatataaaaccactttaccaataaatctaaacaataatgtatgttgacaattctgaagccatttctaattctgtttcatgaatactttcaaaaccagcttatttactaaaaatttacttgagtcatatgaacttgaaaaagcatttggcttaaagtatttttttctgataatttgattttggctgggtgcagtggctcacatctgtaatcccagcactttgggaggccaaggtaggcagatcacttgaggtcaggagttcgagaccagcctggccaacatggtgaaaccccgtctctaccaagaatacaaaaattagccgtggtggcacacgcctgtactgccagctacttgggaggctgaggcacaagaatcacttgaacctaggaggtagaggttgtagtcagctgagattatgccactgcactccagcctgggcaacagagcaagactctgtctcaaagaaaagaaaatttgatttaagcgcttttttttcctttaagccaattaattagagcttgttggtgtatttttagtagtgaaacattatatacatgacacataaatacatagatatattagacatgcagatagaccttatagattcataagacctcttctttttcctcctattttagacttccaatttcttgatgacccattttattaccctaggtagctgtcagctagatagccccaaatttgcatatcaaaggaatagctctcaggtgaaaaatcagatattgaaatttatatctcaaggtagagagagagagtctggtggtgctaggagattaaaaacaaatgccaaatcaaacataaatttatagaaatctatcaggattgtataaggaaataaattttatttagataggtagttctattaaatacatttagtctctatcttttaactggatctctgagctctgagcagagcacccattgaatcctgggtctccaaaaagcgagaattattatgggactagaacacatgatgcttttacagtatacttttttttaaaaaaaaagatatttctttaagtgtctaaactatactcttccttactttaaacacccaagagaaacctctgttataataactattttagttaaagaaaaaaagaaagaaagaaatcaggtaacacaataaaaaaacaagcagtttaagatctgagatgaacttgtctctttacgctctttgtgttccataaggaaaaacagaggtttctccccaaaagggagtctggcactgtctgttttctttaaggaatcccatgctattagaaactgtattggttccctcatgcagcagagggtggcaaaagaaagtagagacagcagaagtaaatggcgaaaacagaattcagtctactgagaagagaaaaaaaactttttctcaaaaaaaaaacaaggtcctaggagagaaaaaaaaaccataacaacctttttaaatacacacacacacacacacacacacacacacacacacacacatcatcatcatcatcatcatcttggatattagcttttaattaaactgacttttaaccattgagctccatttaaaaaaaaacctttttaatctcattaccatattttaactaggataaattgctgatatttcaaaagtaacacaaatatcaaaccagaaagggctttagaaaccaaacccagactgtcttgatgaaaaaaaagtgggggcagaagcttagctatggaactgctgcatggggcgacagccattactctttcagtttggcttggctaacaaaaactggccttattatgtaaataaagccctcagggtagtcaaaatcaagaacctttctcttttatccccttttgctggactgtttttccttctccctgctttttttttttttttttccagctgtggaatttagccaattcagaggtcttgttccccgtaatgtggaactttccttcagatttgatcaagttggatagagttggtcaaacccaattgtcaggcctctgagctcaagctaagccatcatatcccctgtgatctgcacgtacacatccagatggctggttcctgccttaactgatgacattccaccacaaaagaagtgaaaatggcctgttcgtgccttaactgatgacattgtcttgtgaaattccttctcctggctcatcctggctcaaaagctcccccactgagtaccttgtgaccccccactcctgcccgccagagaacaattccctttgactgtaattttcctttatctacccaaatcctataaaacggccccacccttatctcccttcgctgactctctttttggactcagcccacctgcacccaggtgaaataaacagccttgttgctcacacaaagcctgtttggtggtctcttcacagggacacgcatgaaatttggtgccgtgacttggatcgggggacctcccttgggagatcaatcccctgtcctcctgctctctgctctgtgagaaagatgcacctacgacctcaggtcctcagaccgaccagcccaagaaacatctcactaatttcaaatctggtaagcggcctctttttactctcttctccaacctccctcactatccctcaacctctttctcctttcaatcttggcgccacacttcaatctctcccttctcttaatttcaattcctttcattttctggtagagacaaaggagacatgctttatccatggacccaaaactctggtgccggtcacggactgggaaggcagccttcccttggtgtttaatcattgcagggatgcctctctgattattcacccacgtttcagcggtgtcagaccacccagggatgcctgccttggtcattcatgcttagcggcaagttccgcttttctgtgggaggggcaagtaccccaaccccttctctccgtgtctctaccccttctccacttttctgggggaggggccagaacccctcaaccccttctccttcacccttagtggcaagtcccgcttttctagggggcaagaatccccaatcccttatttccgtgccccgacctctcatctctgcacctcaaccccttatttccgtgccccgacccctttcccgcttttctggaggttaagaaccctcgaaccccttccctccatgtctctactctctcttttctctgggcttgcctccttcactataggcaaccttccaccctccattcctccgtctcccttagcctgtgctctcaagaacttaaaacctcttcaactcacacctgacctaaaacctaaatgccttattttcttctgcaatgccgcttgaccccaatacaaacttgacagtggttccaaatagccagaaaatggcactttcaatttttccattctacaagatctaaataattcttgtcataaaatgggcaaatggtctgaggtgcctgacttccaagcattgttttacacattggtctctccctagtctctgtgcccagtgcaacttgtcccaaatcttccttctttccctcccgcctgtcccctcagtcccaaccccaagtgttgctgagtctttctaatcttccttttctacagacccatctgacctctcccctcctccccaggctgctccttgccaggccgagctaggtcccaattcttcctcagcctccgctcctccaccctataatctttttatcacctcccctcctcacacccggtctggtttacagtttcattccgtgagtggccctccccgacctgcccagcaatttcctcttaaaaaggtggctgaagctaaaggcatagtcaaggttaatgctcctttttctttatcagatgtctcccaaatcagtgagcatttaggctctttcatcaaatatgaaaaacccagcccagttcatggctcgttcggcaacaaccctgagacgctttacagccctagaccctaaaaggtcaaaaggccgtcttattctcaatatacatgttattacccaatccgctcctgacattaaataaaactccaaaaattaaattccggccctcaaaccccacaacaggacttaattaacctcgccttcaaggtgtacaataatagagacagccaagtagcaacatatttctgagttgcaattccttgcctccactgtgagacaaaccccagccacatctccagcacacaagaacttccaaacgactaaaccgcagtagccaggcattcctccagaaccgcctcccccaggagcttgctacaagtgccagaaatctggccaccaggccaaggaatgcccgcaacccaggattcctcctaagccgtgtcccatctgtgcgggaccccactggaaattggatggaaatcggactgttcaactcacctggcagccactcccagagaccctggaactctggcccaaggctctctgactgactccttcccagatcttctcggcttagcggctgaagactgacgctgcctgattgcctcagaagccctgtagaccatcacagatgccaagctttaggtaactctcacagtggagggtaagtccgtccccttcttaatcaatacggaggctacccactccacattaccttattttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctgggctacagccacacctcattgccaccttttcccctagctcaaagcctccttcacatcctccccttgtatctccccaccttaacccacaagtataagacacctctactccctccttagcgaccgatcatgcaccccttaccatcccattaaaacctcatcactcttaccccgctcaatgccaatatcccatcccacagcatgctttgaaaggactaaagcctgttatcactcgcctgctacagcatggccttttaaagcctataaacgctccttaccattcccccattttacctgtcctaaaaccagacaaggcttacaggttagttcagaatctgcgccttatcaaccaaattgttttgcctatccaccccgtggtgccaaacctatatactctcctcaatgcctccctctacaacccattattctgttctggatctcaaacgtgctttctttactattcctttgtacccttcatcccagcctctcttcgctttcgcttagactgaccctgacacccattaggctcaggaaattacctgggctgtactgccgcaaggcttcacaggcagcccccattacttcagtcaagcccaaatttcatcctcgtctgttacctatcttggcataattttcataaaaacacacgtgctctccctgct

SEQ ID NO: 1422 - DNA, 40085 bp, Homo sapiens
tgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaacccgcgagcttgaggaagacggacaggtaccggggactgggggacagtgggaaaggacaggagacaggactgagggatgtgcagctggggacagaatactgagggtcggacgccggggacaaggggacaggactggacagaagacaagagaagaggtaaggaggagagggtacagtgaggtagggcaaggaacagggttggggacagaggacaggggggtaggcactggggttggagggacaggagaatgggggaggaggttcagagggcagaaggcaaagggggtggggacagcattgagagataggagccaggcgctgagaaacgggaccccggagagcaggactggctttgaggggaggcaggaaggaggggtgcggaatgagagtctgggagaggggtcagggcccgagggccacagtctggcgacgggctggggagaagaagggagggcaggggagttccagctggaggagaggcagcttcgtgggcagcgggagcggcttggggaggagagggctgggggatggggaggccacagagagattgaggcaggcaggccccggagagcaaagtcttgtcagagaaggctgggatggcagggtcactctggggccctgtgtgggaggaaggattggggtggggaggtgcactgagtcgttgggaccaaaaaggtctgggaaatgacttctggtggtgggggcacaagaagagctgagagggagcacctaagcctgccacccacacacccgttagctccctggagaccccagctccatccagctcaggaggtttccctgggtcccactccccacaccccaacccctgccctgaccctcctctgttcccacagctctgccccaaggaagccagagcgtctctgtgcaggctcccagggctgatgtccagggaccagagctgggtcctcaccctgccaagatgaacttccaggtgtaagcgaactccggagctggtgctgctcttccacgcccagacagatcacacatctgcccttcacacacagctcaccgagggcccaccctacacacaagcacacacacaggctacttgggattcacacttgtgacccaggcctgtagagactgacatgtgcggtcagtctccccaccccacataacatccacagccacacacacagaaatgaagccagtatgcatgagcacaaacacacatgtacatgcacgtacagatgcatgcacatgaaaatacgcaactctgtgtctacatatatacatcacaccacatatgtaaggagcccgtcgtttgcatccatgcccacggaaatgcatgtgcaccaacaaacacacacagacacagataaaatcatagtctcccatgagcccagggcccagcatggaggagaggcacggcagggtggccgagaagtgagatgccggcagagcagggccgggtgggtgtaacaaggcacaggttcccggggcaccaggagaggtctggggttggggggtgctggggagtaggaaagggggcaagattggaatctaagaggccttggggccctgggagctgcacccgagaagacggctttctgagggtgggtggagggaaggggacagttcgtttgcccagcaggctctgaggcccctccatcgaggcgctgggagtcaggtggtgcacccccaaccccctgcctcaactctcttctctgggaaggagccagcaccctctggaatcacaggctggtagccccagagcccctcgaagagggggcttggaccaggctcatgtgctgaggacaaagcatgggtctggggaggggacctgtgcagtgggtgggggccagcagctgaggaagaggcaaggtctagagagagaggcaggtggggaagtctgtgtccatggtgaagggaggcatagcccaagggcgagagtccacgccctctccgatcaatgcagcagggtacccacagccaggcacaggttacccacacgagtcagacagccatggggtggagacctgggacctgagttccatgtggcgcatctgggagtcctccccagcactgtccctgggctggtctagagcaaccagagccagctgaggggactgttggaactcagggaggggcctgtgctcccagctgggtctagcaaaggtaacaggaccttagcctggccaaacaacagtccactcaacagtcccctacaacaggccactctcagagcttttgctggggcacccgtgggcccaggaagggccctgcacctgcagagacgccccccggacccctgccaggcccaaggctgcttattgctctctggtgtggcttatcctccactttgaggtgatctccaaggcattcagaatcctggctgacgtcccctggccaccccgaattctccagcctcaccatcatgcgctgcgtcctcagggaatgtaaatcaatttaagtattagtctcagcgaaatggaatgggggaaggcgacggtgctggagaaaaaaagaaatcgcataatgccttccacagtcgaacaggaacggcttaggagttatctgtgcttcccagagcaggagagggacccgtttgatccccccagaacagcccgggcagataggcctaggagggatgcctatggacatctttcagataaggaaactgaggcagaggggttaagtgcttcgcttcactgaagggccctaggagaccatggagtccgatccccgtgtttggtaagcggggagatgggcccacaggggagaattggcttcacagtccggcagcgcaagaggcaggagagaggccagctgcggtgaccagagggtctgaattcccaaggggacccaggcccaggctgggtgggcctaatggtggcgttctcttcagcactcatcaaacctcctatggacttggggcttccttcaagggacactctgcgttctcacccattcaaggggacatggatggggaaggtggagatggggacagaggaagaggagggaggggagggacatagaagggtctggaatgaattggaacaaacagccctggaatcccatagcccttcctgagtccgatagaattgacttttgacttatctttggattatctgatccccctggctggttgatcaagaatcagctgcagatacggtggggcttcccccaggagggcagggcctggagagcggtgtctgcaggccctgaagcctgcacgctccagggcgagaatcctaagcagtggacatccacttgagtggctccgggatagggacaggtctgggctgcatccaggccaggtcacagaaggggcccagtcaccccgagacctgtgtctgggatgcggggtggggcggggggacccatacgtgtgtgtccttccctcaccatctccccaaactcggctttgctggtctgggggaaactgcagtgcggccccctccccctcccaccagccagcaggaggagagagcttgcctgacccagttttctctacattgcctgagagggagggaggcaggcgggaagccttctctctgcctctgcccctggcgtggggccggcttggggagggggaggtccctctgcggacattcgctgtgtcccctgatcccaagtggcccctggggacccagggaggaatgcagggaggagcgcggagaccccctccctagttctgccagcctcactccagccggcctccttcagggtccctgacggtggggtggggagggtgagaggcaggagaaaatcagcaaataagagcatcctcactccagcatttcctgaggacacttgtctctgtcttcgaggggcaggcttagagctatgcaaatctcaggcagaaggacacccagcctccccacgggaaagttccaggagagctccacctttaacccccgtcacctgcccaagcccgctgattggggtggttaaaagcccatggctgttggctgggagaaggggtcatggaaggcagagtgaaagggaaagctgtgggactctggagccaaaagccctctcatacagcaatcaccagctagatcaaaaggaagcaaagaggtgaagggacttaaccaaggacacacagcagttagagacggctgaagccggagccctgatttctaaacagcataatgcatctgtttcaccttaagtgagggtgtgaccacaagggacatggagagaggcagggggcgggggacttagagaaggggaactagtgttggtaaggaccagccctggctccaggcttcacgtaatttcctgaccctcatcccacccttaggtactatgaacccattttacagatgagaaaattgagggtcactcgctaataagtagctgccttgagacatgggcccaggaatgtctgaccccccagatgggctcttttccctaccatgttgagcctgcagggtcccctttgcagagggcctgacttagagtgactttgccctttggaccagtgctccttccctgccgtggagactacccagaggttctgtttctcgggcccgagcatccagggatggtggatggcctgccgttgctacagcaagtgctccgaatggcagctccgccagctacacctgtggggctcttggcacattcccggacctccctgaggctcggttcttttatctgtaaaatggaggtaatactggccgcctctcaggttgttgtgcggggtgcagatgaggcatctcaagctccccttgcagatattggcacatagtgggtgcccactaagaggcagctcttaccccgctaagcccctccacaccagatgtgcacggaggacgtgctaaatgccaggcaccgtgctgggggaacagggtgattatgaagctggggccagtcctcagatgggaggtatgactttgcagcatggaccttgaatgccatcatggctcttacaggagacaagggtcaggtcatcatcacaaaagccctgtgggaccggaattgttatcaccccattttacagaggaggaagctgagactcagggaggtgagggggcttgcccagggactcacagctcctaagtggcacaactgggattcagaggcctgccagcttcgagcccacctcaactatcccactgtgccaccaaccaaggatgtctggcacttggaacagcttgtgttctgggagttcagaatattactttttggccaagagggtgagaagaaggcttcagggaagagaaagaacttaaactgggccttcaaggagaggggaagagagaaagggcattcaggcagagggacccgtgtgagctgtgtgctgggggctgagtgtggaccagtgtagctgggtcaggctgctcttgaggagctggggagaagtcagaggggcctgatgccctcttgtctcctgttttacagtgaatttgctggacacgtcgaccatccacggggactggggctggctcacgtatccggctcatggggtgagtgatgggcactggggacaacgtcatccctctgtgagcagagagaggctgccactcacagagtctgcatgagatagatcaaaaggaagcagaggcccagagaggtcaagggacttacccaagggcacacagcagttagtgctgctgatctcttaacagtttagtgcatacagacccttgagattacagaaccaaccctggcaccagatccctgattcttcaagtctgaggccctaggtccggggatccccatggctgcatcctacagattcatgaggtgccaggccaggactaaagaaggccagccaggccttcctgccttctgggttgctccctccctcccagctgccctggcctcaccagtcctccgacctctggagtctctgcttgtctgtctccccaatgtggccaagctcccggtcctggccacagactctggactcagccttcaggtcgctgtgggtcatgtgctcacaggccgtgcccccatcctcctggggaagggctgcagtgagcaggctgcactgccccgtccctctgcttctcttctctgaatcctgcgggggcagggcagtagagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagggtgagccctcgatgaacataggcttttataatgatcattaacattgttactcacgtgtgttctctcacacagttactgtcacatgaacttcctctcaccagcgtgctcagaaacacacacatgcacacacacgcacgcatgtacacacacatgcacgcgcgtacacacacatgcacacgtgtgcgtgtacacacatgcacacacgcacatgcacatgcgtgggtacacacatgcacacacgtgtgcgcgtacacacacgcgcgcgcgcatacgcacatatgcacacatctctgccacaggcacgagcacattgtgcatacttgagttctttcatgtccacgttcagcttctatggctctgaggacagaagaataataatattaataatgatgatgataacgacaccaacaggtaacatttatgaagggcctttcttgactttgggtagagttttcatctgggccttttgtgggggcctgtgattggaagtgtagacacggccccacttctctctctctgggggtctggtcaccaggcagcggtgagctgagcctgttatcagccctcatgcaccgggctcccgggagctgggggcaggccacatggccctggctctccaggtccctgagcctggaggaagccctcgtcacctgacccagcaccactgcctgagcgcggacgccaggttcttgaggtgtccctttacctcccagcccatcagttccccactctgtaaaacactccttggtgtggctgtcttccccgcgtgagcgtggtgtggaagggctttggtgcagtgagctggtccccccgtggcagggttccacccatgaggaggtgggtcctggtccctccctcactgcatggcggttggctgagatggcattcccctgagtcccagcagctaggagggcacgcctgggccctggctggctccggggtgtctttatcccactcagagcatcggacttggtgtttagggtagtgaggaattgtcagggttttcagcaggtggggagcatggctggcctcgtgttttggacgctcacactggcagtctcaggtgggttttcatgcggggcgctataatgcatagctcagcgttctagcattgcatttgcgagttagaacaaatcaggcaacttagattcgctgagctctgaacaggtcacaggcgtaatctcatcactccccacaaccaatccttgaggtgggtgcagccaccacacttcacaggtgaggaaggtgaggctcagggcagtgaggagtaatttgcccatcatcaagcaggttccagctgatggcaagctgggactcaaacttgggtctctctgggcccagagcctgtggtgagtcccttccgccaccttcgaactgcaggcagcgaggcctactctgtgaccatttcatgagatggggaggcaagcctgcactctctgctgaggcagggaccacctgccatcttcagggggcctggagactggggtttctcggagaggagagaaggctggaatgagatgcctgatttccaaactctagaccttgaacctgtgccaggctagcaggtgaggcatgcagagtcccacatccaggaggtctgcagaggggcctgggaatcttctgtttaattagctttccagggagccaggcatggtggctcacacctgtaatcgtagcattttaggaggcttgcttgcgaccaggagttcgagaccagcctgggcaacatagtgagaccctttctctacaaaaaaaattaaaattagctgagagtggtggtgcacgcttgtggtccccgctactcaggaggctgaggtaggaggatcgcttgagcctgggaggtcaaggctgcagtgagccactgtactccagcctgggtaatggagagagatcttgtctcaaaaaataaaaataaaaaataataagctttccaggtgattctcctgcccagctgggagggggaacctctggagatggtccttgaggttctatccacccctctgactctggagtccattcagtaacttgaggacaagggtcacccagggcagtctccagcctcagaaatgttacccgattatcagacaggtgcagagcctgaagggccagggcactgggtcctgatgaacgggggctccgcctcctgtagtcagtgtgattcgggcagattacttacttcgcctccacctcctcatttataacgtggggacaatcttagaactgctctgtgcagtgccatcattgggctgatagatgaaaaggccattttaccaacgagaaactgaatactctcagaggcaaagcaattctacgaagactgggggaggtctggcccagaccccctgctcttcatcaggctgcgtccttccctctgctcccgggaacttccgcatgctgggacgtgctccgcctgctctggctaattaacatggactaacgaatgctgctttaggtaagtgggcaggttaatttccattgtctcactggattctcaccacgccctggagtagatggaaggagcaggcatttgctaccccattttacagaagagaagcccaagccccagagaagggatatgcctcaccaagcgctgcacagctggttcgctgcattctgatatgggaggaggacagagttgggggagcagcgtgccagagtcagtttttgggcagcggagatgagagtggcacccatcacggggtgggggtgccccaggcagagaacagggctgattctgcccttgcaccagacctccaggagtctgtgccactctgggcatcagcagctcccggggctggcagggctaggccagaccattggccccggtggggcagctggagtagactcagatggaactgattaatttatccgggtccctggcaggaaacagacagggagcagctggctggctctttggtgctccattaattgtgacaatgactttaaccccagatgtgacgctgtgctgcttggagcctctgacagcaaagcggggtgtggagcaggggtccttcttgggtcggggagactcggaagcctaaactctttcaggtgaggctggcgctccctggggcccctttggaagcaggaaatcctcccgcatggtccctggaggcaggcgcggtaggctgtgaagatgctgccagttcagtataatattagggccattcgtcaagggccttcccgtgccaggcctgagctaagcactttgcagaaattttcccattgcatcctctcaaacctcgctcaagtggggcctgtttgagtcccattttacagatgtgggcactgaggatcaagacgagattagatggaggggcttgggatgggcagaaaaagacttgagatgcccatgaccttctctctagtgcttgtggaataagcccagaactccacaggttctcagagcatctggtcatgaagcccccctccccctttaagcaataggatctctagttcaaggacaattgaaaaaggtcaaggtgttgcatgcgtggaggaaccaggacaggggcccagagaccaacccctccctctgccctcatcctccagctcctcctcagagccctcatgagtccctgaagtcagctcaacaagggactgctcctggccagccagtgctcagcagccgaggaagctaggactgtcccctcccctgtcttctgcagacctccacccttgcaagaaggtcctgcttcattgcagtgccaggttgacaggtaaactacagatgcccacacccaggagggctgggaaggggcctgggagtcttgcccacctggattccctcagctcatcaccctgcactgcctagtctggtggacccggggcacttgaggacagggagtgttcttggcatctttctttttttgagacggagtctcgctgtgtcacccaggttggagcgcagtggcacaatctcagctcactgcaaactccgtcccccgggttcacgccattctcctgcctcagcctcctgagtagctgggactacaggcgcccgccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaaacggaaactccacacccttaaacagtaactgccccctccctgccagcccctggcagccagcattctactttctgtctctctaaatctgactatctaggtactgcgtatacatggaatcctaactatttgttttttgtttctagcttatttcatttggcatgtctttaaggtgtatcagaatttccttcccttttaaggctaatactccgttgtaggtatatgccacattttgcttatctactggttcattgacgtacacttgggttccttctacgttgtggctgttgtgaataatgctgctatgaataggggtgtacaaatatctttttgagaccctgctttcaattctttgggatatatacccagaaatgggattgctagatcatatggtaattctattttaaacactttgagaagctgccatactgttttccacagcagctgcactattttacaatcccacccgtaatgcacagggttctaatttctccacatccttgccaacacttattattatcatttttttttaagagggagtctcgctctgttgctcaggctggagaacagtagtgcgatcttggctcactgcaatccctgcctcccaagttcaagtgattctcctgctgcagcctcccgagtagctgggattataggcacccgccactgcacctggctaatttttctatttttagtagagacagggtttcgccatgttggccaggctggtcttgaactcctgacctcaggtgatccacctgcttcggcctcccaaagtgctgggattacaggcgtgagccaccgcacctggccttattattattgttttttataacagccatcctaatgcgtatgaagtggtatctcattgtggttttgatttgtatttccctaatgattagtgatgctgagcatcttttcatgcaccatttggccatctgaatattttctttagagaaatgtctgttcaagtcctttgcccattttctaattggactgtttcttttctgttgttgtcgagttgtgggaattctttatgtattctggatattaatcccttatcagctacatgatttgcacatagcttcccccatttcctgggttaccttttcactctgttgagagtgtctggtttatttcggaatcactgatgcccagccagcaggcagcacagaagcaattaacactcaactttctcacatcctgggattcccttgagtgggacccaggccagcccaggggaacagcaagaagagcagggtggagggagtctgtggatcaggcaatcactcaacaagcagctgtgcaggagaggcggctgaaggatttgaagtgggggcaaggcatagtctggttcatatattagaaagattcctctggcagctgatatggaaactggacttgctgacttccccaggcaagttctcccactctaagaaagataggaggagccacagagaaatgagggcagagctttggcatcagacaggaccgattcccgtccagccattgctcgataatgacatgacctcagatgtgtggctcacaggtcagagcctctacttcctcatctcaagagttagtaaataacacttcccctgaagatcgtggccctcttcgagatcatgtctgcagggggcctggcatctagtagccaccaggaggccagctcctttgtctttttttttgccagcgtccccagcacagaacacagggtcattggcaaaagagggtgaggtgctggctctgctgtagtggctgtgttctctctgcccacagtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtgggtgagcgcgccatggcctgggcatgggtcagccggcagcggtgcttggtcttggcagggctgccagggtgtaaggggggacgtcagagcccacaggcacctgagtgacccacacagcccctgggaagatggataaacctccagtgttcctacatcaggaaatatgcgaggccacctgtgtccgtgtgttgggaaggacgtgggagcaagatgggggaggggagagggagggaaacagaccccagcgaggcggtgccttctgtgggaggtacagctaaaggcacctgtgcaattgggtatgctatgggattcctacccggattagggagtgataccatgggctaactcaggtcagacatagttctaagcactttgcgagtattaactcattgaatcctggccactacactatgacgtaggaactactgttatcctggttttatagatgaggagagacagtgaggcaaagcaacttgcccaaggtcatgcagctggggatggcagagctgggatttcaactcagaagtctggctccagagttggtgctcgaaaccgctgaacttctaacctgtagggtggagggaagtgggaccggggccctgggtgaatgagcacactgaggggtatgaagccagggacacccagggagtacagtctgggttgggcctgtccctggggccctgaacaggctgcttctgttcagggggatcttatcagggacctgtgtgagaagacaggcaagggccttgtggaggaggacagtgagaagagagcccctgggccatgacttagggtggcagctgtacccataggtgtgctgctgggttcctgtgtcggagcaggagcaaggcatgcagacgagggagcctaggcccaggtggtgtgcatgagtgtgtgtgtgcatgtgtgcgtgtgtgcgtaagtgtatgtgtgcatgtgtgtgcatgtgtgcgtgtgtgcatgtatgtgtgcatgcgtatgtatgcattgtgtgggcctgtgttcatgagtgtgtgcatgtgtgtgtatgtgtgcgtgagtgtatgtgtgcgtgagtgtatgtgtgcgagtgtatgcatgtgtgtgcatgtgcgtatgtgtgcatgtgtgcatgtacacctgtgtgtgcatgtgtatgtgtacatgtgtgcatgtgtatgtatgtgcatgtgtgtgcatgtgtgcatgagtatgtatgcatgtgtgtgcatgtagcgtcagtgtatgcatgtgtgcgtgagtgtatgcatgtgtgcatgtgtgtatgtgtgcgtgtgtgcatgagtgtatgtgtgcatgtgtgtgcgtgcatgtgtgtgcgtgcgagtgtgtgcgtgtgagtgtgcatgtgtgtatgtgtgcatgtgtgtgtctgtatacccgtgtgtgcatgagtgcatgtgtacgtgtgcatgagtctatgcctgtgtgcatatgtatgcatgtgtgcatgagtgtatgcatgtgtgtatgtgtgcgtgcatgtgtgcgtgctttagtatatgtatgcatgtctgcatgagtgtatgcatgtctgcatgtgtacgtatgtgtacgtgtgtgcatgtgtgcgagtgtatgcatgtgtgtgcatgtgcatgagtgtgtgcatgtgtgcatgagtgcattagtgtattatgcatgtgtgcatatgcgtgcatgtgtgcgtgagtgtgcacatttgttagtgtctgcatgtgtgcatgaatgcgtgtgtgcatgtgtgcatgagtgtatgtctgcgtgtgtgcatgtgtgtatgtgtatgtgtgtgcatgtgagtgtatgtatgcatttgtgcatgagtgtatgtgtgcctgtgtgtgtatgtatatgcatgtgtgcatatgtgcaagtgtatgtacggatttgtgcatgtgtgtgaatgtatgtgtacgtgtgggcatatgtatgtgtgcgtgtgtgcatgtatgtgtacatgtgcatgcctgtgtgtatatgcatgtgtgcatgcatgtgtgtatatgcacgtgtccgtgtgtccgtgtgtgcatgtgtgcatgtgtatgtatgcatgtgcgtttatgtgtgcatgtgtgtatgtatgcatgtgtgtccatgtgtatgttcatgtgtgtgagtgtatgtgtgcatgtgtatatgcatgtgtgtgcatatgtgcaagagtatgtatgcatgtgtgtgcatttgtgcatgtatgtatgcatgtgtgtgcatgtgtacgtgcatgtgtgcatgtgtatgtgtgcatgtgtacgtgtatgtgtgcatgtgtgtgtgcatatgtgcaagagtgtatgtatgcatgtgtgtgcatgtgtgcgtgaatatatgtgtacctgtgtgcatgtgtgtgtatgtatgcatgtgtgtgcatgtgagtatatgtgtacatgtgcgtgcatgtgtcagagtgtatatatgcatgtgtgcatgcatgtgtacatgagtgtatatatgcatgtgtccatgtgtgcatgagtgtatgtatgcgtgtgtgtatgtgtgcatgagtgtatgtgtgcactgtgtgcatgtgttcatgagtgtatgtatgtgtgcatgtgtttgcatgtgtgcatgagtgtatgtgtgcatgcgtgcatgcatgtatacgtgagtgtatgtctgcatggtgtgcgcatgtgtgtgtgcatgtgggggagtctgtgcagccaggcaccccaagagtggggaacactaagcaagcttgtgtggacaaacagcaggtgtccagctgttcctggtcttggccaggcttctctccgtcgttttctttggtctcatgagtggctgggcacatggtggctcagccccccgggcacagtgaagcctggctgttgagatcattggatcccctggacagaggaggtgaaagggaggaggatgtttatatgcagggatcagagagacaagagcctgtccccagatacccttagtgaaaactggaacggggcccttgtcagctgctgggaatatgcttctagccctttgctgctactatacaggccctggggccacagtgagagggacctttagtcctcatcacccatcccccagcaggcaggcaggaaaggcccctgagcgctaataggactgggcatgacataggctgacagcctcaggtgataacaggtggggatggagtccagctggctccacttaggagccgtcttgcccagagatctctggggccaggatcttccctgcagccactaggccctttgaagcccttcccggaggctctctggttttctttctttctctttttttttttttttttttttttttttggagacggagttttcacttttgttgcccaggctggagtgcaatggggtgatctcagctctctgcaacctccgcctcccggttcaagcggttctcctgcctcagcctcccgagtagctagaattacaggtgcccgccaccacgcccagctaatttttgtatttttagtagagacaagatttcaccatgttggccaggctggtctcaaactcctgacctcaagtgatccgcctgcctcggcctcccaaagtgctgggattacagtcttgagctaccacgtccaactcgctctctggttttcttaagaaatctcatttcacatccccaatttctatgagtcttctcctgtcccgagctctaaaccccaaagcaccttctgtggcatttgcccatttctggatttgttctgccctctgcagcctggtttgccaggctccccaggccacaagctctcatggttactatcacagacagccctgtgtgtcagctttgcactgggaagaaaaacaaccaacacccctattgccttcacagctcatagcggggcgcatcacataccagctcatttgctcattgcagcaaggcaggtatcacaattccattttacagatggggaagctgaggtgtaagaggtagtgttacctgcttaggccttacagctagtgagagctggagcctgaagacaggtctgtattgctctgagccaggtacaggcttttagcgtctccctagcctgccccaggctgctttgtccgccagagctgcgccaaacctcccctcattcaggtggggctaatgaaggaccttagtgatgatttttcgtctttgatgtaataattatccattctgctgagcatctactgtgtcccggcattggggatacaggtacagggagtccctgcctctggggacttagcaatttcttatccttacaacagtcctttaagataagtattatagtcccattttactgataagaaaaactgaggtccctcaacttaagtagcagagtagtgatctgatcccaggttgcctgactccagcaccttcaattgcttcctctgtgcacaaagccctctgcaaagccccacttccctcctccctggggtagcattcggatggatggttagcaactggtacagcataagtcataacaatctggctggttggccggtgcatacgcactcagggtcggccaccgtccccaagtctggatttagccagcgagtacaaatatgccaattatttgtcccaggtgaactgaaccacatctgtctgtaggaagaagacctgccctcctgtctttggggtcaagacctcgcttggaggtctcaggtaacgctgcagtctccctgtgtggcagaagagggaagcggagcccagagaggggatatgtcttgcccaattttctcagcacatcaggggtggggctctgagtggaaaccccagggcctgagtggcaggacctcacgggggctgggagaggccaaggccactcctatttcctggcactgctgccacattaataacaaataaaaagaaatgccaaagtggggttagggaattgcagcatattttgaattttacatttaaataataatacaacgtaattatgccagttgcaagataattacaggttttataaaaaatattaattcatagtgcactgcaggcagtgagatttgggaacggaaagcccgttttaagtcgcacaaggaaagacatttctcagccccgttggtggcttctttggctgcgtaacctcatttgggaaggtcagcacgggtctcaaactaaggcctttcacaaatgggagccaggtccaagagccctgcctggtccccctttctacccctggagaagcccttgacctctttggagctgcccggctccttggtggatggcctggggcaaaggaagggctgggaacagagtggggtacctttcctgggatacttgagatgtcttctgcaatctgggactgcccctgcccagcctgagggagtcttcaggagacctgctgaggtccatggggcccctgcctggtttgagaacatcctgatcccttctgggcagttctctcagcaaacagttaaggagaggaagggcgtggagtcagggggtctcagcttgcccagtcctgagcccttgtccttctagtgacaggagcaggggttgagagcctgagacccacagcaggggccaggcccccttcaacagctgccctccctgccttgggttttgcccttagaggtaccctcagaaggtggccaggcagtacttgattttgcagaagacagtatagcctgggataagggacccgccaggtcacatggctctttagaggccttgcttagattgcactcagacctcaagagacccatggaaaaatgtcagagccatgtggggttcgtccagtttaccactggggaattggaggcccagagaagtgaagtgactagcccaagggcacacagcgaggggtggttgatagaatctcacatctcccaactccttgcccagaggaagctccccacactccacaactccggatccagtgacctccccacaccagactgcacttcccagcaccccccgcaccctggttcaccccagaaagaggaagggcctctcagcgcatcacccagcggagcagcagctcagagtctgaagtcctggttgctgtccttcctgtcacctggacgcagaatataaatcacccttcgcggccctaatcatctttctataaatatcagagagtctcatttcggagggggagcaggaacagtgagctcttttgccttcctgactgtgtttaaaatctgatttagaattaatttcctttggttgtccaccagcggacaccttatttgtcaaatctccggctctttgcgggggagagcagagaggtggccagggccacaggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccactccatctgtctcagccattaattcccggcccagcctccaggtctctgggctccctgaggcctggtgattagtattcttattaaagattattttattttcattgcgtggattaatctggccttgacacattatagccatatgggtattagccgagtgtgtgagaactgccgactggtgagccacagcggcgcagccatctctcagctctgggacggtgctgggaggacggggggaaaggccatagctccagaggctcccccgcctgactgcacattctggctctgctgggaacctggggcaaggcattcaggctccctgagcctctgtttcctcttctgtcgaacaattgtaagaattccaactacatcaaattgttataacaacaagtgccaggcactgccctggcatgaatttatgtgtcttcactcatgtcatgcttgccatctccctctaaggtgggtagaattatgatctccaccttaaagacgaggaaactgacttccagcaccttgcctaatgtcactgagctcagataaagggggttagacgaggacaggaacccaggtgctacacccgagcttctgctcgggcctgacaaggaccaggtgggccctggaaagggtcagagacttgcagggccagccgtggtgctggcttccctcaggccccgcatcacgccatgaggctttgcctgtccgtctgccaatgccgtggaagctccctaagagcaggcccagctcttacttctcttgggtccatagtagaagctcagtaaatgttggggaaaggaataaatgagggagggaagaagcaaatggtctctgagatgctaatcgttgtggattggatcattacagtgaggattactgtcattcagctcagtaacaggttcaacaaatatttgctgacaaaatgcaaagcccttttctgatgatgccacccccagcggcccccggggctcagaaggagcctgtgcccaaggctgtgccccaggactgagcctcccggggggcttctgggaagaggaggcgagatcacagtgtgtcagtcaagactcctcacgactccgagctcctagacctgagctcagcccccaggcagaccagagccctcttgggatcctctggaggggagggaaagatgttgcaacaatggtgcgtattttcccccactctgcaacttacaagctctttctggctctgcagccttctagagtatgaagcaacttcagggcgttaccatttctcctgactccaggttttctctcaagtttgtagaattttacaaatgaacctggttttagcttttgtaataaagagatacgatcaacatccagagaagaaatgctctgcagtggcctgatgtctttgtaattgaaggttctctcaggcactgagttttccagaacaggatttagtggagagagaaccacagtgagcttcccagtggtccctgttgcaaaggacttcagttccatggacggagccgggagctgcctggctgggtggcatttggcccacctgaacctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcccacgggggcctcccagtctagaaggagagtcagcactgacaagcgagtacagccatagtgttgcaggtggtgaggccaagcaggggccgcaggagcagggcggggaatggtcgtttctctgtgtgtgtgtgtgtgtgtgtgtgcgcacgcgtgtgtctagagttccagaagggacagtcaaaattaatcttaaaagaggagctcagtaggtggacagaggagaaaaggcagcccaggaagcgggcacagcctgtgcaaaggccccgaggcaggaatcagactgctgggtgtggggatcggccagtgctttagtttggcctaaggatgggggtgaggggcagcactaaacaaggctccaagtgggttttggctgggcagggagggatttgaacaccaggtttcattgtctaagccctggggagcctgtgaggcatgaaacaggcagtgactgagtgagatgtgcattttggagactccctcaacctagggtatccccctccctgcacagtggactccttattctttaggccacaactcaaatatcatctcctcctctgggaagtagctcctcccaccatttacccttccatcaccttagcccccttgttctctccctccctcctagcagtgatcccagctgagagccagtggctctggttcacagccctccaaggcccaaacaggcctggtccagagttgtgctcatgaacagtggttgactgaatgcatgatcacgcaggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagcaatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccctctgcaaatgagggcagcactgggcagtgtgaaggtctgcacctccatccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagtacccttgagcccaagactgggccgggcccctgtgtttggtcctccaggcctcagagagccagttctctgctggtggggcaggggcgggtggctctcttgagccagaggccagtctgaggtggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatggtgtgtgtgcatatgtgtgtgtacccatggagttcgaatatctgattctgtgtatgccctggggccctgcagtgattgtgtgttagcgtgtgtctgtgtgagcagctgctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcacccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgcattcatgcccacatgcttgtgcacatacacacagacacacacacccaccctccctccactgccctgcccagatctgtgcattttccacatgtgggacctgttggggcagaaaaggtggccaggtgacagcgtgggcacctcaggcaagtcgagtctggccccaggtcatggacacttgcgtgaagctggctggactctggtttctttccaaacccacagttcagtgcctttaggttctggaaagcttaagatcgtaaaggctgagcttttagtattctatacccttccgatgttaaaaattctcttctcttcaaattgtaagattctgattccaagatcttacaattctattttctgaagatttaagattctctgcctggaattctgagaactggaattctgaggccaggggtccccacagacccccatgccctcttggctcaaacccccaccccagcccctcagacccccagccccacgtcctggtctcctcaaccaaggggtcacccctctctctccaaagtctttgtgctgcccagacagaggctcccatgcccggggttggggagcggctgcttggtgcacacagccatggggatacacggtgggcttctgggggcctccacttaattccacagtgcgtgctcagtggcattttgtatcggatccggcacagaagggtcaaggaatagatgtggctgcaaatacctgggtcacttacacacagggtggctgctgtgggcacccccgggactgtgcggtctctctcccactctgggtgagcagtgggatgtccagacccttggatcatggtggtcctgatgggtgggggggatggggtcccagggttctgtgcccagactctgacattgtggtcccggtctgatggcagagacacaaactctgcccttggggaggctacagaggatggagtagatgtggaccttatccttaaggagccctaaatatgatggggagcccttcccttggggagccccaggtctgatgataggaagacaggacagcccaaataaataaccactgccccatctgtcatcctctgccctcagggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaatcactcggatgatcattttccagaacagctgctacagctgcccttgggatagacttggctgcactggcttggaccacagtagtttatctatcagtttctggccagttggtgggctgaattcacccccggaacctctttcttcccaaactctggaggaccctgcccgtcaagtgacagcgtgacccaagagccctcctagggcagcttcctattaacagccaccctcacctgtgcccaagaccctcaggcccccacccaccatctcctcccaaaaccacacagccctggcctcgcagacaatatgcccaccacgtcacagaggaagaaactgaggcctggagagcacccagggccacctgacataggaagtggcagaggcagggctcaaacccaggtctgtgtcactcccaagtgaagcaggtccccccactctgaatctagggcatgctgctccctgacgccagggcctcagcccttcagaagattccctcattcgacagccctcgtggaacacccactaaatgccaagtgtggtgccaggtgctggcaacacagagagagagtgagctatgtgccccgtggtagagcccagccctggcccacctgtctctaggcacctgaggcccctggcaggctggtcccaagtggaggggagagcaagagaagttcacagcattcaggcagcatccgggatgccccaacattaaagaggaaactagaccctgccttgaacctgccttcccctccggtcaccagaccatttctcttcccatacgaccctctctgtccgtgcctggcgtatctacttcttcctctcctctgcgggacttctccatgtctttcctcacctcttcacagaaatcagcagccctgcgtggccacatccatgggcgcctcttccccctttcatttcctcctcctggaaacacttttctcttgctcgtgtgtcccagcccacgcccattttccattgacctgtgtggcctgtccctctctgtctttgtagccccacctcctttaaatggcctctaaaggccatgggtccctgggaatgtcctgggccctcctctctttcctgtgtgcccagatccatcttttctgggcggctgtttcagggcccatgactttgaattccacctttgtgctaacaacccccaactcgcggtcaccagcgaagacctctcccctaggacccagctgcccactcctgtctccattcggttatgtgaaaaacaaacaaccctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacattctccacaccagtcctgagtgagctttaaaaatagaagtgagggctgggtgtggtggctcacgcctgtaatcccagcattttgggaggccaaggcgggaggatcacttgaggccaggagtttgagatcagcctgggcaacatggcaagaccccatctctacaaaaaaaattttttttgagacaatgtctctatctgtcacccatgctggagtgtggtggcacaatcacggctcactgcagtcttgatctccggagcccaagtgatcctcccacctcagcctcccaagtagctgaccaagggcacacaccaccatgcccagtgatttttttttttttgtagagatggggtctccctatatttcccaggctgatctgaaactcctgggctcaagtgatcctcctgcctcagcctcccacagtactgggattacaggcatgagccaccatgcccagcaccaccgccccccaagttttttagatgaaaatacatgagaacaagctgtcctcaaagcccttcacagcctaggctgagcgcacatgcaattcagacattctcatggcctgtggacccacacagcttcacccctgcctgcctctccagagcacctctttccctggctcactctcttctggccatgatggtctccggtgccccctccttgaacacactgggtctttccctgctgctaggccgtggcctggcttctccttcggaatgactcactcttcccctgacattcctatgcctggctcctctgccctggaagctcccccgaccacctcagctgaaacgtgccagtgcccttccgggccctgcagtggtcttctccatcacagacagcaccccttcctacctttcccagcaccaaaagaacccccattctcctgtttattggacgccctgtctcctttcctgggacagaagctcctagagggatgtcttgggcactgcagagttcccggctcctagccccgtgcccagcatgtgataggcactcaggagtcctagaggatcaagcgacagctctaagcaaatgtggaggactgtgctcaaagaccacctgcccctcctgcctcaccatcaccacttctctacaaccaactcctccctggagccctctcggacgcgaaccccattcccctcccgctctgggccctggtctcactctgtctgcccccatcccacagcacctcctgccttggtttttaagagacacaccctgtgtgtcccttgcaaacagtggcctcatcgaatcctcccctccccctggcaagtggtgctcactagcttcactttatagaaggggacctggtgtccgcagacagcaagtgactcacccagggtcccagctagcaagagagggagccaagtcccgaacccacgcctggctcccagactggtgggctttcccctggaccacacccttccagtgcaactctggagctgcttcttaatttctcatgccagaatcctcagcagcatttattgggcacctactgtgtgcagtccctgcccccagggagctcccggttgtgctggggatgcccagacatgagggaagacttagtcacatagggcagagagtcagaactcggggtgagcagaggggaggaggaggcctgagggctggaggggcagggaggacagggcagttccctctgtttggctgtggcgtggctgtgtctgacacctcctagcagcctccccacagggctgaccgcacctgagccaggagggagagatgcatgaagaaaggcatgggtgacgccgtcaaggagggaggggtgggcgggcaaccaagtgtgactgggagaatacttggggctcagctcacccccttccctcagcatccagaactgtcccaggtatgccctccaaacccaggcagtgaggggccagttcctccattctttctacacttctttctcctgacctttcctccttcctcaagcactcccaagcagctggtccatgccgggccctgggctggggagggaggctcaagcgtcttcttgtccaagccaaccccaacatcccagaccatgccaggccacgccaaccccaggggactgaccccaagtggccaccagcgatttgttgggagaactggagggtgctggctgtcctggggctggggcaggaccatcaggaagctgagcagggctggaaccaggatccccaggtggaacctgggaagggttgggagagaggccacgccttgtctcccctccgcccatctgacgggattggccgccccagccccgtcccaggtggtggtgatccgtcaagagcgggcggggcagaccagcgtctcgctgctgtggcaggagcccgagcagccgaacggcatcatcctggagtatgagatcaagtactacgagaaggtaccacgggcaggacggagtgggaggggctgggccagcagggcagggcccactgaccaccgtcccgtggcaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccgtgagtgcagggagggggcgtgggcgcggagcagcccaggtgccaggaccctggggtcggggggtggccgaggagagagctagtgcaggctgagccagtgccaatgcaggatttctgctctccttgccctaccaagtggggttgtcggagttttttatttaattgagacagagtttcactctgccacccaggctggagtgcagtggtgcaatctcagctcactgcaacctccacctcccaggttcaagcaattctcctgcctctgcctcctcagtagctgggactacaggcacctgccaccacacccggctaatttttgtatttttagtagagacggggtttcaccatcttggccaggctggtctcgaacacctgaccttgtgatccacccgcctcagcctcccaaagtgctgggattacaggcatgagccactgctgccagcctaatttttttgtgtatttaatagaaatggggtttcaccatgttgaccaggctggtcttgaactcctgacctcaggtgatctcccaccttggcctcccaaagtgctgggattacaggcatggaccactgcacccggcctctgtcagcatttgcacagatgaaaaaccgaggttaggagaaggacggtcgctcgcctgaggcggcagagatggtgacagccccccacacaccatggctggtactgagatgagtgtcagggtctgggaccagcagcatcggtctcacctggggacttaccaaaaatgcgaattcccagtcctcaccccagcccttcagaaactctgtgggtgggcccagccatttgggttttaacaagtcctcggtgatccccaggcactgtcacatttgggaccctctgacttcgaggctgtccctttcactctcctcctgccccaatctccagccggagtcagggtctcctgtatgtgcacccactgcgtggtggaggtagggcagagctagtgaccgcccacctggcgctccctgggcgtctgagtgcctccagtgcttgtaggcctggcaccccctggagaccacccagatgggaatcctgagccctccatcccatgtactgtgtggcctcaagtcaattcctcgagttctctgagcctctttccatctgaaaactgaagatagtgctggggtctctctggaagggacgtggggagggtttactggggcttgaaggtacagctctcagcacactccgtgttgtcactgtcaggataacagggaggacaggcatttattggctcagaggacacgcgactcttctccggtaccacagccacaagaagcagcggcaccagcattaggaagctgggcatccaggtctcacgaacttgaagaggaagcttagtagagggtggggtgggaacagaggaggaactggcctgcgccctgactctgggctggctcatggctctgggctccccactggccccagggtcacagccaggcaggctcagaggtctgccagacccctgggcccaaggccagggctgagagcctggtcccccaaccctggctttcccctgcagggccccgctatgacaccaggaccattgtctggatctgcctgacgctcatcacgggcctggtggtgcttctgctcctgctcatctgcaagaagaggtgggtggtctggcccagccacacccagcccctcctctcaagcaccgtacctcctgcctgcccccagccccaccgagccggtggtccccgtgtgcctggggctggctcacttacaaacacaccacctcatttaacctagtgacatgccagtgatgtagagattctgacctcactttgcaggtgagtaaattggggatcagagaggttagtcttcttgccagaatcacacagctgataaatgccagagctaggacatgagcctaggtctgtcaaactcaagcccatactctcagttactttgtcctctcccactccattttggagggaggtggagacaggatagtgtgtgggcttgggatcccagacaatgagaactgtaaggatcatctaactgatggagaaatggagacccagggaagagaaggggctggccaaggtcatccatgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagcctggagtcagggactctcccctgcagactttgtaaggagcaggagctgacctgtcaggggaaggggcatgaagagagaagccatgactcgttccctggttggggtcaggtcccgggctaggggtggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagggtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctccctccacaccccactcctgtgcccgtggcagacagcatcaagcatggtgctgattcccaccaggcctgggtgcagcctcagactcctccttaactactttttatttttattttattttattattttttattttttattattttttttttctgagacagagtctcactctgttgccaaggctggagtgcagtggctcaatctcagctcactgcaacctctgcctctggagttcaagcaattctcctgcctcagcctcccaagtagctcagattacaagcattcaccatgcactactaatttttgtatttttagtagaacgaggtttcaccatgttgtccaggctggtctcgaactcttgacctcaagtgatccgcccgcctcggcctcctaaaaagctgggattataggcatgagccatcacgcccagccagaaactattttcaatgaatcaaagttgacccttgtggcaaaaacttatttttgctacatccctactccagaacaatttagaaagatctcaaggactgtaaaagtgaccccagaaaatgacagacatgcccagaactcactggagactccacagccccatagaaaccccagagcgactccagagaccccactttcacttgggaaatacttatggggtgcgtgttgtttgctaccacatccagagactcccagagacacccctcaccccaccccagacccatcccaggcccagggaatgtcaggaaaaagcaatctctcctgggccccactgaaggccctcctcccgcccctcagcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggtgagtctcaggggttgtgagggcggggccagcatggggcaaggtgggggcacccagggcaaggtgggggcacccagggcagagggagcgtgtgacccaggggtctggcaagcccagggggtccaagggcctgggaggctgggggagtctgagggtcccactgccctccctccacacctgcccctctcggggcctgcaggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggtaggtgccgggcaaagacagcctccccctgcagtgcccctcctgcctggagaggcctctgggtccatcccctcatccatcctgctctgccccacctgaccctgtcctcttggttcaggtccctgaatgactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccacccctgcctcttgcatgggcttggggagggaggtccagtctgggtgctgggagatagtgcaaagccctctaagccccctccctggcttggacaccacaggccgggggacaggaggcaggtatagggaggaggtcttcgagttcagccagtcgaactgcctttcggcccccattgcatgaaagtccctctgctccatgggatcctgctgccctgcacacaggctgaggggggtgcctctgtgggaatccaggccccacccagctggggggcatgctggctgtggtggagacggctggattcccagctcctgcccacagtttctttgctgggtgctcttaggcacagagcttaacctctctgggcctccatctctcgttccacaaaatgggtaagcagtcattgctgccccacgtacctcgcagggttgctgtgagggtaaatgagaccaggagaataacccttaactgcaaagtgcttcagaagtagtggcgcacttggcaaattgcaaagcaccgtctcaactcgagagcatcctacagatgggaggtgttcctgttcacggaccaggcgcctccccgggctttcctgaagtccaagccatgtccccctgcagacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaaccattctgcaagtagctgaatgaagttggcagtttcggggtggccctcaacctggggcacatcctgtttctcctcttcacgccagtgccttcctctgggaaatgggaacagccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagctgagtgcatgggggccagttttcaccctggccccaataggagccctcccttagcctctgtcccacagcctctgggtaaggtttcgcatggagaaaggatcctgtgacaacaaaagaaagaaggaaggaaaggaaggagggagtggagagagggagggagggaggaagaagggaaggaaggaagggagggagggaaggaaggaaaggagggagggaggaaggagggaaggaaggaaaggagggagggaggaaggagggaaggaagggagggagggaaggaaggagggagggaggaaggagggaaagaagggagagagggaggaagggggagggaaaagaaaggagggaaggaaggagaaagaagaaaggaagggaggggagggaagaggagaggaggggagggaagggaggaagggaaggagggagggagtgggggaggaaggaaggaagggagggaaggagagaagggacgagggagggagtgggggagggagggagggagggaggaaggaaggacaagaaggaaggagagaaggaggaaaggagggacggagggaaggaaggagggaagggagagaaggagggagggagtggaggaggaaggaaggggggatggagggaggaaggaagggagggagggaggaaggagagaaggaggaaggaaggagggaaggagagaaggaaggaggagggagggagggaaggagggaggcaggaaggaaggaaagaaggagggaaggaaaggagggagggaggaaggtgggagggaaagaagaaaggagggaaggaaggacagaaggaggaaggaagaagggaaggaaggaagggatgaggaaaggaaggaagggaagaggaaaagaagggaggaaggaagaagggaagggaggagaaaggagaaggaagtgggggaagagaaggaagaggaagagttagaaaacgactaggctgtggcccctgagcccccttggcttgtggctggtattggccgagcatctgcttgtaccaggcgtctcactccctccttccttcgtctccacagcggctcttgtgaggcctccctcaggacaggtgctctgggacggtgggggctgtgttgtccctctggactggaaaacaggaccccagtgtttagctctctgactcagacggctcgggggacaccctgccaggcctgggcagcccctcaactcttgtgtgtccgtcgcagggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtgagtgccaagccctggcaggtccgcgggcggtggagcctcagggtgcagggagggacggctgagcccagcgctgatcccctgcaggtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgccttgtgcccaccccagctccttgaggcccagctgcctcccagtattgccccagatctgtccctgggacagtttggccctgacactaggaccaggcccagcctgggcccccggcccctgccctgccgaaccccttcctcagcctgcttcttctgggggtccagcctcccgaaccctctggccacttaccaagagcccctgtgcctcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccagtgagtgatgggtggggctggggccccatgcgtgtgggggcagggggggggacccctgccggggaggctacaggtccagatccatggccctggctgcgtgcgcggctcccagcctcccaggcccagctggccagcagcacccttccttcacagggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccaagcccaccccaggtcatgccagcggcagaggacgtgaggggctggcagcaggcagggcggccccaggcctctgccctcctctcaggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacacctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacaccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatcttt

SEQ ID NO: 1423 - DNA, 26110 bp, Homo sapiens
tgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaacccgcgagcttgaggaagacggacaggtaccggggactgggggacagtgggaaaggacaggagacaggactgagggatgtgcagctggggacagaatactgagggtcggacgccggggacaaggggacaggactggacagaagacaagagaagaggtaaggaggagagggtacagtgaggtagggcaaggaacagggttggggacagaggacaggggggtaggcactggggttggagggacaggagaatgggggaggaggttcagagggcagaaggcaaagggggtggggacagcattgagagataggagccaggcgctgagaaacgggaccccggagagcaggactggctttgaggggaggcaggaaggaggggtgcggaatgagagtctgggagaggggtcagggcccgagggccacagtctggcgacgggctggggagaagaagggagggcaggggagttccagctggaggagaggcagcttcgtgggcagcgggagcggcttggggaggagagggctgggggatggggaggccacagagagattgaggcaggcaggccccggagagcaaagtcttgtcagagaaggctgggatggcagggtcactctggggccctgtgtgggaggaaggattggggtggggaggtgcactgagtcgttgggaccaaaaaggtctgggaaatgacttctggtggtgggggcacaagaagagctgagagggagcacctaagcctgccacccacacacccgttagctccctggagaccccagctccatccagctcaggaggtttccctgggtcccactccccacaccccaacccctgccctgaccctcctctgttcccacagctctgccccaaggaagccagagcgtctctgtgcaggctcccagggctgatgtccagggaccagagctgggtcctcaccctgccaagatgaacttccaggtgtaagcgaactccggagctggtgctgctcttccacgcccagacagatcacacatctgcccttcacacacagctcaccgagggcccaccctacacacaagcacacacacaggctacttgggattcacacttgtgacccaggcctgtagagactgacatgtgcggtcagtctccccaccccacataacatccacagccacacacacagaaatgaagccagtatgcatgagcacaaacacacatgtacatgcacgtacagatgcatgcacatgaaaatacgcaactctgtgtctacatatatacatcacaccacatatgtaaggagcccgtcgtttgcatccatgcccacggaaatgcatgtgcaccaacaaacacacacagacacagataaaatcatagtctcccatgagcccagggcccagcatggaggagaggcacggcagggtggccgagaagtgagatgccggcagagcagggccgggtgggtgtaacaaggcacaggttcccggggcaccaggagaggtctggggttggggggtgctggggagtaggaaagggggcaagattggaatctaagaggccttggggccctgggagctgcacccgagaagacggctttctgagggtgggtggagggaaggggacagttcgtttgcccagcaggctctgaggcccctccatcgaggcgctgggagtcaggtggtgcacccccaaccccctgcctcaactctcttctctgggaaggagccagcaccctctggaatcacaggctggtagccccagagcccctcgaagagggggcttggaccaggctcatgtgctgaggacaaagcatgggtctggggaggggacctgtgcagtgggtgggggccagcagctgaggaagaggcaaggtctagagagagaggcaggtggggaagtctgtgtccatggtgaagggaggcatagcccaagggcgagagtccacgccctctccgatcaatgcagcagggtacccacagccaggcacaggttacccacacgagtcagacagccatggggtggagacctgggacctgagttccatgtggcgcatctgggagtcctccccagcactgtccctgggctggtctagagcaaccagagccagctgaggggactgttggaactcagggaggggcctgtgctcccagctgggtctagcaaaggtaacaggaccttagcctggccaaacaacagtccactcaacagtcccctacaacaggccactctcagagcttttgctggggcacccgtgggcccaggaagggccctgcacctgcagagacgccccccggacccctgccaggcccaaggctgcttattgctctctggtgtggcttatcctccactttgaggtgatctccaaggcattcagaatcctggctgacgtcccctggccaccccgaattctccagcctcaccatcatgcgctgcgtcctcagggaatgtaaatcaatttaagtattagtctcagcgaaatggaatgggggaaggcgacggtgctggagaaaaaaagaaatcgcataatgccttccacagtcgaacaggaacggcttaggagttatctgtgcttcccagagcaggagagggacccgtttgatccccccagaacagcccgggcagataggcctaggagggatgcctatggacatctttcagataaggaaactgaggcagaggggttaagtgcttcgcttcactgaagggccctaggagaccatggagtccgatccccgtgtttggtaagcggggagatgggcccacaggggagaattggcttcacagtccggcagcgcaagaggcaggagagaggccagctgcggtgaccagagggtctgaattcccaaggggacccaggcccaggctgggtgggcctaatggtggcgttctcttcagcactcatcaaacctcctatggacttggggcttccttcaagggacactctgcgttctcacccattcaaggggacatggatggggaaggtggagatggggacagaggaagaggagggaggggagggacatagaagggtctggaatgaattggaacaaacagccctggaatcccatagcccttcctgagtccgatagaattgacttttgacttatctttggattatctgatccccctggctggttgatcaagaatcagctgcagatacggtggggcttcccccaggagggcagggcctggagagcggtgtctgcaggccctgaagcctgcacgctccagggcgagaatcctaagcagtggacatccacttgagtggctccgggatagggacaggtctgggctgcatccaggccaggtcacagaaggggcccagtcaccccgagacctgtgtctgggatgcggggtggggcggggggacccatacgtgtgtgtccttccctcaccatctccccaaactcggctttgctggtctgggggaaactgcagtgcggccccctccccctcccaccagccagcaggaggagagagcttgcctgacccagttttctctacattgcctgagagggagggaggcaggcgggaagccttctctctgcctctgcccctggcgtggggccggcttggggagggggaggtccctctgcggacattcgctgtgtcccctgatcccaagtggcccctggggacccagggaggaatgcagggaggagcgcggagaccccctccctagttctgccagcctcactccagccggcctccttcagggtccctgacggtggggtggggagggtgagaggcaggagaaaatcagcaaataagagcatcctcactccagcatttcctgaggacacttgtctctgtcttcgaggggcaggcttagagctatgcaaatctcaggcagaaggacacccagcctccccacgggaaagttccaggagagctccacctttaacccccgtcacctgcccaagcccgctgattggggtggttaaaagcccatggctgttggctgggagaaggggtcatggaaggcagagtgaaagggaaagctgtgggactctggagccaaaagccctctcatacagcaatcaccagctagatcaaaaggaagcaaagaggtgaagggacttaaccaaggacacacagcagttagagacggctgaagccggagccctgatttctaaacagcataatgcatctgtttcaccttaagtgagggtgtgaccacaagggacatggagagaggcagggggcgggggacttagagaaggggaactagtgttggtaaggaccagccctggctccaggcttcacgtaatttcctgaccctcatcccacccttaggtactatgaacccattttacagatgagaaaattgagggtcactcgctaataagtagctgccttgagacatgggcccaggaatgtctgaccccccagatgggctcttttccctaccatgttgagcctgcagggtcccctttgcagagggcctgacttagagtgactttgccctttggaccagtgctccttccctgccgtggagactacccagaggttctgtttctcgggcccgagcatccagggatggtggatggcctgccgttgctacagcaagtgctccgaatggcagctccgccagctacacctgtggggctcttggcacattcccggacctccctgaggctcggttcttttatctgtaaaatggaggtaatactggccgcctctcaggttgttgtgcggggtgcagatgaggcatctcaagctccccttgcagatattggcacatagtgggtgcccactaagaggcagctcttaccccgctaagcccctccacaccagatgtgcacggaggacgtgctaaatgccaggcaccgtgctgggggaacagggtgattatgaagctggggccagtcctcagatgggaggtatgactttgcagcatggaccttgaatgccatcatggctcttacaggagacaagggtcaggtcatcatcacaaaagccctgtgggaccggaattgttatcaccccattttacagaggaggaagctgagactcagggaggtgagggggcttgcccagggactcacagctcctaagtggcacaactgggattcagaggcctgccagcttcgagcccacctcaactatcccactgtgccaccaaccaaggatgtctggcacttggaacagcttgtgttctgggagttcagaatattactttttggccaagagggtgagaagaaggcttcagggaagagaaagaacttaaactgggccttcaaggagaggggaagagagaaagggcattcaggcagagggacccgtgtgagctgtgtgctgggggctgagtgtggaccagtgtagctgggtcaggctgctcttgaggagctggggagaagtcagaggggcctgatgccctcttgtctcctgttttacagtgaatttgctggacacgtcgaccatccacggggactggggctggctcacgtatccggctcatggggtgagtgatgggcactggggacaacgtcatccctctgtgagcagagagaggctgccactcacagagtctgcatgagatagatcaaaaggaagcagaggcccagagaggtcaagggacttacccaagggcacacagcagttagtgctgctgatctcttaacagtttagtgcatacagacccttgagattacagaaccaaccctggcaccagatccctgattcttcaagtctgaggccctaggtccggggatccccatggctgcatcctacagattcatgaggtgccaggccaggactaaagaaggccagccaggccttcctgccttctgggttgctccctccctcccagctgccctggcctcaccagtcctccgacctctggagtctctgcttgtctgtctccccaatgtggccaagctcccggtcctggccacagactctggactcagccttcaggtcgctgtgggtcatgtgctcacaggccgtgcccccatcctcctggggaagggctgcagtgagcaggctgcactgccccgtccctctgcttctcttctctgaatcctgcgggggcagggcagtagagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagggtgagccctcgatgaacataggcttttataatgatcattaacattgttactcacgtgtgttctctcacacagttactgtcacatgaacttcctctcaccagcgtgctcagaaacacacacatgcacacacacgcacgcatgtacacacacatgcacgcgcgtacacacacatgcacacgtgtgcgtgtacacacatgcacacacgcacatgcacatgcgtgggtacacacatgcacacacgtgtgcgcgtacacacacgcgcgcgcgcatacgcacatatgcacacatctctgccacaggcacgagcacattgtgcatacttgagttctttcatgtccacgttcagcttctatggctctgaggacagaagaataataatattaataatgatgatgataacgacaccaacaggtaacatttatgaagggcctttcttgactttgggtagagttttcatctgggccttttgtgggggcctgtgattggaagtgtagacacggccccacttctctctctctgggggtctggtcaccaggcagcggtgagctgagcctgttatcagccctcatgcaccgggctcccgggagctgggggcaggccacatggccctggctctccaggtccctgagcctggaggaagccctcgtcacctgacccagcaccactgcctgagcgcggacgccaggttcttgaggtgtccctttacctcccagcccatcagttccccactctgtaaaacactccttggtgtggctgtcttccccgcgtgagcgtggtgtggaagggctttggtgcagtgagctggtccccccgtggcagggttccacccatgaggaggtgggtcctggtccctccctcactgcatggcggttggctgagatggcattcccctgagtcccagcagctaggagggcacgcctgggccctggctggctccggggtgtctttatcccactcagagcatcggacttggtgtttagggtagtgaggaattgtcagggttttcagcaggtggggagcatggctggcctcgtgttttggacgctcacactggcagtctcaggtgggttttcatgcggggcgctataatgcatagctcagcgttctagcattgcatttgcgagttagaacaaatcaggcaacttagattcgctgagctctgaacaggtcacaggcgtaatctcatcactccccacaaccaatccttgaggtgggtgcagccaccacacttcacaggtgaggaaggtgaggctcagggcagtgaggagtaatttgcccatcatcaagcaggttccagctgatggcaagctgggactcaaacttgggtctctctgggcccagagcctgtggtgagtcccttccgccaccttcgaactgcaggcagcgaggcctactctgtgaccatttcatgagatggggaggcaagcctgcactctctgctgaggcagggaccacctgccatcttcagggggcctggagactggggtttctcggagaggagagaaggctggaatgagatgcctgatttccaaactctagaccttgaacctgtgccaggctagcaggtgaggcatgcagagtcccacatccaggaggtctgcagaggggcctgggaatcttctgtttaattagctttccagggagccaggcatggtggctcacacctgtaatcgtagcattttaggaggcttgcttgcgaccaggagttcgagaccagcctgggcaacatagtgagaccctttctctacaaaaaaaattaaaattagctgagagtggtggtgcacgcttgtggtccccgctactcaggaggctgaggtaggaggatcgcttgagcctgggaggtcaaggctgcagtgagccactgtactccagcctgggtaatggagagagatcttgtctcaaaaaataaaaataaaaaataataagctttccaggtgattctcctgcccagctgggagggggaacctctggagatggtccttgaggttctatccacccctctgactctggagtccattcagtaacttgaggacaagggtcacccagggcagtctccagcctcagaaatgttacccgattatcagacaggtgcagagcctgaagggccagggcactgggtcctgatgaacgggggctccgcctcctgtagtcagtgtgattcgggcagattacttacttcgcctccacctcctcatttataacgtggggacaatcttagaactgctctgtgcagtgccatcattgggctgatagatgaaaaggccattttaccaacgagaaactgaatactctcagaggcaaagcaattctacgaagactgggggaggtctggcccagaccccctgctcttcatcaggctgcgtccttccctctgctcccgggaacttccgcatgctgggacgtgctccgcctgctctggctaattaacatggactaacgaatgctgctttaggtaagtgggcaggttaatttccattgtctcactggattctcaccacgccctggagtagatggaaggagcaggcatttgctaccccattttacagaagagaagcccaagccccagagaagggatatgcctcaccaagcgctgcacagctggttcgctgcattctgatatgggaggaggacagagttgggggagcagcgtgccagagtcagtttttgggcagcggagatgagagtggcacccatcacggggtgggggtgccccaggcagagaacagggctgattctgcccttgcaccagacctccaggagtctgtgccactctgggcatcagcagctcccggggctggcagggctaggccagaccattggccccggtggggcagctggagtagactcagatggaactgattaatttatccgggtccctggcaggaaacagacagggagcagctggctggctctttggtgctccattaattgtgacaatgactttaaccccagatgtgacgctgtgctgcttggagcctctgacagcaaagcggggtgtggagcaggggtccttcttgggtcggggagactcggaagcctaaactctttcaggtgaggctggcgctccctggggcccctttggaagcaggaaatcctcccgcatggtccctggaggcaggcgcggtaggctgtgaagatgctgccagttcagtataatattagggccattcgtcaagggccttcccgtgccaggcctgagctaagcactttgcagaaattttcccattgcatcctctcaaacctcgctcaagtggggcctgtttgagtcccattttacagatgtgggcactgaggatcaagacgagattagatggaggggcttgggatgggcagaaaaagacttgagatgcccatgaccttctctctagtgcttgtggaataagcccagaactccacaggttctcagagcatctggtcatgaagcccccctccccctttaagcaataggatctctagttcaaggacaattgaaaaaggtcaaggtgttgcatgcgtggaggaaccaggacaggggcccagagaccaacccctccctctgccctcatcctccagctcctcctcagagccctcatgagtccctgaagtcagctcaacaagggactgctcctggccagccagtgctcagcagccgaggaagctaggactgtcccctcccctgtcttctgcagacctccacccttgcaagaaggtcctgcttcattgcagtgccaggttgacaggtaaactacagatgcccacacccaggagggctgggaaggggcctgggagtcttgcccacctggattccctcagctcatcaccctgcactgcctagtctggtggacccggggcacttgaggacagggagtgttcttggcatctttctttttttgagacggagtctcgctgtgtcacccaggttggagcgcagtggcacaatctcagctcactgcaaactccgtcccccgggttcacgccattctcctgcctcagcctcctgagtagctgggactacaggcgcccgccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaaacggaaactccacacccttaaacagtaactgccccctccctgccagcccctggcagccagcattctactttctgtctctctaaatctgactatctaggtactgcgtatacatggaatcctaactatttgttttttgtttctagcttatttcatttggcatgtctttaaggtgtatcagaatttccttcccttttaaggctaatactccgttgtaggtatatgccacattttgcttatctactggttcattgacgtacacttgggttccttctacgttgtggctgttgtgaataatgctgctatgaataggggtgtacaaatatctttttgagaccctgctttcaattctttgggatatatacccagaaatgggattgctagatcatatggtaattctattttaaacactttgagaagctgccatactgttttccacagcagctgcactattttacaatcccacccgtaatgcacagggttctaatttctccacatccttgccaacacttattattatcatttttttttaagagggagtctcgctctgttgctcaggctggagaacagtagtgcgatcttggctcactgcaatccctgcctcccaagttcaagtgattctcctgctgcagcctcccgagtagctgggattataggcacccgccactgcacctggctaatttttctatttttagtagagacagggtttcgccatgttggccaggctggtcttgaactcctgacctcaggtgatccacctgcttcggcctcccaaagtgctgggattacaggcgtgagccaccgcacctggccttattattattgttttttataacagccatcctaatgcgtatgaagtggtatctcattgtggttttgatttgtatttccctaatgattagtgatgctgagcatcttttcatgcaccatttggccatctgaatattttctttagagaaatgtctgttcaagtcctttgcccattttctaattggactgtttcttttctgttgttgtcgagttgtgggaattctttatgtattctggatattaatcccttatcagctacatgatttgcacatagcttcccccatttcctgggttaccttttcactctgttgagagtgtctggtttatttcggaatcactgatgcccagccagcaggcagcacagaagcaattaacactcaactttctcacatcctgggattcccttgagtgggacccaggccagcccaggggaacagcaagaagagcagggtggagggagtctgtggatcaggcaatcactcaacaagcagctgtgcaggagaggcggctgaaggatttgaagtgggggcaaggcatagtctggttcatatattagaaagattcctctggcagctgatatggaaactggacttgctgacttccccaggcaagttctcccactctaagaaagataggaggagccacagagaaatgagggcagagctttggcatcagacaggaccgattcccgtccagccattgctcgataatgacatgacctcagatgtgtggctcacaggtcagagcctctacttcctcatctcaagagttagtaaataacacttcccctgaagatcgtggccctcttcgagatcatgtctgcagggggcctggcatctagtagccaccaggaggccagctcctttgtctttttttttgccagcgtccccagcacagaacacagggtcattggcaaaagagggtgaggtgctggctctgctgtagtggctgtgttctctctgcccacagtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtgggtgagcgcgccatggcctgggcatgggtcagccggcagcggtgcttggtcttggcagggctgccagggtgtaaggggggacgtcagagcccacaggcacctgagtgacccacacagcccctgggaagatggataaacctccagtgttcctacatcaggaaatatgcgaggccacctgtgtccgtgtgttgggaaggacgtgggagcaagatgggggaggggagagggagggaaacagaccccagcgaggcggtgccttctgtgggaggtacagctaaaggcacctgtgcaattgggtatgctatgggattcctacccggattagggagtgataccatgggctaactcaggtcagacatagttctaagcactttgcgagtattaactcattgaatcctggccactacactatgacgtaggaactactgttatcctggttttatagatgaggagagacagtgaggcaaagcaacttgcccaaggtcatgcagctggggatggcagagctgggatttcaactcagaagtctggctccagagttggtgctcgaaaccgctgaacttctaacctgtagggtggagggaagtgggaccggggccctgggtgaatgagcacactgaggggtatgaagccagggacacccagggagtacagtctgggttgggcctgtccctggggccctgaacaggctgcttctgttcagggggatcttatcagggacctgtgtgagaagacaggcaagggccttgtggaggaggacagtgagaagagagcccctgggccatgacttagggtggcagctgtacccataggtgtgctgctgggttcctgtgtcggagcaggagcaaggcatgcagacgagggagcctaggcccaggtggtgtgcatgagtgtgtgtgtgcatgtgtgcgtgtgtgcgtaagtgtatgtgtgcatgtgtgtgcatgtgtgcgtgtgtgcatgtatgtgtgcatgcgtatgtatgcattgtgtgggcctgtgttcatgagtgtgtgcatgtgtgtgtatgtgtgcgtgagtgtatgtgtgcgtgagtgtatgtgtgcgagtgtatgcatgtgtgtgcatgtgcgtatgtgtgcatgtgtgcatgtacacctgtgtgtgcatgtgtatgtgtacatgtgtgcatgtgtatgtatgtgcatgtgtgtgcatgtgtgcatgagtatgtatgcatgtgtgtgcatgtagcgtcagtgtatgcatgtgtgcgtgagtgtatgcatgtgtgcatgtgtgtatgtgtgcgtgtgtgcatgagtgtatgtgtgcatgtgtgtgcgtgcatgtgtgtgcgtgcgagtgtgtgcgtgtgagtgtgcatgtgtgtatgtgtgcatgtgtgtgtctgtatacccgtgtgtgcatgagtgcatgtgtacgtgtgcatgagtctatgcctgtgtgcatatgtatgcatgtgtgcatgagtgtatgcatgtgtgtatgtgtgcgtgcatgtgtgcgtgctttagtatatgtatgcatgtctgcatgagtgtatgcatgtctgcatgtgtacgtatgtgtacgtgtgtgcatgtgtgcgagtgtatgcatgtgtgtgcatgtgcatgagtgtgtgcatgtgtgcatgagtgcattagtgtattatgcatgtgtgcatatgcgtgcatgtgtgcgtgagtgtgcacatttgttagtgtctgcatgtgtgcatgaatgcgtgtgtgcatgtgtgcatgagtgtatgtctgcgtgtgtgcatgtgtgtatgtgtatgtgtgtgcatgtgagtgtatgtatgcatttgtgcatgagtgtatgtgtgcctgtgtgtgtatgtatatgcatgtgtgcatatgtgcaagtgtatgtacggatttgtgcatgtgtgtgaatgtatgtgtacgtgtgggcatatgtatgtgtgcgtgtgtgcatgtatgtgtacatgtgcatgcctgtgtgtatatgcatgtgtgcatgcatgtgtgtatatgcacgtgtccgtgtgtccgtgtgtgcatgtgtgcatgtgtatgtatgcatgtgcgtttatgtgtgcatgtgtgtatgtatgcatgtgtgtccatgtgtatgttcatgtgtgtgagtgtatgtgtgcatgtgtatatgcatgtgtgtgcatatgtgcaagagtatgtatgcatgtgtgtgcatttgtgcatgtatgtatgcatgtgtgtgcatgtgtacgtgcatgtgtgcatgtgtatgtgtgcatgtgtacgtgtatgtgtgcatgtgtgtgtgcatatgtgcaagagtgtatgtatgcatgtgtgtgcatgtgtgcgtgaatatatgtgtacctgtgtgcatgtgtgtgtatgtatgcatgtgtgtgcatgtgagtatatgtgtacatgtgcgtgcatgtgtcagagtgtatatatgcatgtgtgcatgcatgtgtacatgagtgtatatatgcatgtgtccatgtgtgcatgagtgtatgtatgcgtgtgtgtatgtgtgcatgagtgtatgtgtgcactgtgtgcatgtgttcatgagtgtatgtatgtgtgcatgtgtttgcatgtgtgcatgagtgtatgtgtgcatgcgtgcatgcatgtatacgtgagtgtatgtctgcatggtgtgcgcatgtgtgtgtgcatgtgggggagtctgtgcagccaggcaccccaagagtggggaacactaagcaagcttgtgtggacaaacagcaggtgtccagctgttcctggtcttggccaggcttctctccgtcgttttctttggtctcatgagtggctgggcacatggtggctcagccccccgggcacagtgaagcctggctgttgagatcattggatcccctggacagaggaggtgaaagggaggaggatgtttatatgcagggatcagagagacaagagcctgtccccagatacccttagtgaaaactggaacggggcccttgtcagctgctgggaatatgcttctagccctttgctgctactatacaggccctggggccacagtgagagggacctttagtcctcatcacccatcccccagcaggcaggcaggaaaggcccctgagcgctaataggactgggcatgacataggctgacagcctcaggtgataacaggtggggatggagtccagctggctccacttaggagccgtcttgcccagagatctctggggccaggatcttccctgcagccactaggccctttgaagcccttcccggaggctctctggttttctttctttctctttttttttttttttttttttttttttggagacggagttttcacttttgttgcccaggctggagtgcaatggggtgatctcagctctctgcaacctccgcctcccggttcaagcggttctcctgcctcagcctcccgagtagctagaattacaggtgcccgccaccacgcccagctaatttttgtatttttagtagagacaagatttcaccatgttggccaggctggtctcaaactcctgacctcaagtgatccgcctgcctcggcctcccaaagtgctgggattacagtcttgagctaccacgtccaactcgctctctggttttcttaagaaatctcatttcacatccccaatttctatgagtcttctcctgtcccgagctctaaaccccaaagcaccttctgtggcatttgcccatttctggatttgttctgccctctgcagcctggtttgccaggctccccaggccacaagctctcatggttactatcacagacagccctgtgtgtcagctttgcactgggaagaaaaacaaccaacacccctattgccttcacagctcatagcggggcgcatcacataccagctcatttgctcattgcagcaaggcaggtatcacaattccattttacagatggggaagctgaggtgtaagaggtagtgttacctgcttaggccttacagctagtgagagctggagcctgaagacaggtctgtattgctctgagccaggtacaggcttttagcgtctccctagcctgccccaggctgctttgtccgccagagctgcgccaaacctcccctcattcaggtggggctaatgaaggaccttagtgatgatttttcgtctttgatgtaataattatccattctgctgagcatctactgtgtcccggcattggggatacaggtacagggagtccctgcctctggggacttagcaatttcttatccttacaacagtcctttaagataagtattatagtcccattttactgataagaaaaactgaggtccctcaacttaagtagcagagtagtgatctgatcccaggttgcctgactccagcaccttcaattgcttcctctgtgcacaaagccctctgcaaagccccacttccctcctccctggggtagcattcggatggatggttagcaactggtacagcataagtcataacaatctggctggttggccggtgcatacgcactcagggtcggccaccgtccccaagtctggatttagccagcgagtacaaatatgccaattatttgtcccaggtgaactgaaccacatctgtctgtaggaagaagacctgccctcctgtctttggggtcaagacctcgcttggaggtctcaggtaacgctgcagtctccctgtgtggcagaagagggaagcggagcccagagaggggatatgtcttgcccaattttctcagcacatcaggggtggggctctgagtggaaaccccagggcctgagtggcaggacctcacgggggctgggagaggccaaggccactcctatttcctggcactgctgccacattaataacaaataaaaagaaatgccaaagtggggttagggaattgcagcatattttgaattttacatttaaataataatacaacgtaattatgccagttgcaagataattacaggttttataaaaaatattaattcatagtgcactgcaggcagtgagatttgggaacggaaagcccgttttaagtcgcacaaggaaagacatttctcagccccgttggtggcttctttggctgcgtaacctcatttgggaaggtcagcacgggtctcaaactaaggcctttcacaaatgggagccaggtccaagagccctgcctggtccccctttctacccctggagaagcccttgacctctttggagctgcccggctccttggtggatggcctggggcaaaggaagggctgggaacagagtggggtacctttcctgggatacttgagatgtcttctgcaatctgggactgcccctgcccagcctgagggagtcttcaggagacctgctgaggtccatggggcccctgcctggtttgagaacatcctgatcccttctgggcagttctctcagcaaacagttaaggagaggaagggcgtggagtcagggggtctcagcttgcccagtcctgagcccttgtccttctagtgacaggagcaggggttgagagcctgagacccacagcaggggccaggcccccttcaacagctgccctccctgccttgggttttgcccttagaggtaccctcagaaggtggccaggcagtacttgattttgcagaagacagtatagcctgggataagggacccgccaggtcacatggctctttagaggccttgcttagattgcactcagacctcaagagacccatggaaaaatgtcagagccatgtggggttcgtccagtttaccactggggaattggaggcccagagaagtgaagtgactagcccaagggcacacagcgaggggtggttgatagaatctcacatctcccaactccttgcccagaggaagctccccacactccacaactccggatccagtgacctccccacaccagactgcacttcccagcaccccccgcaccctggttcaccccagaaagaggaagggcctctcagcgcatcacccagcggagcagcagctcagagtctgaagtcctggttgctgtccttcctgtcacctggacgcagaatataaatcacccttcgcggccctaatcatctttctataaatatcagagagtctcatttcggagggggagcaggaacagtgagctcttttgccttcctgactgtgtttaaaatctgatttagaattaatttcctttggttgtccaccagcggacaccttatttgtcaaatctccggctctttgcgggggagagcagagaggtggccagggccacaggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccactccatctgtctcagccattaattcccggcccagcctccaggtctctgggctccctgaggcctggtgattagtattcttattaaagattattttattttcattgcgtggattaatctggccttgacacattatagccatatgggtattagccgagtgtgtgagaactgccgactggtgagccacagcggcgcagccatctctcagctctgggacggtgctgggaggacggggggaaaggccatagctccagaggctcccccgcctgactgcacattctggctctgctgggaacctggggcaaggcattcaggctccctgagcctctgtttcctcttctgtcgaacaattgtaagaattccaactacatcaaattgttataacaacaagtgccaggcactgccctggcatgaatttatgtgtcttcactcatgtcatgcttgccatctccctctaaggtgggtagaattatgatctccaccttaaagacgaggaaactgacttccagcaccttgcctaatgtcactgagctcagataaagggggttagacgaggacaggaacccaggtgctacacccgagcttctgctcgggcctgacaaggaccaggtgggccctggaaagggtcagagacttgcagggccagccgtggtgctggcttccctcaggccccgcatcacgccatgaggctttgcctgtccgtctgccaatgccgtggaagctccctaagagcaggcccagctcttacttctcttgggtccatagtagaagctcagtaaatgttggggaaaggaataaatgagggagggaagaagcaaatggtctctgagatgctaatcgttgtggattggatcattacagtgaggattactgtcattcagctcagtaacaggttcaacaaatatttgctgacaaaatgcaaagcccttttctgatgatgccacccccagcggcccccggggctcagaaggagcctgtgcccaaggctgtgccccaggactgagcctcccggggggcttctgggaagaggaggcgagatcacagtgtgtcagtcaagactcctcacgactccgagctcctagacctgagctcagcccccaggcagaccagagccctcttgggatcctctggaggggagggaaagatgttgcaacaatggtgcgtattttcccccactctgcaacttacaagctctttctggctctgcagccttctagagtatgaagcaacttcagggcgttaccatttctcctgactccaggttttctctcaagtttgtagaattttacaaatgaacctggttttagcttttgtaataaagagatacgatcaacatccagagaagaaatgctctgcagtggcctgatgtctttgtaattgaaggttctctcaggcactgagttttccagaacaggatttagtggagagagaaccacagtgagcttcccagtggtccctgttgcaaaggacttcagttccatggacggagccgggagctgcctggctgggtggcatttggcccacctgaacctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcccacgggggcctcccagtctagaaggagagtcagcactgacaagcgagtacagccatagtgttgcaggtggtgaggccaagcaggggccgcaggagcagggcggggaatggtcgtttctctgtgtgtgtgtgtgtgtgtgtgtgcgcacgcgtgtgtctagagttccagaagggacagtcaaaattaatcttaaaagaggagctcagtaggtggacagaggagaaaaggcagcccaggaagcgggcacagcctgtgcaaaggccccgaggcaggaatcagactgctgggtgtggggatcggccagtgctttagtttggcctaaggatgggggtgaggggcagcactaaacaaggctccaagtgggttttggctgggcagggagggatttgaacaccaggtttcattgtctaagccctggggagcctgtgaggcatgaaacaggcagtgactgagtgagatgtgcattttggagactccctcaacctagggtatccccctccctgcacagtggactccttattctttaggccacaactcaaatatcatctcctcctctgggaagtagctcctcccaccatttacccttccatcaccttagcccccttgttctctccctccctcctagcagtgatcccagctgagagccagtggctctggttcacagccctccaaggcccaaacaggcctggtccagagttgtgctcatgaacagtggttgactgaatgcatgatcacgcaggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagcaatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccctctgcaaatgagggcagcactgggcagtgtgaaggtctgcacctccatccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagtacccttgagcccaagactgggccgggcccctgtgtttggtcctccaggcctcagagagccagttctctgctggtggggcaggggcgggtggctctcttgagccagaggccagtctgaggtggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatggtgtgtgtgcatatgtgtgtgtacccatggagttcgaatatctgattctgtgtatgccctggggccctgcagtgattgtgtgttagcgtgtgtctgtgtgagcagctgctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcacccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgcattcatgcccacatgcttgtgcacatacacacagacacacacacccaccctccctccactgccctgcccagatctgtgcattttccacatgtgggacctgttggggcagaaaaggtggccaggtgacagcgtgggcacctcaggcaagtcgagtctggccccaggtcatggacacttgcgtgaagctggctggactctggtttctttccaaacccacagttcagtgcctttaggttctggaaagcttaagatcgtaaaggctgagcttttagtattctatacccttccgatgttaaaaattctcttctcttcaaattgtaagattctgattccaagatcttacaattctattttctgaagatttaagattctctgcctggaattctgagaactggaattctgaggccaggggtccccacagacccccatgccctcttggctcaaacccccaccccagcccctcagacccccagccccacgtcctggtctcctcaaccaaggggtcacccctctctctccaaagtctttgtgctgcccagacagaggctcccatgcccggggttggggagcggctgcttggtgcacacagccatggggatacacggtgggcttctgggggcctccacttaattccacagtgcgtgctcagtggcattttgtatcggatccggcacagaagggtcaaggaatagatgtggctgcaaatacctgggtcacttacacacagggtggctgctgtgggcacccccgggactgtgcggtctctctcccactctgggtgagcagtgggatgtccagacccttggatcatggtggtcctgatgggtgggggggatggggtcccagggttctgtgcccagactctgacattgtggtcccggtctgatggcagagacacaaactctgcccttggggaggctacagaggatggagtagatgtggaccttatccttaaggagccctaaatatgatggggagcccttcccttggggagccccaggtctgatgataggaagacaggacagcccaaataaataaccactgccccatctgtcatcctctgccctcagggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcattaaaaaataa

SEQ ID NO: 1424 - DNA, 329857 bp, Homo sapiens
aggcgcggcggggcgcggggcgtggggacgctagcgggcgccggacgggcgcggcgccccgtcacgggcagcgccccgaaccggggccggacacctcggccgctcgggccgcggcggcggggaccatgccgaagaaagtctcctgagcccggcaacttcggcccctccccgcccccacccggctgccctccgcgcggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggtaaggaagctgggcaggcgctagggcggcgccgacagcgcaaagttgtgcggcggggagagggtcgcggcggggacttctcgcgctgccaccgcgcgccgccgccgccccgggtctctccaggtgctaagcccgtgagcatctgtgccgcggtcgggagcgccttcttcctcccgcgcgtccgactgtcctcaccgaggcgggggcgccgctgggttgcgctgccggcaggtaccccggggcgaggcaccgctcaccttccccccgccccacctccgccacccggatccggactggggcggagtggatgggtgtgtggggtgtgccggagtgtgtgtatcttcaggcctggcggcgcggggagtggcgaagggaagggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaacccgaggatcctcggcgctgtgtgcgtctcaagctcaagtcaaaacttgtgtgtgtgtgtgtgtgtgtgtgtgtgtgtgtgtgtgtgtgtgtgtgtgtgtggtttattaggagagaggccgcctgtctttagcagaagtaaggaaggggtttgacgggagggaaagagccgctccagcgagaaggcgtgaccccgcagctccctcgtctcggctgcgggagccaggggtgccagggacaggcgagcgcaagcccaggtcgcaaggacgatgctggcactcgcgttcgagccaagggaggatgcagatccctcccaagtctgtggccagaagaggtcgtgcgggggtgaaggctgggagagctccagcttcttgcaagcatccgaagtgataagcctgagcatctgcacgatgagagcgagtgcggggaagcagagccaccgaagtgctggaaagaaaatgggccaaatgacccgggccagctggaggctgccacagttaccccaaacgtcacttcgtggcagaagccacaggtctagatagtagaccgtttggagaaaagagaaaagaaaaggaaaaaaaaaaaacccaaaacaaacaaacaaaacaaagcaaaacaaaaacaaaaccacatcagccaagttacaaatgtgttagggcatttggaaatgtagatgtggataaaataatattctttaccttgtacaagacctcatattttaaaagttacacttttatttctttataaactttggggaactacagattacaggaaaagttggcccaagtagatttccatagcatttggtttcatagaggatttggggcaatatatcctttattagggaatcaaacctcttcttttcataagttctgtattgtggagtctcatagcttcctccactctctgacacctgctagtgccacaaaagttaacagtattttcatcaccagcagcaatccctgttaacaggcattgggaggcaagcgttgaggctcagggtctttctccattaaatctgacagtgaattcttgtggaagttctttttaagtaatagatggaggccaggggtgtagggaaaagtgtaatggaccaggatggaagtcatctgtgctcattgtcctcaaagcacctggcctcgtgtagggtactcagacttcataggcctggtgtttcatggcagaattagaagccacacctgactgtcaatgaaacctccacccagctcctaaagttttggggttctgacacctttcttgaggaagggaaattctgggaggaggaaggagcaaaggtactactgaggataaaatcaagacatttcaacatatattgcattaacattttcactttatatttccaaacaatgaggcctaataaatttgggtggtcagttggtagaagggtgaattctcagcttctgctcaggaaactaggaagaactgaaagattgaatgctgctcctgttactagctgatcattatatttctgactgatgtgataggttcaaaatgacatcattgtgaactgaaaatagaatacccttggccaaatttgttccctgttacgtaaatataatgatttttgggaaaagtgggcttgtggtattttggatggtctaaaatatacctttaataatataaggccactgtgtctgcagaattactttcccctgttttcctccattcttttattttagtgtctgtcaaaacaaaacttgtggttagtaaacacatcctctcaatttcctcagccaattttggcagcaagtatttttcgtaaatgtaagttcatgtaaagtaaaaattttccaaatcaaaatatgtttatatcaaacacttttctttacagagtattatttcagtatacttatacaatattctatgtctgacacacaatggccactcaataaatattggttgaattaatgacccaacctgttgtatcaaacaggtagtgtgatatttaacgtactgaatattctcataggaaagccaagagacagtagcattcatagtaaaagctagtatttatcacgcatgtgccagtcagtgcatacacagggtgacattcaatctgcacagcaacactgtcggtaggttctattgttatttccattttctgtatggaaaaaatgagggcaaagagttatgaaggacacatagcaagcgaggcaggacttcaacccatgtctgtctgattgcaatacccattgcatagcactatgggcagtttaagggagaaaatggaaggacagccaagatgcaaatgggaatctaaagatcgggactggctaaaaacgatccatcacatttacatccataattccactttccttttcttgatacttgtactctgagtatcttgaggagccagcagagaagggaaataattcaagcagctggtttgctttaactctacctttccgtattaatccccactatgtggcctccatttatttagggaactagaccctccctgagctggacaacaactgggagtaatgttggtcggactcgcatcttccgggcgttttctctttctttagcagttgtgctatgtctaggctagtggttcccaatgtgggtccttggacctgccgcatcagcctcacctgggaatttgtcacaaatgtacatgctaaggtcttatcccaaagctgctgaagtctgggcacagggcccagcaatctgtgcgtcagcaagtcctctaggtgattccaacgcagagaatttgagaaccattgttgttgagcaacaacaaagtattgctttctggaggcttcccatgtatttgagagaaaggaggaatgtgaggcggggtgggtagatttataaagtatttaaaggtactttaatactttaaagtatttaaaaatgtgatttaaaaatgtacatggtttcagtttttaatttcaacttttaaaaatgcatcttgtttgctacttaagccccactgttttgagggaaggaccagccaacggcacccaccccagctggctttagaccttccaaggttaggagaggtgtgacgtgaggagtaggctgacgtggggcaaccggaaagcatagtgtggggaaggacgagaacagagccactgatgatgctttctcttccccataggagacagtggtgaacagtccttcttcctagtcaatttggggaaaggcagagtatgttctacttagagaatgttctgctgtaacacatttgaaaagagtaaaggaagtgatggggaggaaaatcatgcaaggataactgttatcttgatttcccaccctgagattgggtggagggggagcacaaacatacattggggtaaatagaaatatatagcaaatgctacacttaagcttggagaccatggtctttccaattcagtgaattttttttttttgaaatggcattcaaactttgttttgctatggaaaacaaacaaaaaatcaaataaaatctcccccagaaattaggttatgatgcagccttgctgccagtagccttattacttatgagctgtggaaatatcaaaaacttggaataagactcattgatataaacagaataagccagatggcttactactgatcttgtacaaccgacaaactctaatgatctatcatccagccttggatatgtgatttagactttatgggagctaaacttgttggactcattcccagctgatatgctttcctttccatttttaatttataccactttaaatggagatatagaactttagttctcagaattgccaatctttacgtatattatatatgagcctggcaatttagagtcaaaaaatgaaaagtatgtcatgttattgaatttgaaattctctaagtttaagtgcatttaaaggaaaatgtgaaaatagaggtccatatctgttacaaaatagtttctttgaacctaaaaagccaaattttatttttcttctgcatttcacacatggtataaatataatactttaggctccaaacagtaatctaggaaatgaatgcataaaatatgacgttatcaatagaaattgttgacatagaaaaaatgatattcttgttcatagctacaagtttatattgtggggttggttggggacacagtggcactatattagagaaaggatagaaaatggaattcagctatggtaatccgttctgtaaacaaatagcatgaatggtgaaaagcaatctgccttgtaaactattttttaatgtagactagtcttagtatgaattgtctaagaacacatataaatgtggattatctaaatactgtctttcttcaaattccctgtcatcaatccaggcttaagacagtggttagttttgttttggagaaactggaaagaaagtggtcaaggtttttgagtcccaaaataaatagtatcttttgcttcctcagagggagactgaaggagcaaaaacagtagcttgacctgcagctgtactggtgggtgtccatgatggacaatgaaaacgcatcttatttgatggattgtagctgctagaattattaggagttgctgctttttttttgttttttggaaagaagacttgaccacaaattaattttgtcataaatatatttatttgtattacatagaaactcggctttaagcaaacagtgatatacataaatccctttttatcagaaatagggacagaaacactaacatttcacaaaaattcttatttgcaaaagtcaatgtagcaactgttttgcaagagaattccaaataaagtacatttcagcatttgctattagtttttaaacagctttgttgagatataattcatataccatataattcacccatttaaagtttttaatagtttaatagcttttaatatattatagatatgtgtaaccattgccacaattttagattttcatcaccacaaggagaaacgccataccctttatccaacacttttgccccatcaaccccagtcctaagcaaccgctaatttactttctgtctgtatagatttgcctattcttggcattttatagaaatagaataatataatatgtggtcttttgtgattggcttcttttacttgacataatgttttcaaggttcattcatgttatagcatgtgtcagtacttcattcttttttatggctgaataatatttcctaagaattttttttattgcggaataaaatgttccataagactgtatggatattccacattttgtttatccattcacccattaatggacatttgggttgttttcaccttttgtctactgtaagtagtgctgctatgaacatttgtgttgcaagcttttgtttcaacacctgttttctgttcttatgggtatatacctaggagtgggattgctgaatcatatggtaactctaagtttaagttattgaggaactgccaagctgtttctacagtggctgcaccattttacatcccccgccaagaaagtatgagaattccaatttcttcacatcctcactgccatttcttattttccatttttttattatagccatcttaatgggtatgaagtggtatattcattggcgttgtgttttgcattaatgatgtcgagtatcttttcatgtgcttgttgactgtttgtatatcttctttggaaaaatgtctattcacattttgctgattttttttttttttttgagattggaggctcgctctgttgcccaggctggagtgcagtggcgcgatctcagctcactgcaagctctgcctcccaggtacacgccattctcctgcctcagcctcccaagtagctgggactacaggcggccgccaccatgcctggctaatttttttgtattttttagtagagatggggtttcactgtgttagccaggatggtctcgatctcctgacctcgtgattcgcccgcctcggcctcccaaagtgctgggattacaggcatgagccaccgcgcccggccactgattttctttaaaaaatttatttccataggttttaggggaacaggtggtatttggttacgtgagtaagttctttagtggtgatttgtgagatttttgtgcactcgtcacccaaggagtatacacagaactcaatttctggtcttttgtccctcacccccttcccaccctttctccctgagtccccaaagtccattgtgtcattcttatgcctttacatcctcatagcttagctcccacttatgagtgagaacatatgatgttgagttttccattcctgagttacctcagttgcctatttttgaattgggttgtttgtatttgtgttgttgagttgtaaacattatttatatattcttaacagtagacccttttcagatatatgatcttgctattaatttgggggttgggaaatatgatactgacttaaatacaatactgttatgtattgttcactatattataggtgttcaccttatcaaggagcaagaaattagttttatatgtaaatgagttttaaagtgttaagtacggtacctgggtatatagtaaaacctaaataaactctaaagatggattgaaaacaaggatctgttctaaagaatcctgggggtcttgttttacagttatggattactttgaatattaaacactttacatttatctctaaggtatgataattcatggatagttaacacttaacctattttagagatgtcacaaagattgctgtgacttgtatgtggaatatgaatttagctaatttttgaacagcagattatagtacaatggttatattttgtctttatatttgctcactagaatggagccgatgagctcagcaggagaaaacatttgggtttattatgttccttatacaatatatgaagcaaccaaggaaatcttaagcattctcatgaaattggaattcatatgcaatttattttgtattcatgttgtggtataatatgaaggacaaatatataggaacagtatttgctacgtatgtttctcttgagtaaaataacttatgagttttaagaagaaatattgtttttacaaaaatgacagaaaattttagtaggtttcaaaaatatatataatcaaaataagaagctctaaaataactgcagtcaattagatgctgcttggcctcagtttgaataattggcaacactctctgaaatggtctgcctctatgtctctacccaaatctcatcttgaattgtagttcccataatccccacatgttgtgggaggaaccctgtgggaggtaattgaatcatgggggcggttaacccccatgctgttcttgtgatagtgagttctcatgagatctgatggtttcttttttttttctttttttttttaatacacattccccaaaactggattactggggtccagtattccaattatgagcatttttaatttattaaattttgttaaatattttagatcaaaatgttgaagtaatttacacataattcacatttcctgccacctccacagagctagatgtcatctctatagttctggtaatcatccaggtgaaaaatggtaatattttttaattatactttaagttctagggtacatgtgcacaacgtgcaggtttgttacatacgtatacatgtgccatcttggtgtgctgcacccattaactcgtcatttacattaggtatatctcctaatgctatccctcccccctccccccaccccacgacaggccccggtgtgtgatgttccccttcctgtgtccaagtgttctcattgttcaattcccacctatgagtgagaacatgcggtgtttggttttttgtccttgtgatagtttgctgagaataatggtttccagcttcatccatgtccctacaaaggacatgagctcatccttttttatggctgcaaagatctgatggtttcataaggggcttttcccctttgctcagcacttctctctcctgccaccatgagaagaaggatgtgtttgcatccccttctgccatcattgtaagtttcttgaggcatacccagccatgtggaactgtgagtcaattaaacctctttcctttaaaaatcacccactctcaggtatgtccttatagcagcatgagaacggactaatacactgtcattcaaaattaccagggaaccagatatagctgcttagtcttgaagctacgccatacctcttggtctgtctcagggtttatattgattgtctataatttccccaaaactgccactgattcatttttgttgtctcgctgcctgcttagacttctgctaatgtctttgtactgattgtttaggaaggtacaattccaattaggatctctaaactcctgtaagtatttgtttatttcatgatctcttatgaagttttgacattctaccttgtattgtgatcatctgtgagcaagcaccttgaagggaggaagcttattcagtgcttcgcatccctgctctgacatctcttctgggtgctccacacaggccctcaggaagtggctgttgattcagtatatttgctgagcaactgttcttcactaggattccaaatcctgctttgtttggtctctatttagagaatatggggagggatgccaagaaggactctagctcagttgatgcctttagcctatttctttcttgctctttgaagctgatgctccaagcaaatacattacaaccacttatgacatatgagtacatatagttttgtttagaggtggttgcccattctagagtgtagtggtgccatcagagctcactgcagcctcaacctcctgggctcaagccatcctcccacctcagcttcttgagaagctgggactacaggcacaagccatcatacctggtaacacaaacatttccttctgtgcacagagataactgtccacttcttacctttgggcatttggaattacacttttagagctctctctgtaattaagaatagctgagatcagtttagagatttgtgtgcatacagttagaatgcaaacttcttgttacttgtcattttctgaaatcctagaccagttgttttggaagtttgcagaatagctgttatttctgtaggttagtgtcttctttaggtagcaatttgtgttaaattagccagtatgtttcaagcatgactttaagtcatgaaggagatgagaccgtggaatgatgtgatttttgaaatagggactgaacagagtttaacctagaactgcaacacgaccatactgtaaaattaggtctcaatccaccaacccatttacacttgtttggtgaaagatactataataaccttaagtcatggctttgattaggcaattcttagttaattcattaatagatgatttaaataacctattacctttaactgtactgcatttctggaaacaccattgctgttttttagttcaaggagtacaattttcataatcttgatgaaagaaaaatgagaatattctgagacatatgaattcctttgttcagtcattcaacaaatattcatggaaggccttctttggggcagaagcatcaggcagtaggaaggatataggttttggagcagagctccgggtgtgaagcactgtgttaccatttattagctgggacagcttgaataattttattaacttctctgaacctctgatgttttgatgtatacaataggattaataattgctgttttacaggatacttctctaacccaaggcctgacatttaagttcaacaattgccaattttctcagcttgttctttgcttccctttaactccctcttcatttagcacacatacacatatgagtgtacacacacactcatatcagaacacagctgggggagtatacagattcactgataacctgacttccaattgaaagaagcaatcaaacctagaaatacacaattacttcactagtatttggcaagggctcttcaacacctgacaagttccggtaattcatccatcccactaattacatatatgtaccccttcctgcttcttctcttctgcttcctggagatagtctttaaatgacacattttttgcacagcctgatttcctctgttttgaatttatccacactactttttttgttcctgcattcacaaaataaaaatagctgtgtggagggagtatgctggcgcttactctctgggatagccagctgttctaggattgcactagtgatccataagatacatcctttcagaaataatcacaatgccaggcatacactgtgcctgctcccagaacttcccccattcatgacgaaactaccacgtccagtagtacgcccactttcttttctcagttcccacttccctctcattgacagtcagagcaagagcagtgaaccgcagaagcagatcttgtgtcttcacttgcttgtttcccaagctcagcctctctgtgttgccttgctctgttagcctccagtaggtgttgcggcaagtgagagccataccatctggcatggccaatcacccagttccttgagcagttgaaggcaaatgctgattttacattatttcgtagaaagttgtattttgtttggggaccttaaaaaccctgaccttgtcatccagcacagagcttcctgctttaacacaaaggctgtttgacatgaatgccttcccattggataaacagaaccgtcaggcagagccatgcggctggatggagggggcactaggcctgggtgtgcagggtgacccgacaataagtcagttgtcggtgttaagtcatgtgagcctccaaggcttcagtgtcttcatctctacaatgaaggagtttcattagatccatgattctcagctgtttccgttccttaggaccctcatccatagcagtgtttccatagggtcttgactgtccctatgggaatacatctcagtggccaggagagggagaaagggcatggcattggaagtccttttaaaaaagtccctgagctcacgcctgtaatcccagcactttgggaggccgaggtgggtggatcacgaggtcaggagatcgagaccatcctggctaacatggtgaaaccccgtctctactaaaaaatacaaaaaaattagccgggcgtggtcgcgggcgcctgtagtcccagctactagggaggctgaggcaggagaatgtcatgaacccaggaggcggagcttgcagtgagccgagatcgcaccactgcactccagcccgggcgacagagcgagactccatcccaaaataaataaataaataaaaataaaaaaataaaagaatgcggcgtacgcggtggttcacgcctgtaatcccagctccctgggaggccgaggcggacggatcacaaggtgaggagatcgagaccgtcctggctaacacggtgaaaccccgtctgtactaaaaatacaaaaaattagccgggcatggtggtgggcgcttgtagccccagctactcgggaggctgaggcaggagaatggtgtgaacccgggaggtggagcttgcagtgagacaagatcgcaccactgtactccagcctgggcgacagagcgagactctgtctcaaaaaaaaaaaaaaaaaaaaaaaagtccctgaggtaatttttctgtgcactcccaggggagagtgtttcttttctcttgagaatcactgaagtagatcgttctaagatctctgctgttcttcaaatcatgtgctgaaagagacaagaggtcatataattgtagcaactgaaacaaatataaggctattttctttggacccaaacacttattttaaaaattgcagaagtcaagtgaccaaggcaagtagaatacacaaaaacattttaggccatcgttgtcattttctgagtcttaatcatagttaaattttttctaaaattaaaatcagcagtgcgtttcctccacctccgccagaacttgctctagaaattaggggaagcagaatgtccccaggaagtcctaagagagaagaagcagagtaagacatgggtttccagagtttagagtctcactatgtgataggtgaaagctgtgttgttgatgaggatttgcacagcctcctcccggttgcctgctactgaccatcccatttcactgtgggcagctccagtgggtaagagggttcttcacagtgtggtgagctactcctttctagcctccatccattttttgctgttcttctggaagctatataggcttgtctattggactttatagtcttcaaataattgaagatactaaaatgactattatgtctaccctgctctgctacacacataaatcttgtccagacaaataggtctgtttaccagtactttctcatcagaagtcatttgaagacacagaaagtaaaaaccacaaagaaaaaaaaaactatattaaagtgaaagctcaacagtaacaccccataaccatagcaaaacaaaacaaaacaaaacaaaacaaaacaaaaaaaaaccacaaacatctccccaggaaatagaactaatatgcaggtctttaaaagttcagtttatcaatgagaaaaagataaaccaactcacgagataaatgggcagagtacaggagcagtcacagaagaggagacacggctggccagtaagcacaaagagaaatgaaatggttttgattcccttacacatcttagcccccttcctctgtctacatggcccgtaaaagccacagaactgaacagttttccagttccctcagtgagcctgctttgtgcagtggtatgttactgtcagaagggatcctcttcgaagctgtggtatttgagaatgactgctcctcccaccgcttttctgagggtgttagcaggagtgcaacagagccttacttcaaggcccccagcgggctggctggaaccctgcttcagctcctccaagcacgtgcggccaagttctgggagccacgtcgatgtgggttgatgggtcccctgagacgccctctctgctcagaacacagccagtaagccatgggcagatcacaacaaacagcaccctgccttctgctccgcctccctccatctaccacactgccaagttcctaagaagcttaggggagaaggaactgctgtggtgcttagaatgcagtgtcttgcctgaaagtattttctcagtctttgagaaaacagtggaactgactcatctggtcagagctttacagaaatgtgattgcagatctcttgcaatttcattctgctttagtgtcagaattcatccgacaacgtgccaaaaaaaaaaaaagtgtgtaaaatcacatacagatttagatacttcaagaggaagttatttttaccacagtggggaagaaaccagaaagtgccgattggtggagaatgcccggcagggctgaggaaggagggtgggcacctgagcaacctgggcctggccacactcacccctgcagccttgccagcctggcccggggattgtggtgtggtcacctcttagcaggtggagggaggagttcctgtgtggaagatctgcttgaaggaggaaatgttgatataacccccgagtgtggagccaacttcagcagtgcggggttaacatgggttactcttgaaaatgtgttgcgtgctctcccaacagtccatagaagcagctctctaacagctgcatgggacacaaaagtaaaaatggagaaacgattccagaaaaccacataaatataaaaaccaaatggcgcagtgtctttattttgttttggcagataacaggattgaggccaccttgttttctttgctcatgcatttcccaactcaaaaggctgttcttgtttgcttgtagagcagagatccaaggcctgagagaccctgaaatgtttgtagttatattcttcattcgtgctgcgagataaagagttttcccagaaactaaagggagggaacaggaaatatttgttaagatccataacctctggcttttgtctcctcttttcacctgggcaaaggatatcagtgataatattttgggtctcataagatgatgaattgttcaaatgtatttggagaatactttattcaagcatctttgtctttctttcctattccttgtggctgaagagaggcatgtgctttttatgcaagggtcttgaaatgtatgcagttaccatggtggcactctgtctctgacccaaactctgtcatagagtgtatgtttagccatgttttcaggggtgcttcctagcgtggtcaggagaaactgctagagctgaatttggttgctgggcaggcttctatcttttttttttttttttaatagatgcagggagtataagtgcatgctttttacatgggtatattgcataatggtgaggtttgggttcctagtgtacccattacccaaatagtgaacactgtacacaaaaggtaatttttcaatcatcaagccttttctccctccctgcttttgagagtccccattgtctgttatttccctctgtatgtccatgtgtacccattgtttagctctcacttctaagtgagaatgtgtggtatttgagtttttgtttctgagttacttcacttaggacaatggtcttcagctccattcctgttgctgcaaaagacatctgtatatagaccacattttctttatccagtcatctgttgatggacagttagtttcattccctgactttgctgttgtgaatagtgctatgataaacatacaagggcaggtgtttatttgatagaatgattcttttccttcccgtagatacccagtagtgggattgctgggtcgaatggtagttcgatttttagttctttgagaaatctccatactgttttccacagaggttgtactaatttacattcccactaacagtgtgtacatgttcccatttctccccatccttgccaacatctgttgttttttgactttttaatactagtcattctgactggtgtgagatggtatctcattgtggttttaatttgcatttctctgataattagtgatactgagcattttctcctttgtatttttgtgggctgcttgtatatcttcttttgaaaaatgtctgttcatgtcctttgcccactttttaatagggttatttgcttttttcttgttgagttatttgagttccttgtatagattctggatattagtcctttgtgggatgcatttttgcaaatattttctccctttctgcaagttgtttgtttactctgttgattctttctttgctgtacagaagctctttagtttaattaagtcccttttgtttatttttgtttttgttgcattgcttagccatatattctttgcccaggccaatgttcagaagagtttttcctaggttttcttctaggattcttatagtttcaggttttacctttaagtctttaattcatcttgagttaactttttatatggtaagaaaaggggtccagtttcattcttctgcatatggctgtccaatttttccagcaccacttattgaatagggtatcctttccccatcgtatatttttgccaactttgtttatgatcagttggttgtaggtaagcggctttatttctgggttctctactatcttctattgctctatatgtctgtttttgtaccagtaccatgctgttttggttactatagtcttgtagtataatttgaattcagataatgctatccctccagctttgttctttttgcttaggattgctttgactattcagggtctttttggttccatatgaattttaggattgttttttctaattctgtgaaaatgacatcggtaatttgataggaattgcatgtaatctatatgttactttggatagtatgggcattttaatgatattgattcttccaatccacatgcttgggatgcttttccatttgtttgtgtcatctacagtttttttaatcaatgttttataattcttgtggagatttttcacctccttggttaaatgcattcctaggagttttattattttttgtggctattgtaaatgatattgagttcttgatttggctctcagcttgaacattattggtgtatagaaatgctgatttttgtacattgattttgtgtcctgaaactttactgaagtaatttatcaaatctagaagtcttttggaggagtctttagggttttctaggtataagatcatgtcatcagccaacagagataatttgacttcctcttttctaatttggatgccttttatttctttctcttgctatcaggggaacccacccccgataattcaacgtgggttcttttctatttccttaagtgtcggccggtctgagaaataaagggaaagagtacaaaagagagaaattttaaagctgggtgtccggaggagacatcacatgtcggcaggttccatgatgccccctgagctgtaaaaccagcaagtttttattagcagttttcaaaggggagggagtgcatgaatagggtgtgggtcacagagatcacatgcttcaagggcaacaaaaggtcacaaggcagaaggtcagggcgaaactagaatcactaatgaacttccatgtcctgctgtgcacacaatgtcagggttcaagagcagagaaccggtctgactagaatttgacaggctggaatttcctaatcctagcaagcctgggggtgctgcaggagactagggtgtgtttcatccctatctatatctgcataaggcagacactcccagggcacccattttagaggccccgccctaggaatgcattcttttcccaacgctgttaattattaatattccttactggggaaagaatttagcggtatttctcttacccattttgggtaataagagaaaggcagccagactttaaggttatctcccttgttccctgaaaatcgctgttatcctgttcttaaggtgcccagatttcatattgttcaaacaccacttattgtttcagcaccacttattgaatagggtatcctttccccattgtatatttttgccaactttgtttacgatcagttggttgtaggtatgtggctttatttctgggttctctactgtcttctattgctctatatgtctgtttttgtaccagtaccatgctgttttggttactatcatcttgtagtataatttgaattcagataatgctatccctccagctttgttctttttgcttaggattgctttgactattcagggtctttttggttccatataaattttaggattgttttttctaattctgtgaaaaatgacatcggtaattttcaaacacacatgctctacaaacaatttgtgtagttaatacaatcgtcacagggtcctgaggtgacatacatcctcagcttacgaagatgatgggattaagagattaaagtaaagacaggcataggaaatcatgagagtattgattggggaagtgataaatgtccatgaaatcttcacaatttatgttcagagattgtagtaaagacaggcataagaaattataaaagtattaatttggggaactaatacatgtccatgaaatcttcacaatttatgttcttctgccttcagcctgtccctccgttcggggtccctgacttcctgcagcatcttgcctaattgctctggctaggacttctactattatgttgaatagtgtagtgggagttggcattcttgtcttgttccagttcataggggaagttcttttaaattttctccattcagtatgatgttggctgtgggtttgtcctatatggcttttattattttgaggtatgttcctttgatgcctagtttgttgagggcttttatcatgaaaagatgttagattttatggaatgctttttctgcagctgttgagatgatcgtatggttttggttaggcttatatcttcatacttcatttgttttatggcataatgcgtttctgtgccaaaatatagcctctcttccccagattttttccctgtcaccttgtcagaatgatagttgactttgttaattgcagagtaagtcttgctcacaaggcttattcttcattgaagtctcacatcaatgagccttaaaggatcagagacacatgttctcctatcactctcacccactcacccacttgctctcacccactcacccacttgctctcacccacgcacccacttgccctcctttatatttagcttggcagtcttcctctgttttcttttccatctagacaggttcattccttcaacaaatgctcatcaagcaccagttatatgctgagtgctaagataatcaccgtattcatggggctgtgttgtacctggagggacagagaaggacttaagatcccgtatgaggtgtgttgaacagggggagttaaaagaggtagtagaggcagtgattggtcatgcctggatatggttagactgattatctctttcctaaaggccctgttgatgctagtagatcaggaggtactcaagactggctgcatgatagaataacctggagaactttggagaatacagatatgtgttcatttggtcaagggtgtatgtgttaaaagctccatgggtaattctaatatgcaaccaaagtaaagaaccactgtagcagatacagggtcggagagttttgtttgtgcagtaaatcctcttacagtactatttagggatgctttatcttaatctataatctttatttgtctatgacttataacactttagcttacagcttctctactctggcatctctcaaactttaatgtgcatgcaaatcactcgaggatttgttaagctatagatcctgatgtagcaggtctggaactgggcttgagattctgcatttccagcaagcacccaggtgtagctgaggttgcagttggagggccacattttgagtagcaagggtctataccatagcatttctgggaaataatgaatacctgtaaacaacaaatatgtcagggttcagcttagctcattaaagatctgtgctattaagcatttcatagatatcttttaaactgaattttcattcaccagtttgattgttccaatttaagaacattaagtatttcttaagtgagaatcacacccttgtatgatttcaagtttaaaatggctgtttttatttatctttggaaactatagtattaaaatataggctatttggagttttgtgaacatacagattttgacctaatgtcaagtttgttaataagcattgagagcaaaccaactggtcttagagatgaagtttcttcaaatagttgttgcagattcggtaccgttttaccgtttgactgttaggcatactatcaaaattcattaccaaagtttcctgacatacaaatattctaggtaaagttttttttttatagccagagaaaataattggatgcacatagagtgaataattagaatgactctgtgtaattatttaaaaacacaattttaagaattaattaaaactgttaatacatgctcattgtaaaatactgggatacaggaaaaaagcacaaagaaaataaaacacacattaatttctttgttcacaactgctttggttacatgcttcctccactctgtagtatcatagatatcgtttcacatctttatatatttttttacaacattggttttcatggtggcagagtggcctgtgaatatactattaattcctataagaaggcttttttgatatttggcccatttctagttttttttgtggttgtaggtaaggttgtgatgaacattattaaattgttgcagacttccctattgccttgggataaattcctagacttggaattgctggttaaatgtataccaatttttaaactgattttacaaaccggcacattgatatggctttgtatatttcactaggagtctattacctgttttgcctatacccttaaaaacactggatgcaatcttttaaaaatcctttactcatttgattggtgaaaatgatactcttattctttaatttgcatttgtttcaatattagtgaaagtgaaccagtttatgcttgtaagacatgggtcttcttttgggaattgcagttttaaatttcttttgcaatttttctctatagatgtgttcctctttctcttatcaattctaagagttctttagagatgaaggatattaaccctttgacatacatgcaagtaataatttcctggctttttatttgtccttttgttctaaaagtcagtttcttttatttttcctgtgcattaattacattttcccatttattattcttttctttgcttttaggcttagaaaagacttatatcccatcagatacaaattctctatattttcttctcattctattgttatttcactttttcatttactttttaaatcccattggcatttattttggtgtaaagtaaattaactcaatgatactgcatgtctgtctggaaacaaagtcgtcattttgaatgatatccttctttaacagtaaatgaatttttaaaacattaaaatgaattgatttgagttgaaagctttttagaggacttttgaaagccctgtttgttgtttgatcctaaattttggcagtgggagtgcttctgaggccatctggtccctcttcgcgatactagaacctgtgcttgggcctctcccttctgctgcctctctcagctatgattctcagcacaggtccacagatgcccttgttcctggagagaacttttgtccccacatctgtggaacctgtagttgctagctctcaggccaggcagacatggccactgtcctccctggacctctgttggcctggattgcccatgtgcaggattgggtaactgtatggatctcagcctcctggattcctactgggtcttgagcaaaaaacacaacccctggacagctgcatgcagccttgcacatacaccctttgggtgagctcctcaacaacagcctggctgtctgtttggggtatctcaggaacacagacagcactcatttgaacactatttgtataagcagctagatggtgatcatttgtttagttcctgtgaattgtggtcctttttaatgtctacaaaattcaaggcaccacagacatttaaaggccaacaagatggaccagtagaggtatattttctgtttaggaaattacattttcttctgtgaatttgcctttaacgggatgtttcatatcacaagaggcagtgtagtgttaacaaaacattgggcttcaaatcagaagtcttctgtttgtgtcctggcattgccaccgtgcagctgtgtgaccttgggtaattcacttaacctctctgagtctctgttggaactttagagggactctttctgttctataacaccaccatcaaattataaagagactgctgtgtggtattctccagcctagaatactgtggaaatttgcatttgtaatacctgttaatacacatacatgtcttcagtttagtcagtcattcagaagcctgagcacagcaggtggcagatgggagtataggaatgtaggagcctgtgtttgtgtgtgtgtgtgtgtgtgtgtgtgtgtgtgttgtcttcaaacaaactcataaaaattctgccgctaggcattcacaaacagtggttgtttgttgtatagatccctactctttctgtcacttttttttttttataggaaaagaccttctaagattatgtaaattacattttcgtttactggctatttttatgcatttcctgttctttcaaaggactagataaaaattttctgtatgtcctaagatctctgactgcctcactttaaattgtaaagaacgattaagagttctaaaacattgaccctgcgatcattggataagattttaattttttcaagattaaaaaaattgagtgtgctaatgacataaaggttcttgcaagagctgctagtctagcctctgatacagatgtgtataaattcatcatcttcgtgcagacattattggtaatagagatttgcccacataacatggggagcacagaggagaagagagaaggagagggattcagggaaaaggtgacacttgagctgggcattgaagcataaataggcattttctatgtaaagatgtgggaaaagggcattctagattctagaaagaagagcacgtgcaaaggcaagccactgggcaaaattgtggcatttttgggcacacgaagcagtacagagtggctggccagaaaccatggtaggggaagggaagagggttgctgcaaggtaggcgcctacagtaaaaggaacttgtacgttacactaactggtatgcaatgagaagccaccgaacatttttagaccacagagtgagagcagatttcttattcacaaactcaactctataaacagaaaggaagagctgaagccatgagagagcctagggcaggcgtctgatacagtcctcatatttgaacagtgctttacagtttataaagtacttgcacctttgttgtcacgtgcacctcttccctctcctgagtggtgggtgttaagcttcctctgcagacaaggagcctgaattcagagacatgaatggccctgggttgctcagctggtgcagcgggcagagggagaggtcaacatgtcaccgaggtcctttgccttttcgcctcatgccacagggaagcatatttcagcaaaatactgaaatatttttccaactttttaaatgagatttgactttcaaagtaactttaatcttgattaaaaaaaaaagtttgacaagacaaacaacttttatcctgcaggtattgatttagtagaacagagtgatgtcactgtgccttgttgctgacattttcctgttatgatagccttctacaagctgatggtttgttttttctgattagctaaaatggaaagaaaaatctccagtgtgcttttattaggataggatataacatatcttaatttatgtttcagttatttcaataactttgatcataccattttgtcatagattaagttggcattgaggctgtaatttcttgctgtttggaaatgactctttattgagtaaggcagatttattttctttgtgccattattgaagattatagaagtggctctgcttccattttacctaaagtcgcataggctgtggctgttgagcttgcattctgagcgtagctttttgtagagctgttcagccttccaacgcttgttggatgacatccagccccaccctgttctgccacctgctctggagaggtctaaagcaaaatgttccagtcatttttgtttctaaaccagaagcaagtttctacatctttaattttgttaaaatatagttggaagagagtaagtctaggtcacagaaaattgaactgtgctgagatggagtgggtaggtggatagtcctttagataatgagtcgactattagaatttaaaggcatctttctagagaagagatgaagaagaaaacagctctaacaggtgctccatgccccaactgagcctgtctgaacttacacatggtctagaatttattggatgatatatgtttactaaggtaattataacatgtacctgaaatgagagagtttttgcaggtaactactaaatttgtagctgaattttctggaggtcaaagcaaaaagggagtgaaatgtatcatatgttaccattgtccagtctaaggtgcacactagctcattgggaaagggtggcctctgtcttcctacctcccccaaaaggagatatctattcgatcttagagaatcatagggacaatacctccttcaatatttttttttccccagaaatggggacatgttcttcatgaggctgcactatacattggctgtttataaaagtgaaagcataatatcaaaccacagctcagtggtggtatttccctggggagctgaacctttacagtttaggtgtcctacttttcattggttttatgtgtttagaaaggagagagaatagaatattgagtttgtgcctggtggtttctctttatcggtttctgcagccttatttttggcaggaacaggatagcagtcagttgaaggatgctatgtgcccaaggtataacaaatcagtgtgaatcgcactgggtgggtgattaaggagccaggcgatgtgctggttccttcttccctcttactgagcagcctgcttggggttggctgggcctggtggagaacttaccttgggtgggcccttctgacctttttttttttttgagttggagtcttgctgtgtcacccacgctggagtgcagtggcacaatcttggctcactgcaacctctgcctcctgggttcaagcgattctcatgcctcagcctcctaagtagctgggattacaggtgtgcaccaccatgcccggctaatatttggcatttttagaagagacagggtttcgatatgttggtcaggctggtctcaaactcctggcctcaagtgatcctcccacctcggcctcccaaagtgctgggattacaggttgagccaccgtgtccagccccttctgagctttcagtgttactccccatccctaagacatgagatctgggccagaatctttctcagagggggaaattccaaatgaacatattttgaatgtcttaaaaccttatctgttagaggaacttttaagaaaagatcaaacatacttccaattttacaatagttgtcaattagaggatggaattgattttactatttttcaacaactttattaacatttttttgcgaacctctttttccaattcagcaaacttttgcaagtcttgacatattcttattctaggcattggtgggtacgtgatctcacaaaattgtttaaggaattttaaaaaaaattatagaaaataggatctatgttgaaagaattataaagtgcattacaatttgagacttaaatttccatatcttttaattttacctaaatttatatgaattttaaaatggtgattgttggccaggtctggtggctcacgcctgtaatcccaacaatttgggtggctgagatgggtgggatcacctgaggtcaggagttcgagaccagcctggccaacatggtgaaaccccatctctaccaaaaatacaaaaattagccggctgtggtggcagatgcctttaatcccagctactcaggaggctgaggcaggagaatcgcttgaacccgggaagtagaggttgcagtgagccaagattgtgccactgtactccaacctgggtgacaagagcaaaactctgtctcaaaaaaaaaaaaaagtgattgtttttcatgtttggaattatatgacatgtatgtattaagagtctaatttatttttcaagtataaatgaggtaaatgcaaatcccagaagactgttttctatgcacacacaaaactacatttcttttagtacacagggaaaggtaaatattcaaattctttccgttgggtgacattttgttcacatatttttgtagggcatccatacttttgttttacactgaacaaaaggacagtgtgagggacagatgtcagagtgaaggtgtgaatttgcaccaaatgccaggtttagggctcagaatagcatttttttgtacgtggggcgccatgaacgcaaagacttccagcgggatgggcgttgagcagggattgtctaagaggaatcaaattgccaaatgtctgctgccagattattcttccctaaaattgatctccctgagaacttgtcttgcggcccaattcccaccagcttccctctgtcctccccgactttataaagaagcttatctgactctatgctggtgtcaaacacctccaggtaccaaaggaagaattcaaaatcctggcatggagaaagtgaatgactagtgactacagcaaacccttttgcaggtcacgtggctcctattcttggctttcaaccaaagtgaaggaggatctaatctagttatcccctcaggtagatcaccaacagatcactatgggatttagaaagatgttaaagaagcgtgtgacacggctataactaaacactctccattcctgtctgttaaagcgaacaaggttattttatatatatatatatatataaaaatataatgaataaataggaataaaattgaaatcagtgaaatttacttatagacaaggccctattcactgtatttatgatcaaattccacttttgattttaattatttgtgaaatgtgtaaaatctttatattgttttgatcaactgtgaaacaaaggtaatcttaataataactcaaattcaggatatatagtttaaacttttaaagcattatggtcacaagaatattttttaaatgaattttactttacctacatagttttgtcatgtagaaatagaacagagagatcaatacagtaatttcaagcgtgaagtataatctgttagaacaaaaatctgtggggggaatggaatgaaaatacaagctgaaaaatttgttactcagactttcttttcagcattttttagaggatttgtgaatttcagagaaaaatgagtgcatgaggtcaggtgcggtggctcacgcctgtaatcctagcacttcgggaggccaaggtgggcggatcacctgaggtcaggagttcgaaaccagcctgaccaacatggtgaaaccccgtctttactaaaaatacaaaattagccaggcatggtggcaggcgcctgtaatcccagctactggggaggctggggcaggagaatcacttgaacctgggatgcgggggttgcagtcagccgagattacgccactacactccagcctggagtctgacagagtgagacttcatctcaaagaaaaaaaaaagagtgcatgaaagaaaagcttgttaattcctccttgacttcataatgatctcacctctaacaagggtttcccaatattgagaatatcttaaacatacatatgctatcctctccgtccctcctaggcccgccctctacctgaggtaactagtattcttggtcttgtatttattgttctctgccaagttttgcagggcttgaatattatgtgaatttgacagcttcctttaggacaaagaataaaacattgtcagttaaaaaaaaatgcccactccagtgcagtgtcgcccagcgtgagaggttgtgtggagaaggggaagttaggatggagcgaggtggtggtctttaccaatggcagtttccttttgcagattttgcaaaaaaaacgtgagcatgtgcgtttattgttagagccacccctcagacttggaaaggagctcataaaagtaagggctcctgaaatttaaacttcagcagtcactgtgaaactacctctgtgtatgtgtatgtgtgtgcatgtgggtgtgcatacacacatacatccctgaaaactgtgttggttttagttgattgtaactctttttttaattaaatttttttttttttggggcggggagagagtctcactctatcccccaggctggagtgcagtggcacgatcttggctcactgcaacctctgcttcctggattcaagcaattctcctgcctcagcctcccgagtagctgggatcacaggcacacgcctccatgcccagctaattttttttgaaatttttagtagagatggggtttcaccatgttggtcaggctgatctcgaactcctgacctcaggaaatctgcccgcctcagcctcccaaagtgctgggattacgggtgtgagccactgcgcccggcctggtaaaatatgaattttataccttgttctaggagaacaggacgtatatatttgattgttattgctattgttttataacttggaggaattatgagctgaaattttattacttacactttattttctgcattttttaaaggacatgtgaattccagagaattgtccttatttattttggctgaattaatagggcaaatttgcctcctctgaaggaaaaaaaatagacaagaaagatctctttaaataccagcctggtgttgttctgtgttagagaaattctggcttttgcttcagacctccagtcctggtttccagaagaggagcactttctggttctcattcaggcccttagtggatcttcttccaagatttttaaaaatatgaccattagcttacattttcctatgtgttcaatcctcttctcagcagaagtgtttgcggtggatttttgagggtgggagtgtggtcaatgacgcaactgagcctttcagggacttggaaataaagctgttttattgtgatgaccagttttgtgcagaatcatctcattcttttctgcacgtggtgagttttgaagtgaaacttaaagtttaatgagatacagcagctggagttgggcattttgaaaagaggtaaagagagataattgtagtaaaacatactgtaaggccttacttatctggaatagcatggaatgaagagctccagataatggtgttttctagaaagtgaaagtttagagctttaaccatcataccctccccttttttctttaaccatttgttggaaatctctttaaaacatattacacatggttttcttctccagtggaactattagtcatcgtttgaatctcgtaagacattgtttctggaatctggctgtgatacagtcatctcctctggatccgtcatgatgggtgggacccgctgtcctgcccttacctggccttggtctgtcctgctgggtgcactcttgggtctgttgtaggtttgcatctcctgtgtggtcccttggccttgtccctgctctcaagtggctggtcgtagcagctctccatcccactaacctgctgattctaacaggcagtaaattcagggagcaaatacagaacgtgttggaatttgtaaaacagcaggaatggccctcactggagctccaagtgcttgctggatgtttcctctcctggagacaggagccgttttttcctggtgtgccggctcacttaccgcacttaaaaccgactgctcttaatgaataagggaacagcgtgcctcatctttatctctttacctcttttagacgttaggccattagctcttattttcagttgtgttctacataagcaagcctgatggatgactctgaataagtaaataagatttaattgaattatgcaattttcagtttctctcagataataccaaatcaaacaaaggtgaagccaaacacacataaaagattcgttttgctaaagcacagtgtgaatattttaattgacttttattgtatagtcatgtgccacataatgatgctttggtaaaggatagatgcttattctgatggtggtctcataagattataatactctatttttactgtacctttccatgttaatttttttgttttttgagacggagtctcgctctgtcacccaggctggagtgcaatgacacaatctcagctcactgcaacctacgcatcccgggttccagtgactctcctgcctcagcctcccgagtagctgggattatgggcacctgccaccacacccagctactttttgtaccttttaaatagagatggggtttcaccatgttgtccaggctggtctcgaactcctgaccttaggtgatctacctgcctcggcctccgtaatcccaaagtgttgggattacaggcatgagccaccacacctggcctaggtatatttagatacacaagtacatactattctgttacagttgcctgcaatatattctgtacagtcacatgctgtccaggtctgtagcctaggagcaataggctataccatctagcctaggtgtagagtaggctgtaccatctaggtttatgcaggttcacgctttggtgtttgtacaatgatgaaatgccctaacaatgcatttctcagaatgtgtccccattcttaagcaatgcatagtggtagttacatatcaacaaaattgaaaagtaaaaaataaaaataatacaataattgtaatgataaactgaaattttaaccttcaccttagctataagaatagaggtatagcctcctttcccataaggatttcctggagtacagagccctagttccaaatttttttccaaggccactcagaaagggttgttaagcttctttgttttctgttttaaacaagaatttcagaagcaagatgtggagattttgcctattagagatttttttcttggtcttattttcttttatatcaagtgatttgactaaaggactgaaagtcctgagtgaggatccagggcccaggcagacatactagggccttgtgggtgacagaaaaaggcactccttgggactaattctacaacggtgcccttcctgaggcgaacactggcaccatggcttgtgaatggagcatggcctccctttcagcccctgacccctcctcccaggccacgtcaggcagggcactctggtgtggggtgcagtcctgtgacaatccctgcatcagtgtggggcctggcaggaacatggttggaggctcacagatctgagtcctaaggctcgcagggtctgtccagggcacctgtaagtaagccatcatcactgacattgtgttgatttaagaattgaaactccaggcctggggcaacttgccgagggttataaagccattacatggtagggagtggggtcttgagccagagctctggtcatctctgatgacgaccaaggcccacccccctccatcccatccggaatccagattgcattggttgagcgtatcacccctctcttccctctgttttccatcctcatggtggtcacagcagctcagcccattgccctcttctgcaaggccgagcccaccctcctgggctgcagccatagctgtggctgtccttacccgctgtggatgccgctgtgggacttctctctttttctctccacaaagaaccaaagaatgttctttgtggcacatttttttttttttttcaaccagaaagtactacctcaagcctcctggaaaattccttattatttcagaaacatcactgtacttcttccgttgactcagcacttctgtctccttttcaagtgtggatttcagacccttgtcattctatggagcaaatgaaatacagtcttgaggagaagcattacgtaacattaaatttcatcacagctctttttaagaatactttgagaatttcagagtgttttcaagggaatctctttgacgttagttcctcctcttggttcctcaccagataaaggaaatctccaactctggggaagacatgtgagggaagtctgggagaatgtcgtgcattgacacccatgaacttgctgacatctggaggaatgagcagggctgagagaattccggtcctggtcctgcctctgttgctcccaccacgccagggaaataataattcccactcagcccgctccacgggatgtcgtaaggacaaaatgagatgtgatatatgtggaaacacttggaaaattcagacgttaaagtgactctagaaatgtaggtgtcatcatggctggaaatattagtatagctttgagagaaaaggacatttttggtcaaataagtttacagaatagtgaattattctctccttgtgggctctcaacacgtcttaacattttaaagcctcccctaagtcctgcaggaaagaaatccttttcgattctgtttaacttagtgtttctcagtgttttttccccctcctgttagctgcctctgtgaactgctgtgagtggagttcttggagggcttgtgaactcagcagaaagactttgtgatatttattttggctgcttatttactcaggtttattccagatacaggaggtctccagacactgagttatagatcagtgaggtattattgtattttattatagacacatacatatacaaatacatgtgtgtgtatatatatacacacacacacacacaaatacatgtgtgtgtatatatatacacacacacacacacacttatgcaggaataccttgttttattgtggttcactgtattgtacttcacagataatgcattttaaaatagtaaatggaagattcgtggcaaactgttgttgagcaagtttatcagcaccacttctcatttttctttttttaaaacttttattttaggtccagaggtacatgtgcaggtttgttatataggtaaacgcgtgtcatgggagtttgttgtacagattatttcatcacccaggtactaagcccagtaccctatagttattttttctgtttctctccctcctcccactccccaccctccagtggaggccctggtgtctgctgttcccctctttgtgtccatgtgttctcatcaattagctcccacttataagcgagaacatgtggtatttggttttctgttcctatgttagtttgctaaggataatggcctccagctccatccacattcctgcaagaacttgatctcattcttttttacagctgcatagtattccatggtatatatgtaccacattttctttatccagtctgccattgatgggcatttaggttcattctatgtctttgctattgtgaatagtcagcaccattttttctgataacatatgcttacttagtgcctctgtatcatattttggtaattcttgcaatattttcaactttttcattattattatatctgttatggggatctgtgatgaatgatctttggtgttactattgtaattgtttgggggagccacaaactgcacccatataagaaggcaaatttattcaataaatatgtgtgttctgactgctccacctacctgtggttccctgtctctcttcctctccttggacctccctattccctgagacacaacaatattgaaattaggtcagttaataaccccacaatggcctctaagtgttgaagtgaaaggaaaagttgcacatttctcaccttaaatagaaagctagaaatgattaagcttagtgaggaaggcatgttgaaagctgaaatagaccgaaagctgagataaactgaaggctgggtctctagcgacagttaaccaagttttgaaagcaaaagaaatgttgttgaagggaatgagaagtgctattccggtgaacacgtgaatggtaagaaagctaaggagcctcattactgataccgagaaagtttgagtggtccggatagaaggtcaaaccagccacaacattgcgttaagccaaagcctgatcctgagcaaggtcctaactctcttcagttctatgaaggctgagagaggtgaggaagctgcagaagaaaagttggaagctaccagaggttggttcatgaagtttaatgaaagaagctgtttctggaacataaaagtgcaaggtgaagcagtgagtgctgatgtagaagctgcaacaggtcatctaggagatctagctaggatcattgttgaaggcagctacactaaacaacagattttcaatgtagacataacagctttctataggaagaagatgccatctaggactctagttacagaggagaacccggtacctggctttgaatcttcaaatgacaggctgattttcctgttaggggcttatgtagctggtatcttaaagttgaacccagtgtttatttaccgttctgaaaattgtagggcccttaagaatttgccaaatctactctgcctgtgacagcatatctgtttatagcatggtttactgactattttaagcccattgttgggctttaaaaaaatagtgctcagaaaaacagattcctttcaaaggtcactgctcattgacaatgtacctagtcactcaaggtctctgatggagatgtacaaggagattaatgttgttttaatgcttgctagcacaacatccattctgcagcccatggatcaaggactaattttgactttcatatccttttatttaagaaatacatttctttttttttgaaactcagctctgtcacccaggctggagtttttataaggatatagctgccatggatagtgattcctctgatggatctgggcaaagtacattgaaaatcctctggtaagaattcaccattctggattccattaagaacatttgtcattcatggaagaaggtcagaatatcagtattcacaggagtttggaagaagttgggatgacatcgagggggtcaagacttgagtggagaagtaactgcagatgtggtggaaatagcgagagaactaaaattagaagtggaacctgaaaatgggactaaattgctgctatctcatgatcaaacttgaacagatgaacagatgaggagttgcttctttttttttttgagacagagtctcgctctgtcacccaggctggagtgcagtggcgcgatcttggctcactgcaacctccacctcctgggttcaagagattctcctgtctcagcctcccgagaagctgggattacaggcgcctgccaccatgcccggctaatttttgtatttttagtagagacagggtttcaccatgttggtcaggctggtctctcgaactcctgatctcgggtgatccacctgcctcggcctcccaaagtgctgggattacagacatgagccacagtgcccggccaagttgtttcttatggataagccaaaaaagcggcttcttgagatggaatctactcctggcgaagacgcggtgaacattgttgaaatgacaacaaaggattttgaatatttcataaacttagtggataaagcagctgcagagcttgagaggattggctctagttttgaaagaagttctactctgtgtaaaatgctatcaaaccacatcatatgctatggagatctttcgtgaaaagaagagtacatcaatgtggcaaacttcgttgttgtcttattttaagaaagtgccatagccaccgcaagctttagcaaccatcaccctgatccattagcagtcaccaacatcgagacaagaccctcctccagcaaaaagattatgactcactgaaggctcagatgattgtaagcatttttagcaattaagcatttacaatttttatattaaggtatatacattatttttagatataagtgtattattgcacacttaatagactatagtgtaacataaacataacttttatatgccttggataactaaaaaactcactatattgtcatatttgctttattctggtggtctggaactgaacctccaatatctctggcacacatatacacaaataacatttctgtaatctgatagttttgccagataagtcatattctcattgactaacagagctcaagttttaatcaacccagcaaaaagcatttctctcctggagtttttcccatgtacacctttcccctgaagaagcagacgtatcattattttaaataattcttccttcttaggaaaaattataggcatattttcttctcacagctaccaaatgtccttgatatctgtgcatgcacatttatatgtaaaatcagagcttcttgtggttttagaattggaagaggccttagagatgaacttgtctggtgattctcaacccctaagcatgttcttaacgtgaacacttgggagtggaagcctggggaacctgaaataactacacatttcctgctaaccttctaattcctagtctgccatccttgcagtagtaaggttcccctgtgcagtgggaattttctgtccccagggggttggggacagaaaaatgttgcactatagatctcatccaaccccgcattttacaggtgaagatgatgagctacaagattcaatgatatcttcaaagtcacacaacccggcctagaaataggctgctgctgatcaatccactgctttctctgcctatgagttttccccaatgtcagtgatttctgtcctacctctgtaatttacggcatatcacgaaaccccaaccctcatacgcttcatcattttaaataaagactgacttttatatgtgaataatttatgaaagaaactgtaatccatattcgatgtggaaatgtaaccacatttcactcactatgaaaaaggtaacactaaaaataaatgctatgaaaaaatatattaaattttaactaaagttccccacttaagtttctgagcctgaagttttctctctgctaaaaagagagattatcaagttatgaagagtttaaacataacactagccccaaacgatgacactctttttatgtaatcggaattattgaatgaaaattttgaaggaaataacattctctcgacataagtccaggcagtatttactaaccaacacaccatctcaaatcctctcaagttccaccagtgagtgagctgtgtacccattcacgaggaactgtctcccaaaagggaagctatatcaggcaaatcatacctctgtctgtatctaagctggctggaaggtattagatttggtggcaatcagagtattaattggaaagaacaagtggaaaattgtacatatattggctgtttatcttgtgtatgtgtccacagacacccttagaaaaactgaaagcacagtgcctgcgatatgataaaagctcagtaaatatttgttgaatgaattgatgaatacctggtgaatggcaagcattctgcctcaagtcaggtagaaacaatagactggtaaaagcaagttgctgcattttgtttcaaggcactttgaaatgtcttatcagtggacatgaagtatagaagacttagcagactcaggaagagcagagcatggccatggaatatttaacagataatgaagagcatatatgtggccgggcgcagtggctcgtgcctgtaatcccagcactttgggaggctgaggcagccggattgcctgagctcaggagttgcaaccagtctgggcaacacagtgaaaccctgtctcgactgaaatacacgccggcttggcggcgtgtgcctgtagtcccagctactagggaggttgaggcaggagaatttcttgagtccgggagacagaggttgcagtgagccgagactgagccactgcactgcagcctgggcgacagagcaagactccatcttaaaaaaaaaaaaaaaagcatacatgcatttaggcattaagatgctatagaccattatcttttatagtctgtgtcacacttcatgttatgtatcaagaggagaaaagcatctcagcccaagatttgattcctgattttactactcaatagctagatgatttggggacaactgcataatatctttgagactacttagatatacaaatgaggactatgataatgcctacctcaaaggttgttgtgagggttaaatgaggcaatgcaaatgaaaattgctttataaagactaaagtgctatattaatttgcctttattgaaattacatactattaaaatgaccagcgaactaccatttgtgcagagtggttgaagaatatggcatgctgattatttgaacattctggataatagaagtatagtacatgtctttctggttaaaaagaattacaataaagtattcttaacatcaaagcttactaacacaactaatcgtttggatgagatttcaagatatttctatatattttgtgggcagcacttgaacacttgaatagtataagatgttgaggaaaaaaatgcttaggaaaagaatacactctaactgataccccaaaccatgtatgttaaaaaagtagttccttaaaatatacatttactcattattgatcccttgcttataaaaaatgtatgaattgaggaaccatcattggatatacagaagtagaattatagaatttgtttttatgggtattttgaggggtagaaaacaagaattattttattttgccctgttcagacaaaaatatcatgttagctttttaaatagtatatagtgcaattggaactcaatcttaagacatttttgcttaatgaaaatgctaccatgacagatcttttttttttttcctaacaggatgtatatgattctcttttcattaaatttgcctcaaagagtttcaactctcaatttttagactaactttactttagataaaagggtttttatactattatttctttttttaaatttccagcttttattttaagttcaggggtccgtgtgcaggatgtgcaggttcgttacacaggtaaacatgtcccatggtggtttactgcacagatcatcccatcacccaggtattaatcccagcatccactagctattcttcctaatcctctccctcttcccaccccctgccctcgaaatggccccagtgtgtgttgttcctccccatatatcgatgtgttctcatcatttagctctcacttataagagagaacatgctgtatttggttttctgttcctgtgttagtttgctaaggataatgacctccagctccattcatgtccctgcaaaggacatgatctcatccctttttatggatgcattgtattccatggtatgtttgtgccacattttctttatcaagtctatcactgatgagcatttaggttgattccatgtctttgctattgtgaatagtgctgcaatgaacatatgcgtgcatgtctgtttgtaatagaactacttatactcctttgggtatgtgtccagtaatacgattgctgggtcaaatggtatttctgcctctaggtcgttgaggagtcaccacactgtcttccacaaccaacagtgtaaaaacattcctttttctccacaacttcactagcatctgttattttttgactttttagtaattgccattctgactggtgtgagatggtatcttattgtggttttgatttacatttctctaataatcaatgatgttgagctttttttcatgttttttggctgcatgtatgtcttcttttgaaaagtgtctgttcatgtcctttgcctgcttttaatggggttgtttttttcttgtaaatttaagttccttatagatgctggatattagatctttgtgagatgtatagattgcaaaaattttctcccattctgtaggtagtttgtttacctattgatagtttcttttgctgtgcagaagctctttagtttaattagatcccatttgtcaatttttgcttttgttgtcttcatcattaaatctttgcccatgcatatgtcctgaatgacgttgcctaggttttattctaggttttttatagttttgggttttacatttaagtctttaatccatcttaagttgatttttgtatatggtgtaaggaaggggtccagtttcaattttttgcatatggctagccaggtctccctgcaccatttattaaataggaaatcctttccccattgcttgtttttttcaggtttgtctcagatcagatggttgcaggtgtgtggccttatttctgggttctctattctgttccataggtctatgtgtctgttcttgcaccagtaccatgctgttttggttactgtagccctgtagtatagtttgaagtcgggtagcatgatgcctccagctttgttctttttgcttaggattgccttggctattcaggctctttttcggttccatatgaattttaaaatagtttttttccaattctgtgaagaatgtcaatggcagtttaatgggaatagcattgaatgtataaattgctttgagcagtgtggtcattttcatgatattgattcttcctatccatgaacaacccaaatagtgacagtgctattaaaaaattgtaatcaaagccactgatattacatgacaaatctttgtgagtactttcttcctgttagatcattttaaaatagtttacattcttgaatttttaagtcagttttaaaaaatagattgcttgtattagtctgttttcatgctgctgataaagatgtacccgagactgggaagaaaaagaggtttaatggacttacagttccacatggctagggaggccttacaatcataggggaaggtgaaaggctcttcttacattgcagcggcaagagagagaatgagagccaagcgaaacgggtttcttcttatcaaaccatcagatcttgtgagacttatttactaccacgagaacagtatgagagaaactgccccccaagattcaattgtctccctctgggtccctcccacaacacatgggaattatgggagtataattcaagatgagatttgggtgaggacacagccaaaccatatcatcgttcaactagaaaatatatatatatacacacacacacacttagtgaaagttattttattaattagccaggataaaccttatttaaactatttagatatgagtcactttgaggaaaggttattatatgaaaatatcactgaaataatcagaaatttctttaaaaaatgctgttatgctataattcatttcataaagttctgcttacattcataaacttgagccgtttgtacagatcacttattatcctcatataataattttctgacacatccaatctgcgtggctgtgataaaaaatgatccaaaatgttgacctataacgtgtcttaagagctcttaaaaaaaagataaaatccttgaatgatgccaggcatctagaataaaattgtcaagagaaactcaactaattttgagatcaaattttaagatcaaatcttactcctttattacaaatgttcagtaacgatctcatcaacatgatgtctgtagcaaattatttttacttaagggctcagctctgacatttgaagtgaatggttgtgagtgccagtttagttcaggaaaatgctgtggttaagggctggcccattttcacatggaataatattattcaggtcttgttttgtggtatttatgttgtaaataatacatccagagtccatgtagctacctatgcctgcccgtgaatgatacctacttagcgttgtcttagatccagtggcaataacgtttaaatgctgaaggaaatatcttttggtttgctgagagttttaattagggttcactttgctgctaagacagcagcatttaagctactaggttcttggcacaatattgtttccatatttctttttctttccagaaggcttaattatttcttcacctgaattttaacaaccattttagctgaatgatctagaaactgtcctcctcaatgtgtgttctgagtcagcagcatcagcatcacctgtgaactgttagaaatgcagaatctcaggcccaccccaaccccactgaatttcttagaagctgcatccaatggaagcatctatatgaaccacacttttgagtagcaaggatctagagttcttgtgcagatctctctctctctctctctctctctctcacacacacacacacacacacacacacacactttcaaaagtattttatttatataaatgtttttgatcattgaattaaaagaaaataatgcaacattgaaaatatgtattttttgagacagagtctcactctgtcacccaggctggagtgcagtgatgccatctcagttcactgcagcttctacctcacaggttctagtgattctcctgtctcagcctcccgtaattcagaattacggaggctgaattacagagcctcctgtaattcagcctctcctggaattacaggtgcccaccaccacacccagctagtttttgtatttttagtagagacagggttttaccatgttggccaggctggtctcgaactcctgacctcaaaagatccacccgtctcagtttcccaaattgctgggattacaagcatgagccactgtgcctggccaaaaatattttcataatgaagactcataaataaatatcacacatgtcagtgaaaaccaaaagcttttttctgtcatcaagatttcaggattctttttttttttttttttttccagctttaagtgcctatcctttttgtctgggaaggctgatttctttagctcttttctttctctgggaataatgcattcgcattgctatcgtagttatccttgcagcggtgtcagactttagctgcttcctgtagctcgttccctgacagtgttcatgtagcgtctcctcctaaggcggcagcctcgctgggtggattgagtggttaccttggatcccttcatgcccgtgctaatctcactccgtgctcttctgtgcctccaactggaatgaaagcttctgggagtagagaccccgttttgctgtctgctctctccagcgcctcatgatgtcagatgtagaataatccttcactatatttgctgtttctggaatagtagagaccacaaggttctgaaaaagaggccactggttcagatgagggcaaggcagttgcccaggggtagatggcatacctccttggcgaatctgattttgaagtccgtgccctgaatcacctccacgtcccaccttgtgcctggtgaatgtcagccctgcactgttaaggtgctgtagcggatgctgtgatgtgccaccgttcagagaggcactcaggctgccagcttctgagcatggctaccgatgtgtcatggctgggtccctccttcagcctggaaggagtgctgtgccccgtgtggaaggaaacctcctcgcccaaggttatgcctctcctctcggggcatcccacatccaatgcctggttgatgtggggatacaaaggtctgatccccttgcgtcaatctgggacaactctgatgggccatcccagttccagagctcctgtgggacaggctgagctccgttgcagctgcatcgcagtttgccttctctctctgcccgttcctgcgtctccactcctttgtaggttgtatctgagtacatgcacatctctccctcaggatctgcgcaacagttaaaggtgcacgcgttagtgaaacctcgcaacacatcagtgaccagggttacagttcgctgactactgaatctggactggaacctttttcaattcagtgcttttctgactccaccactctgactccctcaagtgcagtggttctcaacagaggtgactttgttctccaggtgacatttggcattgcctggggacttgagattattactggcatctagtgggtagaggccagcgttgttgctaaatgtcctgcaatgcacaggacagttcccgcaggaacaattatctggccccaaatgtcaggagtgctgaggttgagaaactctgctgaatgtatggatgagcattggtcaccaagatagaggagaagaattcaatattgctcttccattatattttcctaggatgtggactctatgttttagacaatcttccgtattaaaactatcatgtgaataaatgtatttttgttacatatgttttctggagtttacatgtattggtggacaacacataagaagtgcgtagggtcagagaaatgccactcgaggtcattatttccactcaattgctcactggggaaaaaacaaacatgagttctattctgtaatcagtactgctggcaacagtactgatcactaagcactgtgagaagcacatttcagtacaatactcttgttgtcctaagttctgtgaccacttttcctagattttctgtttttcttgggatggaaataataaatacttcctcttgcctcctctcagtctagagtaacaataagggggacatgtaaatccaggaatttcacaccaggatcctggaggttagctttcctgttttcttcttgccagtcttatgcattacatgggaactcatatctatcagcacaaaactcagtaaacgattgttgagcgagtaagtcaggaccaacgcgtcaatcacatgatgcaggatgctgtatctaagcttgcacacttactttaggaaactcaaatggaaaccccactctcaaatagtctaatctaattacctttggttctggaaagcagcatccaagaggaaagagattgtaaaatcctcagaggaagcggggaaagtgggtctgagaagaggggacgagagcctaggagtcagcaggtagctcaaaggatgagatggatgtctctctctgcttctttccaatcttatggaatttcaggatattggtattcactgttgctgatgacctagagaatgatacttcccattaatgtgagtttgaaaatagtttctatccttgaataaattatgcttggcaccgtgcagaccaaaatagattcaagttatgtgagtttcatacttgaccaaaaagcaagaggctgcgcgtcattcagagctgaccccgggctggcaatgagagctcacagtcttgctctcctgctaataccaagcccctcagtgctcagcaaaccccaaagtcgcctgggcctgtgaactgtgtaaactatcctcccagacacttcggactggagatcaagacaactttgaaaaatcttccgaaagggaacatgaggtccacctggccataaagtgccttccctgtgtcacctttttgctgtcagcttgtggctcaaggatgttgtccaaaactgctggagctcacgtttcaggcagagatgtgtgtctcatgtagctgggcctttcaatttatgggaaatgttatagtttaactttagccattttctgggatctattttaaaactcctatatgtggggagagacaaatttaatgtttaacacaacattgctttgactgtcttttgctgtactattcaaaaattaatgttacatgaataggaactcaaacacagctgataggaaagtaaattagcaaaacttcctcctggggataattttttaaatatcctttgatctaaacattctttagaaaatttatcttaaggaaataatcatagatgtggttaaatatctagctacagacatgattgttacagtgttgattgcaataatgattaattataagcaacctaaacatcaagaaaagcaaggagtaattaaataatttattgtactgtatgggtatggtatgacttgtgatacagcagttgagaaagatggagaggaccacttaatgacatgaaatgatttttaatattaagagaaacaagattatagtgatggggaatgatccctgtatatttattctaaaaatgtagccagtagttatctctgggtgaagagattatgagcaagtaattttttttatgtgtatttttaatatattctacattgaataggagttacttttgtaatatgtaaaaaaaaaagttactaaaaataagggtgatgtttgtgaaacacataaagaaacgtacgcaaatcataagtgacagcttactgaattctcacaaagtgagttcacctatataacccaaaccaagctcaaacaggatagaccaggtccccagaaacccccctcctcaccctccaccgcctctaactgcagaggggagtgcctgttttttggaacttcatatgcagtcatgtgttgcttaacgatgggaacacattctgagaaatgttatgtgctagactttgatatgactgacagtgcagcgggtttgtttccaccagcatcaccaccaacaggtgagtaatgcagtgcactacatcacaatggctatgacatttctaagccataggactttttcagctccattatcatcttgtgggcccatcattgtatatttggctcatgactgcaattggaataatatagtatgtctccttctgagttcgtggctgcttctgctcaacattatatttgtgaatcattcatattgtttcttttggctgcagtttgttcaatttcactgctttacagagttccattgtttgcatataccaccttccattttactgttgattgatggacttttgggttgtctctggtttggcactattctgaatagtgctgctgtgaacattgttttggttaacatcagcgcatatttctgttggggagtacctaggaatggaaatactgatttgtatggtatgtttctgttcagctttcatagacactgccaaacagttttctggagtggttgtaccaacacacacttacacttctatattttccagtgctgatcacaagatttctccaagatactttcaactttcctgaattatttgatgctgtcatattgggaataatttttatctctgttagttgaatatcaaattgatgttctagaaaactcttgagtcattacctacattttttaggtgagtggtgtttgatggctcaagatgaaccttctctttcctcagaacagctttaagtttcttatacttcttgtgattgaagagcaggtgaccatgtttttcttctagtaactgcattatttgaattttgagagtatcatacttttttattccactgaagagaaatttatttttaatgaagctgctttttgagtaaaaaatgctagagtggtgtgattagaaaatacagaatccttttctttcttttgtaagtgttgtcagctttaggagatttgatgatcttataagacaaccttttttaaaaagtcagtgtcctcccatttagaaatagttgatgaactcctgggagaccagcaatccctactgccagaaaatttagttcctatgttgcttgctcgatcccagagccagaccatttacctagctctggccagatagaagtggctgcttgtacagaaagaacatcgggtggaataacaaactcagaacattggatgatccaacaaaagctttgtgtggaaggtctttcatttgaggcccttaaatacatggaataattaatgaagggtggaagttggggaacttattccttctgtttctaccacactgctgtgggtatccttcatcctttaaacactccttttcgtctctgagcattcactggctaagaacacaggtccacagcctctttgacggctgcgttgtcttttccacgttctaaggaaaggcagtcagtcagtcatactaaagactgactcatgttgtttttaaatattaaagggctctgttgttgaggcagagcctaaccagtcttcagtttcctgacttctgtttctggtccagttgcaaagaagcctttctgtaattttctgtaatatgatttgtactatgtttttcatcatggaaaattaaatttcaaaactttacaaagctgtagtaagaaatatttgagaagtaggcttgggatggaggtgtgcactgaatgagaagggacaggagggtgtccccagcttgtgataccaatgtgtggctggagacagaggctcagttgcctggtcttcgatgtgttcaggaagtgccctgacggtgagaggcctgtcctggctggttaactttaagggtggcctggcctgctgctttgctcacaagcacctgcatctcatggcagatgtgcttctgatttgtgatacaaagtatctccttgtttgatttcttggacttagtgtgaacatgttttcttaaggagtaggttttgggcagggcacattactaagtcttaaaaagctttttttctctactatatatgaaaaaaagtcctctcaacgcctgccgtattttacccagggacttttaaaaaaacccaactatacccttaggtagaatagcttcttccattggggttgtgggatgggcgtgggtctgtagtccatggtttgttctgctctaaaatcttccatctttgctgagatgacgtatttttgccttctaacagacctacaaaaccatgacacagacttgatttgtatacctgttatgtcaggtatgataaatgttaatgtaataatattgactcatttattttgccgattcattacgggctggttaaagtgataaacaaccattaattttgttttatttccagagacaatttattataagcagaacaaaaggttggcttttaactacacctgcatatgctatcctcaggaaaatatttatagtttagttaatcttgtttaggcctaaagtaactgtggtttaatcactgaacaaacaagataggacagcgtggtggataattgaaccaaaattcccattgagatgcatgggggcagactgctcccatgtggtttcacagcccaagaaactgaagggtagttttgaatcctcatcctctctaggatgaggattgagatgagaagcatggcactttgccctttatttcagtatatttatccatacacctacaagggacataagattttggtcaaacatttcttgataattgtatataagttgaagttttatatacagaaattttcttgataacagaaacatttcttgataattgtatataagttgaagttttataattcaaattgtaggttcagagctggaagggaatcccagcatttgggaggctgaggcaggcagatcacaaggtcaggagttcgagaccagcctggccagcatggcgaaaccctgtctctactaaaaatacaaaaattagatggacgtggtggcacgggcctgtaatcccagctactcaggaagctgaggcaggagaatcatttgaacctgggaggcggaggttgcagtgagccgagattgtgccattgcactccagcctggacgacagggcaagactctgtctcaaaaaaaaaaaaaaaaaaaaaaaagagctggaagggagagagtgaagcacactgaagtgaaaaactgatacccgttaggcttcaaggtgaagcccaggtacacctgcttccctagtacaggctctcttcatgccgcagtgttgccctttaaaaaccaactttctctgataattctttttttttttttttttttttttgagatggagtctccctctgtcacccaggctggagtgcaatggcgtgatctcagctcgctgcaacctctgcctccccagttcaagcaattcttctgcctcagcctcccaagaagctgagattacaggcgcctcccatgatgtccggctatgttttgtatttttagtagagacggggtttcaccatcttggctgggctggtctcctgacctcaggtgatccaccggccacttccaaagtgctaggattataggcatgagccaccgcgcccaaccttctccgataattcttaatagtttagaaagcactgtcagctgggtgttgtggcatgcacctgtagccccagctactcaggaggctgaggtgggaggagcacttgaacccaggagttcgaggctgcagtcagctatgatcacaccactgcaccctagcctgggcagcagaatgaaaccctgtctctaaaaatgaacgaacaaaaaccaaacaaacaagcaaacaaacaaaccccacaaaacaacagcaacaacaaaataatagaaagcactattttatatgctgctttatatactttagttcttacaaataaatccaaaggtcaatacattgtaaaaacaaagaactgtgtcaaaaaacattcctaatatgttattgatttattcagcaagcttttatggaacacctgctatgtgctaggcattgtggtatgcattgggaatacaaagccttaatgattttaagcacctgttctgaagggaagacagtaagaaaagtgagtgttcagagtacacagtgataaggtatgtgatggaaaatgtatccttcgaatgttgtgggagcgtagaggggtggtagttggaataaacgtgaaggtcttcccagaggaggtgatatttgcattgagttttgaaagacaacgaggagttgttcataggaaggagggaaggaaggcagttcagacaagaagaacaatatgtgagaaggccagtgtgatgattttgagaacaccattcaacatgtctagagcctaggggatgaagagatgggtgctaggagggtaggagtggtggcaaatgatgaggccagataggtaagcagtggcaagtttgtaaagagcacaccagtgtactccattaaggggttgggagtttggccatcattctaatggatggcaaaccatttgaagtaggtgggcaacatggtcaggtttgaatttgagagtgttcacccggaagccagtgttgggggaatggtgtgcaagagattgaggtggaggctgggggcagatatacaagtaatccagcccagagaagaaaagagcctgcaccgagcaggcacatgatggagggcagaacaggacattagagaatgagaatctcctggacttggtagattgaatgtggactcagggtgagtctaaccacacagctcagctttgagcttccctcagagccaaggggaggagtgggtacttttagaaagaagagatttcattgatttgttctgtttccccatttgctaatatatgaagaggagtgggcttagtggtggggaatgggagggaggctaacgggctgtgtttggggaaggctgagtttgtggtgcaggtgggttgggttttctcagaggaaatgatacagatcacgctctcaggagcatgctgtggcctggagatagaggctgtggatcatcagcatgattgccctgtaaattagaggatggggatgaagtagcctaggaagcgagtgtaagtgagaactaggaccaaggatggatccttggggaccactcatatttaagtgatgagcctcaaaaggacacagatgctggaggacaaccaggacagtgatgttatgggggccagggaaggggagagcttcgagaagggatgctcaccagggccaaacactgccgaaggtgcttagcccagagtcagtgctcataaacatttgttactctttagtgttaggatgacagaggagagggaaatgaatgaggcttggagtggtcaggaaaagcaatgcaggaggagataggatttatttatttatttatttatttatttatttatttgagatggagtctcgctctgtcacccaggctggagtgcagtggtgcgagctcggctcgctgcaacctctgcctctcgggttcaagcgattctcctgcgttggcttcccaagtagctgggactacaggcatgcaccaccatgcccggctaatttttgtatttttcgtacagacggggttttgccatgtcagccaggctggtctcgaactcctgacctcaggtgattcacctgccttggcctcccaaagtgctgggattacaggcatgagccaccgcatccggccaggagataggatttaaataaaggctttaaaatttacgtaggtttggataatagagggaaggtgggcaggcatcccaggttaaggtagtaatttagcgtggtcgcacactagaagacttctctgaggcgtgggatgggggagttatttgcttacaagttgttatctccacagattgacgctcagctccctgatggccaaggcaactgtgtgctttcctttgtgtctgtcaatcattgtagcaaggtttttggcccaaagtggtcagttaatagatactagctggaagcattgataaggtgggcgaagttggtggttcccggcaactgagtggtaaaactctactctcaggggtcccttcttgttcagggaatgtatttgcatccctccctacttaaaccatttaagaaaaagagtgttctagtttgccttttttatctgcacttaggtccccatcactccttttcttttccaaccccgttccctccctccttccctttttctctttttttcttgccaatttcttatctctctcttcctgcaattcctatttgtatactcattctttatcagaaagtacctagaagctgataaagcttgtacttaatcctttattttacctatatgcaaaatattgctggcatccttttgattggtggtgatgttcattgcgaaatattttgaatcttaatcttggcctgtatggggaagtagaattagaaggaggtatcagaggaactctctctctcactccctctcgccctctttctctctcttgtgttttaataaatatcaatgctattaaatttgtcaggtaccattataaaaatagttgacattaaaattgcaaaccctaaggtgaatacgagagctgtctgcatcctgatgaggaagattctttactttcctagcttccatgagtctttaatttgaatatggattttatgaacagagtctaataaaaatgctgggctttggcatcagaaaaacatggataaggctcttcctcagtggtgctctatgggcagttactgaccctcactgggtttttaaatctgtaagtctggttcagaagccagcctcataaggattttgtgaggattcactgaaatactgtttgcaaattaccgaacacagggcctgtatcatagtcagaactgaaggttcccttctttcccttacttcacatttttacttcatctttcttcctcccccatcttttgtccttaattagagcagagcattgaaaatcagtcaaataatctttttatgcaggaaaagaacttccttccccttatttatttaagaatctggctttgagtttgagttggaaagtgtccttgtcttatggtatgagagtttgggctatcatctgtgacctgcgttactggttaccaggaatgattatatagttgcttataatgggccactttagatttttgcaaggtatatttgtatcatctctgattcacaattcgagggattgccaaaaaaaaaggggtagggtttttcttgcatagttactgttttggttggcacagaatgcagcctcctcacccaccctctttttgattatagccaatgattacataacattttcagatcagattttttttttttttttttttggaaagcttttggagacacgtggctctggaggaatcctcatggaatcttaaaaccctgagggaattcaagaagaaaactattccacttgcttgcctctggctgcatctatatttaaattatctaagaaagatattggtaaattcttctatttttaggaattagaggagcttccacttttctcttaaaatcaaattcaaagagcaacttttttgacaagctgaatagatctttgaagttaatgaactggagcatagcttgcaactccatcagtgaggttgatcaggagtgaagctgcctcatcagcttagtctcttggaagttaaatagtagaaagaacatttgggttttgagaacatgaggatctagttttgctgtgtattgtgtctattgatgcattcctgggggatttttcccccagaggtattttatagctttgatttaatttaattttatagctttgatttgatttcagtgtacttcatctgtgggatttcatggggtcttgttaagggtgtttctctacagagttgttttagtgtttacttctgacaagtgctccaggacatctttgatctgagaccacttatgttaatctcttataatgagggttcctagactagatggtagggtagattttcacaacccaaatggcagtgagcttccaattatgaattttctgggaggatttttcttttttctttctttctttttctacccagagcccataatgaggccagcatccttgcacagggtgtggtagatgtgtgaaggtctctgttttacaggaggtacttgcttctcattccactccactttttgcagccaagattaaaccctcaaccctctttggccatcaacttccaagctcctggtttctcaccctcatcctcctggggcttcctgagcatcagcacgtgcttagcagtcactctcccctttctttttggccccggcatatctcattctctctctgagcccaaccaagcttgtaatatgatgtttattatattttatccaacatttctaggtattttttcttgggaaagtttccaggttgtcaggttgactctgtctgtcaggtcaaatagatggaagttgaagtttgaagatttgggttaaagtactggttctgctaattgtttctctggctttgcatgagtgattctgtcactcttaaatttcagttttctcatctgtaaagggagagggtgcataatacctcacagacccttaatatactgaaaagttttccatgtaagcaacttcacattgtgaaaacagcctgtagtgcatgttgttgacatcctgcccaagtccccatgcggggcaaatgctcccattgcccagcgcttgttgagtgtacattgctaaggctcatagctgctgcttctctggagaactgcatccaaatccctatcccagactctgcttctagggaagctaacctaaggcatcatcacaatgcttccccccaaccccaaggaatcgtagttcttacaaagatgaattactttgaaagtttagatagaatataataaatcagcaaatcaagaataaaccatctgccatatttttgaaattatctttttgtcattttaatttttcacttgtgagaacacaatgtatatgtaagtttatttaaggctcaatggagcaagactttgatggatctgggcataaaagtatgggtaggaaagattatctgcagcaactcaattcaaaattaagggctaagggcttcagagatcactttaagtcacacattgatttcattttctctctctctcatgctgtttccctctatatggagaattttatatacactctcttggctcttaactacagccagatttgtaagtgacgagaattgagggccagggtgggaggaaatgctaatatattgtcccaggttttatgcttgggaagcatgaagaaattcaaagagaccaaggtgttctcaggagtaaacatatcccttcacccaaataggcaagaacaattttagaactgaaatcgtgaaaggggtcttagagctttgagcagaacggtagacccagaaggaggctattttggtccccttgctagcacagattttgattcaatatctctgagcttcattgttttgtaaggattaaacatgcctgttagattgtcttctacaaggctctgaataaatggtaattattttatattattgatgatggtgatggtatgaacatttttattattatcatcatttttattatcgttagagagtgtgtcttcctaataaatcctgtggcaggggctggagttctgattttagagtctgtggaataagatgatactgttgcaattgctgacttttcagattatagtattttctgccaaagaagcctggtactttgtagatccatagaatctccctagaatcaagagtaattctccttcccctctctctcaatccatttctactctccttcttggaaaaggaagaaagaaaccttaggcatggtatcaaactgaattacaagatcttgattctcggttcttaccattcctgggatattctagagacctggttctcctccatgttggccagagtccatattcattttgggcatcaaccctaacagaaatttatacataatctatcattagtcctgatgactttacttcttaaacacctcttaagtgttattacttctgtccaactcctctattaacaccattatagaagccacaaaattatctcccgtaggtttctgtagtagtcttctaactagcttacctatatcaactcagatttcatgctgaatgttctctcctctggagccagaataaaatttccaaaatgtaaatcagataaagcctcccagcccccacaactctcccacactgcccccaaaccctcagaggttttccctgactcccagaactccttcagtgtggctgaggaggccctacctgctcctcttgcttctccatcattcctcactttgttctggctctggccacacaggccttcttgattttcccctgctacgtcctgctgcaggacctttgcacatgcgggattcacctgggatagtctgacattacttaaccccaacttgtccttcagatctcaggagagtcttccctgagttgccttgtgaaactctttcctagcactccatcatctccctggcttgattatgcacttcgtgcggccagagaatatgtctggggtttgtctccactgtatcctcaaggcctacaatgacctggcacataaggaccccgtaaatgtttgttaagtgaataaataaaagaaatgagggaaatgcaggaactgaagacagggcaactggcctccttttgaaaaactcttgcaactcaggacgtggcttgtatgaatctctgagtcattgtcgtatcaggagtcagatggagtggccaatgtagaatgctctcatctcagagatagagagagggaaatggtccttctcttcacattcgggagtttacagctgattgtgtttataaaccctcccagcaagatgatgccctctaaatgttcccctcccccactcagctccatatcccctgttgtctgtctgcactgtgtgtgtgtgagggggggtcatgggcccctcttattccacctgctgtaaggccacccttggtgactgcagtgccacatgcaagggtgaagtggtctggtgctcctctgcgtgtttacaaggcttaattaataagtgtcccatgtaaacagcctgcaccatgtacgtgccatccttacatttcctccctaaacaggcaaggctttctggaagtgtgtttcaggggggagaagtcaagctggaattttatcatttgttttccaatgagtattaaaaacatttgtctttaaggtttatgtgagaatatcatatactggaaatgtgatttcatattattttgaaatcagagttcagattcataaaatcaatatttaatgggaaacatgaaattgtaattactaagcactttttcggtgtgcttactatttttatatgtaaatatatatataaatatatatatacttcattttatgaaccatctatatggttcataaaatgaaaatatactggcaaaatatataaaattctaatttttgcatataatatttttccagtatataaaccatgtatatatggatatggttcataaaatgaaaatatacttgcaaactatataaaattctaattttcacatatagtatttttccagtgtgctgtccctctatgtttgcatatttatatttttgagtttcacgtgatgaaaatcctgtatctgagggttgatatgcacatgtacataaagtagaccatttcgtatagctaagggcttcacatttttcttcccatatagttttgtttatttccaatttcacatttgaaggatattcttcagtatccccaagtcattatgcaatttggttgtttatgtaaatgtcctcaagggattctgaacgagaaatatttcactgtttgttacgttgtgtagaaatgttcacaaatcatgttaatttgaaaaagaataggaaatgaataatctgcctgcagttttgattccatgatcaactatccaaggtcaactggaaaaagcctgagatgttggaaaattagtggaagtttttgtgtttttgttttgttcttcttctaaaaggtatgtagaaaaggcatgacataaaaaggggagaaaaattctgtctttaaaactcagtatcgtaaaaggtcatttgattataagtgaaaatgacaataaaatggtgaggatttctggaataagtttcccagaatagagagtacctctctttttaaggctattcacatttggagaggaaattgaaagttgatgtaattttccaacagcattcagaatacgggctttaaagtttcattttcttaaacttttcatagtccttcagatcatttggcactttggaaattttaaatttcctctgctgtgtcttgaaaagtggtgaatgattggaacacccagattatgaaggaggttagaacacaggttttataacttcaaaacatttttcacattcttatctctactgaaaaactttatggagcctgtgaatagaggctttaactgcagaattctaccttaggtgctcttaagcaactgtcggtctttttctattatctttacagatgtactagagcttattcaaggggaaaaaaagatgtgggctcagctttacaggaactgggaggaccagtttctttgctggcctaaatatacattttgagaaatcaaagggacgcttttttttttcttttgtccatgcatatagtataattgcggcttagtttgaaagtagcccgtgctttactgtttataacctgaaccatgtctattcaaagtgaattttgaggagaatattgaattggattcaccttttggttgttgtagactcatgctaaatcagactaatctttaggcatttgcctcatgtcgatattattttaaaagtggtcactatccaagcttagtcttgaaacttagaaggatttaccttccctatgcctttctttgtttttgagacagagtcttgctctgtcacccaggctggagtgcagcggtgcgatctcatctcactgcaacctccacctcctgggttcaagcaattctcctgcctcagcctctcaagtagctgggactacaggcacacaccactggctttttttttttggtattttagtagagatggggtttcaccatgttgcccagcagtctggtcttgaactcctgacctcaagtgatctgcctgcctcggcctcccaaagtgctgggattacaggcgtgagccatcgcacccggccccctatgcctttcaaattcatttttatcttagtctgttgctgtaacagcatgcctgagctgactcactggtctggaggctgggaagtccgagattgtggggctgcatttggtgagggccttcttgcagcatcaaaacacggcagaaggcatcacatggcgaggatgcaagtgcatgagatagagagcaagagagggagggcccaggctcatcctttgatcaggaacccactcccttgataactgacccactcccactatggcggcattaacctattcatgaggccagagcccccatgacctggtcacctcttaaaggtcccacctttcaacactgttgcaagagcaattcaatcaatatgagttgtagaggggacattaaaccacagcagtttccttttatgtctctcttaatctctgtgtattgaaagtagctaagtattcaagtttctaaggtataaaggagtggagcgaaggaaaaatcccccaaaagagggagagttactttgtcaaagcctagaaaatacctctcttatgagtctggtcagttcctccattagctgcagagagtgagaagcattagcccctttactgatacattggatagacaactggaaaaatacatctgattaagcctctgccacattgcctaattggaatggagagaggcaacactgctctcatcatccttacctctttaggccttcaaaggaggaatcaaggaatggaggaaaagccaggcctgtgggttagtggtttcaatcccagttctccatttaccaaccatgtggtcattaacaagttccctgagcttttgtttctttcgagggataataatgaagttatgagaatggagtgtatatttgcctagtatgtgtgcagtaaatactggttttcctctctcttccctctggaaggtcagcaagcaggtcaggagtaggagacagggggctggagcagtaagatgaactatgccaggggcaactcagggtgagacagtgcgtggtacattgacagatacagctttgatttcttcagcaagggtgttagggggcttgggtaagaagcaagaaggaaaggctgtattttcatattgggaaatcatgatagggtggcctgtaaccagcttgggatgtgtctagtacatctgaaagggattgcagaatcaccctggatgcttgtgatataacaagatgtcaggtgtggatatctatcgatgccgtggtttaaagaagggaatgggaataagccccctgaactcactttctagctgagaagaaaccatccaggaagtagcaacaagacaccgccttgttcatagaactgaactttgagccctggtcaatgaatacttaactgtaggccacgaacagaagccggtggggaagccagggtgggaggcagggctggggctggttggggttacgggtatcagtggtatggctaagacatccaaggacaggcacccttgtgctggagtttccatgggcattctaaggtggagaggagtaagagacattcgtggtggaatcagtgggtctccacacacagaaagggtgctccaggcaggccgtgagggagcctagtgcccctcttggggacattcgcttttcttacccagtcacttatgttctgtggctttgggaccagcaagagcaacagacaccctattcctccaccctcataggcgaatgttttccttcctttacttttcttaaaaatactttttaccagcataagatcctaaacatgacccctttcctaggagagatggcttttgcctgcttgtgaggggggtgggctttctactcctgccctggcagccgccaccctttacctgggatggggataggtgggtgggaggctttcttgccccacccctagtagcatatggcttttgcctcatgctgaagcagggtcaggtgtggaatgtgggcaggtttctgtccctccccagcaggagatggcttttgcttgatataaattaaagaagcgttgggatatgggtggatttaataccacctgttatggactgaatgttctagtgtctccccaaattcatatgttgaagcttcagcccccaatgtcatggtatttggaggcagagcctttgggaggtgattaggtttagatgaaatcatggagatggagccctcatgatgggattagtgcctttattagaagaagaacagacaccagaactccctctcttcagcatgtgaggacacagtgagaaggtggccatctgcaagccaggaagagagccctcaccaggaattgaatctgctgggcctttgatcttggacttccccacctccagaatgatgagaagtaaatatctgttgtgtaagccacccggtctatggtattttgttatagcagcccatgctgactaagacactgtccctcactggcaactaatcatcaccttgtactcgagcgaggcctgaagtgcagatgggcttgtcaggaaactcctgtcaccaactcaaacctcagcagggcctgtgccctgagcacagctcactcaggcctttggcactgtcctcagagtttctcaggggagttcagagtcctgtggaaaaagagtaggcagtagggacagacttctcgtgtttggggatctcagaagtcttaatctgtcacactaaaccacacggaatttcttaaaaccttagttttttgttttttttttttttctcacctgcttttcttgctgccacctctttctcccatacactgtcaaagctgaaacagtgcttgtgtcctttcttcctcagaggtgcgtgtcaccctttgaaagtcagttcagttggttgcctttccatctcaacactctaacgtgctcaaaaaattagattttgtggattatctgcttttcttattgttagggcaggagtggtggcattctctggcagtcttctgtatccttagcagaaacagaactgggaagggtatttggaaagtagaagctaggagctaggtgtgctgattgcctctgaggtatcattgtttatagcagtcctacgttttcagattatctcaacctgctggaagcttctctgtcttttgaatacctttgccattcatgtacatacccatcagtgagtctcagggttggaagacaccataaatgccacttcatccaaagccacagtttagtctccagttcacatgtactgccttgtggcatcattccagtggttgtcttaatcttttttttaaatattatattgttcagcccagtgtgtatacatatccatcctcaccccaattctgctgctggatataaattggcagctgcaacagtatcatgtacagaaagttggtatcaatttgagagggaaggagtgttctctgctggaggacagggaggagacagagccatcttatctgtttttcccacattttaaaatgcattgccaaagtcaattttaggatgcagttgggttaaattagtagctagaagataaaacccagtagccagaagcaagctgaacattaaaactttgggactctgaccacagtattgaacattatggctgaccatcatggggttaaaaggttaggaagagagtggaccagtagccatatatttttagcctgcttagaattatagttgcctttggaaatttttggtaaactcccatagatcaggattagaataaaggccataaatatggttcaaaaactgtactttcaacacttcattatatggtttgctattggctttagtggtagtgcattatctgaattgatgtaaatagtatttaagtttgtcttttcctatgagtaataagtattgtatgtagatatttccgtttctattacttaaatagatccccacagtagtttggtacatagttgccatgcacataattactgcatggctattattaggaaaattgtgtgggtaaaatccatcctgctatttggctctgtttgaaccttgatgcccatctgctaagcaatgtggggtcaaaataagtaccagggtagttctggccttggcctttttggatgtgggctcaactctcttttctctctacagtccctaaaactataatacaaggtgtcaccagagaggaagagcaattttttttaaaaagcctataaaattattactaccagcaccatacattgccagtgaacctgactctggtgttaaaactacttctcaaatagtatcccttcatatctatccttatgaattacagattatcagctaaaatacaaaataattccccaaagaaagttgggagtattgtatactaattaatctgcatcaagtcataaaagaaattgacatatgtaaggtgatgacattgagtttttccaagctggcattttcaagttttatgaaaggtacaccagtttatcatatacattgatttaatgtgattattatatcagctatctattgccacaataataataatgctgtgtaacaaacaaccaccaaagcccactggcatacaaaggatacatcgattattgctcatgatctatgggtcagctgggcagttcttctggtcttacctgggggacttacttatgtgttatgactccccagctggttggtctgggagtagttggctcacctgtacatggtccttcatcttccaacagacaaacctaggcttgttcttttagtgatgcctgggtattatgagagtggaaaggcagaggctatatgaggcctaagctcaaaaccagcacaccgtttcttctctgcacaccacagcaagccacaagtctagcccagattcaaaaaatgaggaaagagactctgcttctcaatgtcttatagcaaaaagtatggatgtcggaatgggtgagaattggcgccattttaaaaattggtctcattctggttactctggctgcttagcacattccctaaaacttagtgacatgaagctatcttattttgttcacagctttgtggtttaggcatttgggaagggctcagcttggcagttctcatttgggagtcacttggctcacccacatggatagcagttggtgtctacacatggcttttgcagcatttgagtagtcagactttcagcatgacaggtggcttccctcagaatgagtgtcccaagggaaccaggcagaagctgtaggactcgtgtgatgcagtcttggaagctgcgggtcttcacttccagtaacttctattgctaacaaacaagccattagtaagcccgaattcaaagggaggcaaaatacatctcacctcttggtgcaaggagtgtcagagaggttgcaggcatgttttaaaatctccgttaatctaccacgattattcatggagagacatcagttccctcattctgcaatgtcaggtcacagtgctatgatctttaacattcaccattcacattaaatagtgcatttgcaatttgtatttgcagatttttttttctttctttgtatagttctgtatatttaaaagtaatccaggaaatgattaagggtagctatttatttaattccaaattttcagtgatctttaagaaaatgcatacatgcatactttctatattgtttaattagtgcatgtatctgcactctgttttttcaagccattttgtacacacatgcttagagaaaacacaaaaatgcttgtaattttaacaatatccatgagttcatcaagataatatatcataatttgcttagcagtttccaagtttgagtacctctgttattataattacactaacttgatagcaccacgtattggttatttattgcaatgtaacaaattatcccaaaacataacatcttaaagcaataaacatttactatctcatgcagtttctgggggtcaggaatccaagagtggcttagctgctcattaggtctctcatgaggttgcagtcaagctgttgcctggggctgcagtctcatctgagggcttcactggggctggaggatccactcccaacttcactcacatggcagccagcaggagacttcagtttctggccacatgggtctccccataggggtgctcatgacatggtagctgacttcccctggaatgagtgatgagagaaagagagagagagccctcaaatgcaagtcatgttttttataacctaatcttggaagtaatatagtttaacttctgccatattttattggtcgcacagaccaatcctgatacagcatgggagaggactgttcatgggtgtgaatggcaggaggtggggatcactgacaggtcgtcttcgagcctggatactacacattgctataaacatctttcaaaaaattcctttttattggtaaatgataagggggcatttacttttagcatatcccccaatgcagaattatcggatcatacagatcaacaatttaatagtgcccctttttcatgttaaggtattcatgtatatatacacacatgtatgtacacacacacatgtatttacattgtaagattttcttatgtgtttgtattttatatttttatgtaattattcttatggttttaatgtgcacataaaattctctacattttacaaagcatgtagttgctagcaaaattccagtaagtgccctcagttggctatggtttgggatgggaaatgagagagggaaactgctgagtcctattatctcccagaaccctttttttcttttaaattttgtgcctggtttctataaattaggccatactgcccccaacctaatataagccattgccaccaatagttcctataacagaataattttttttttttttgagacagagtcttgctctgttgcccaggctggagtgcagtggcacgatctcagctcaccgcaacctccacctcccgggttcaagtgattctcctgcgtcagcctcccgagtagctgggattacaggcgcctgccaccgtgcctggctaatttttgtatttttagtagagatggggtttcaccatgttggccaagctggtctcaaactcctgaccttgtgatccacccaccttggcctcccaaagtgctgggattacagaagtgagccaccgtgtccagcccagaagaaattttaattggcaagaaacttgaccattacgaaatagaatgtgtccttcaccatttatgctgaatttcagttgtgccatctttatatttctgaggcaatgtaaagcaaacctgctgtagaccaggatactgaaagggccattctatatcaggcaatttttgaagcctttattacaatctgtgaactaatttaatatgttataaatgaatactcaattaatagtcatacattttgagtccacaccccccctttgccatttatatgagataaaatataactgtttcattttcatgtctgtaaaaatcttttcggcctttccaggaacccatctggatgcatttacacgatgcactttccatcatttcaaaatttattaaattttatagcaccttccatgttatgggcgctcaataaattgccatcaccaagttaaatgatggggtaataaggacaggactctggttgttcacactaatgacacagtttgcattgatgatgaagtccccagaacagagggcaggaggagccacctgtatgaggagtgtgtggggaggagctgtcctttacagcccgctgtaaggatcatgctgtacaaataaacctaactgtgtgggtggtcctttctctgcccccttctgcttttagagacttagaagagctgccaaagtacctataggaggtgtttgatttaaaaggaaacacaccagttatgccttcttgtaggggcatgtgagccagtagagtttgcagctgcatggagagatgaagcaaaactctgaacattcaactgcattaaaaaaaaaatcatgccaagagggcctttgagcaagaaattcttgcagatttatgacacccgatgcctgaactctgtgtgtgacatcagggttatggctctgtaagctcttaaccctgcagctgacccagtcagcttctggctgtactaggggttgatgcggttcactgtggttgtttgtagacctcagaaaagcacgatgattatttacagatttccagaatctctactggattctttgcttttcctttctcacaaggaaactttccaggatacagagcacaacaggatctgaatggcagtgaattctctttaacatatctcttcagggtgatgggggcttcactggtatagaggggtcagggtcagcccctgttgtttctgcttatgggttggagaccccctatatgtgcaagaaatacactaagccaacttactccattaatgatgatagcatggctttgtatattaggatgtgtgtgcatatgtgaatgataggatatacgttaatagtttgtaataataaaagattgaaagcaacataaatctgcattaaagacacttattaaaaaaaccgtggtatatccacacaatggaatactatgcagctataaacaagatgcaccaatatggaatgaactccaacacttacttgtaaaaagcaaggtacaaagtagagcatatacatgaatattgattgtctttaaagaaaaggaaagagggagaatatgcttgtttgcttaaatagtataacatttgtctggaaggctagataagaagctaatagtattagttgcctctagggaggaaactgaggagttggaggacacacatggaagggatgctgttcactgtacagccttctatgccttttgaatattgagctgaataaataaaatattgaaagaagacagtgttggaataaggcctggggaattgaagcttggggtggaggtgacaagtgaaccccaagagggcaggaagccaagcctctgccccactcccctgcttttttttaaccatacggtcccagtgtagatgtagctagcacatgtagatcctcaataaatatttgttaactgaaaaaatacataccacatggaaaaatcaccctttaattttaatgtgtatattacatacttaaaaatatcattgccattaaatatgaaaattgtcttgaccagaaagaaaaacaaaaacaaaaaaagagttcagaacaaatagtggtcttggtcaggagaaaatgagttcgggtttggatacattatttttatcagtgtttctcatgtttttcctattctgtgtgaactcctgtcttcagatttaaatagttgattatatgaactgaaattgtagaatgggagaattttattgctaatcagattatcctaggctttgtggttagagacaggctgtgagtcctgagtctgcttttcttttcattatactcagcttcccaccttttttcttatcttcctgtctgggacatttcattgcttatgagctacagacctgatgtgtttcatgccaaagcataaactctttaagggagattggctgtgacctacacggcacccacattctgcaacacgggattgttgggtgcctcaggatgggccagctggggtgtagatagagcacttgaaattacacactgtgttgttttcactgggatttgcacacttgagttaaaattctcagatgtcaagaaaagcaaaccaatgttttgtaatgcaccacagtcccctgattggtctcaagcagtgaattgcagccacatggtcaccatgaggaggaggatgaatgacagctgatatcaacatgatcatttcaggagaaatatgactagacacccagagagacaagtggattatgcaaagaggggaacccttgcacccacttgagaagtgtgtctcagtttggggaagaataattaaattccaaattgagcatgttactgaaaggagagacaggataaaaagcaactatctttagacccctgatgagggcatttctacaaagcctaatgtgtaaaagaagttaatagaattctatacaacatagtaaatagctggttcctattaaaagaaaagttttctgagaaaccaaaacccaacaaaagagtcatgccctcaagtatatgtgcatggacttgtgaggagtgagttgtaaagtattaagcaattaaggtttatatccacttacttacatataagaaaaccaaagctgagtttaaatggctatgatatcggagaaacagagaataggatatggaacatttatttcctttttttgtatttaaaattttttttcaacaaacagctgaatgttacactcatttgtggagtaacaaatggtccctggaatgaatatatctctcttttgagctttctatttggataatagagttgccacaaaccattacccccaacagatgcagtcctatcttcccttgaagtcatggcccttaaggtcttaaatttggcactgtaagagttaacagggaaagctgtaaacatccagattcccgggccccactcctggttatcaagattgagtaaattgggattggagtccagagataggaatagttttgaagtatgctaggagattttggtgcaggtggcacgtggcctactctttcagaaacccctttccagtgtttctgtttgtttgtttatttttggttttggtttggctaaataaaggctaactttcactagaaagcaaagccaagaaatactaaagctggggtcagcaaacctttggctgtgggccaaatctagcccttcttttatttttgtaaatactgctttattggaacgcagccatgcacatttgcttaggtattgttgatgaaaagagtcaaactctgtaaaatatttgaagagatttattctgagccaaatatgagtgaccatggcccatgacacagcccacaggatgtcctgagaacacgtgcccaaggtggtcggggtgcagcttggttttatacatttagggagacatgagattgaaatcaggtacattaagaaatacattggttgggttcagaaagtcaggacaactggaaggggtgggggagcttccaggctataggtagatttacattttctgttgacaattggttgagtttatctaaagacctgggatcaatagaaaggaaatgtctgggttaagataaaggattatgaagaccagagttcttatttgcagaggaagccttcaggtagtacgcttcagagataataggttgtaaagtgtttcttatgagacctaaggtctgtgttgagatgaatgctggagaagtatcatgaggcatgtcctacttccatcacggcctgaaccagtctcaggttaaattttaagagtgccctggttgaagaggaagttcattcagacagatgggggaccttaggattttatttgtaatttacagtatagtctgtggctgctgtcacactacaatgacagagttgagtgattgcaaaagagaccgcaaaacctaaaatatttactatctgaccctttacagaaagtttgccaaccacctgctaaaggatgaacatttacctgatgtgttacatttactccccttagaacaaataagaccttcaccaggagactttgatactttgctagtctgtcggaagtctgtctccaatagccacatatgataaaatgagctagaatggagcacgttcaaaacacaagattgaagtgaagtggcatacatcttgcagtcgacgatgtgtcttaggccactgaaataaatgatttcattttatttgccaaagtgtgacttggggtgaaggagacacctggcctggcctcgtgctagattggaccctcgatgtgtacacacgacttgttctaatatcacttttcattggaagtagacaggtgcaattaagtaacctagagaagggggtaaaacacaggtcttcattttcccattgagagagaactctgtccctaattcagttggtgggaaatggatttcttggctttgataattaagctggcaaagcaaatttggttccaacattttaatgagccagtgtgggtggccaacaaattgcaggttcagacgtaaatgtttcaaacctgggtggctggcttttaaccctggggcaaattctatgatggtaaggaaattttaggctggtagccaagttcaaagagtctttgccaaatattaagaaaaatgcctatttgaggcaattttaagttatttgaggacaggattatgttgttcattggatgtgattgagatgataaattaacatcatttgagtccactcaaattgtatacttgtgaacattcatacctgtgtttttgtgtctgaacttcatacacagaggattatcttgaaagagagggagacatgagaaaggagaaagtggtcttgctcctctcttcctgctttccagtgcccaactgctaaggtattcaggcctggttttctgtctggggataatcaaaatctgggttcttatgtaatgtaagaccactctttggggaaaaaaatgagttcagacctgagaaatgaagggttaatactcattgaattttcactttcatggagaggctgcatttgaagcaaaaccccgctgggctctgtgagcgaactttgcatcacaaaggtagggcagatttgcagaagaaagtaatagatttcaatttaggttgcttttcagcctgaaaaatagtctgaattctattactgatcctgttagcagagataataatgaaatgcaaagcaagtatggtttaaatgttaaaaaaaaacaaaaacaaaacttgtaaaaataccactgtgggttcttgatttatgctttctcattactcagtaggacaaaatacgatttgacataatgttcactgtgtggttaccctggggtcagaaaactaagccctgttacctaatacttcttacatttgcaaaagtaatcacgactgtgactcgaatcggactggaaaatctattgacttagagatagaaagatattaggaatctcttacgttactttttcttattcacctactgacaacttatacagactttgtaacttttctgatgaaagggtatccaggtggataattacgtattttatgctcttaaacaagttaagaactggagttgtattttttgctattgtttttaaaagtcaatatgttgtggctgttaaaaagcattattttgtgtatgtatcactaataacttatgttagcacataatgagtatgaccatcaagatcagtaacactctcttctttcattgtaccaaacataatgtagcctgcctggaatctttttgtgtatgaaaaagaaaaaaatagcatcttccattggaagttctggttaagagtagccttattatctacacctccttccatgaaactctgcttctgatttcctaactcttctgggggtttatacccttcagctttttccacgagctgctatttctttctagaatgctccgaaggcccatctgtacccatgggggcctctctctccgggtgccagcttagtttcaggttgttcacatcgtattatctgtgttcccctgttcctctaggtagctaaaggtcaggtctggctcctttgtgttgcagagcctggcatgcagtaggtgcttagtgacaaccgtttgaggatatcgacatactaaaatcctctaatctttttcctttaaatatacttattcagaaataattacaaacttatggaaaaattgcaagaatataacaaaaaattcccatatgccctcactcagatgccacaaaactcaaggtaatcatacttgttttctctctctcaagacacgtgtgtgtgtgcatatacacattctctttctgtatatcattattatttaattttctgaactatatgaaagttggttgttgacacagtgcctcatttacctctcaaacttgttctccctctaaaaatctgttttctaaaagattcagaattctcttttacctaaccacagaacaaccatcaaaatcaggatattaacctcgatataactctactattgaatgcataaaccccattaaaaattcactgattatcccaggccgggcacggtggctcatgcctgtgatcccagcactttgggaggccgaggcaggcggatcacgaggtcaggagatcaagaccatcctggctaacacgatgaaaccccgtctctactaaaaatacaaaaaaaaattagccaggtgtggtggtggccgcctgtaatcccagctactcaggaggctgaggcaggagaatggcgtgaacctgggaggtggagcttgcagtgagctgagatcgcaccactgcactccagcctgggcaacagagcgagactccatctcaaaaaaaaaaaaaaaatcattgagtatctcaataatgtcttgtatagatagatctacaatctgatccaggatcatgtattacatgtaattgtcatgtagtatttttttttaattcctttttttttttttttttttgagacggagtcttactctgtcacccaggctggagtgcagtggcatgatctcggctcactgcaacctccacctcccaggttcaagcaattctcctgcctcagcctcccaagtagctgggattacaggagcccactaccacgcccagctaattttgtgtattttcagtagagtcggggttttgccatgttggataggctggtctccaactcctgacctcaggtgatccacctgcctcagcctcccaaagtgctgggattacaggcatgagccaccgcacctggctgtatttttttttttaagtctaatccaataacgttgtagaattaccttgtcccttaatttggtagtgttggatgtttcctcatagttagatgcaaattatgctgtcttttttgtagaaataaatggtgcagaagggaggctgagttctcagtgcatcatgttagcaagtacgtgaggctgacttgtcttatcactggtggtattaacttttatcacttcaataaaatggcatctgccaagtttctacatgataaattcaagtaacaagtatttggtgcttagtaactaacaggtagttaataaatattttataaggagccactaaaaactatgtaaatattctgttcttcattagaattttatctacccattttagcatccgttgatgattctcgtcagaatcaattattaccaaatggatgccattattaccaaattggtgccaaatggtgattttctaccttctcattctttgtagatttataagttggtattccactgtgaagtagaagtttttctcccccgtttacttattattcattcatttatctttatcagtacagattcatggcatcttacttgattcaatggtctatattccattactatcagcatttattttgatgctcaagttttcccagatttggccagtgggaatctcatcaacttgtgtcttgtgttctttctacatgtccccgtcatcctttgagcggttcccttactttataataaaacaagatgtttcagactcaccttttatgttccctgcactataatcagctatttctttaaggctgtctggttttttttagtagagaatagtgtttattaaccaagatctgggtgctgtgtttgcacattgctactggaaggttgctgcttctagggaacagagatagaaaaatatttgagtgtatacacgtgcacacacacgtctatatcaatttctagatgtctgtctatacttgaaaaatcttatgcttacattggtattccaatcctaatctaacactctaggtttgttctactctttcctctttccatatttataactccctctttgagaagaaactgacctatgttgttgtcaatatacttacatttttgctcaagcctctgtgtacacccaattctcacacttatgggctgcctcctttgctctgatccactggccctgaccccaaaaagacgtgataattcttaattggcaagatagatgaaactgaagtaaggagagaaagagactgaatgtatagaaagagaaatgagagagagagaatatagtattctgcatagtctgtaaaaccaagccccatgcattgtctcaaggcaggtttttgacttctacagcctcagtagccatgaggtatgaaatatctctgtcggggaatatgagtaatttgccatttcttcaatgatacaaacaaacctgatttcccttattttgggagggggtttgtgatctcaaatgtgaagcatagttaataaggataaaacgttacttttgcattgaaagcaaaaatcttagtggaagaacttgaaaaggcaaactatatatattatggatagtgcaaacatttctgtgtgtgtgtaaagaataaataagattttaattgtttttattaataaattaaataacctaaccagtaaaaagtgctaatagagctgatgtaatgtatttacagctcttacttacctggctcttaaatgacttgggtgtgtttgtatttgtgggtaagtgggtatatgtgcacatgtggacacacactgagagtggtgtgtttccccacatctgtctacatcaccagagaggtagagataatttcctttagttttagaagagggacttggcagagactactcttttagttgaaaaatgtaaaatatcacatgaagtgttgatttttggagtgcttttcttgcataactacatgctttttcagactacagaaaggttaatgacaaaatctgaaagaatgatttagaaagatttttatctaaataaagcaaactagaaagaaaggaagtttatcactgacattataaaagttacccttgggaaaatagttacctataaattaatctgtggccctttgctctaagaatgccttttatatctccagctaacatcagatcttcttgaaatcaatagtaatctgattgcctccagagaacagttgccctcctgtgttttaagccacagaggaactgtacatttttgtgataagcataatttagaggagaattatattttctttcttaatctattacctactggtgctgccttatcctgttactcacatttccttttcatcattaagttgatagcacagaaaaagaaatgtgatattagtattggtagcagtgtaccttaatttggaagggtaggaaataatagctttcttaaactgtacctcatgtgttacaaagattagcccccgtgtctagggtatcagttaacattgctctctggtggattttatcttgtgttctgtagactgcgaagagatttttatagaattttagatgcagaatgaatgaaaggagaaaaatcaccttcagttgatgatgcaggatgttcgatgctattcctcctccaggtagacttctagtcttccactatttgtctgcaagcaattttcgtgtcacttataaataatcaaaaaacggaatccatgttaggtttaaagaaaggatttaggaatctgagcacggctttgactgatacaaggagataacagaaaaagctgaaatagaggaaggaaatgagagtggaggactaataatagcaggaaaatttgaagatatagttaatgttctgagaatttttccactgcaactcaactattaggcttgttaggagcatctgagtgtatttagcttcatgaacttcaactcatatttctggacgcctaagttcaagttatgttgaagaagcatgctcagatggtctggagaagttaggtgttgagggttgaatcacaggaatgtgttggataaccctgggtgttacctagctttgaaaagaagatgattcaggccaagatctatgtcccagtcactaggtgattgtgcagtataggtacagtaagagacatttccttggcctcctgctcaacaagctcagagccaatgtacagtacttggtcagcaaaacaagagtcttctttgaagacttagactgtgcagtataagaaacttgctgctattggagagctttggagatccacctctgggaggggtggataccattctgacacatccaatcaccatcatcagtagagatcactgatacattgaagaggtgtgagctactgggagatggtttttgctaggaggtttactcattatttattttcactaccgctgagtcaaattcaatgggggtagatggtattttctttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgattttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaagtacagaatctggtcaatagagtttcctgggtcacttgaatcatggttacctgtggcatggtatgggggtgagaggtggggtgacacatcccctttctagacttgagagacaggcagtggacaccaaaagtgggagggatgtgggttggcagtctgactaatatgtcccctgatgataggccagcacattctgttatttcggttggaggctgaagttattttgctgggcaggctgtatttaaattgcttgtttggcttcagtagtggcaaagataggaacacaggtcctttgtgcatcccctttggaggagcacattgttaattaaacagtgggtgcctacttacccaaaaaagcattgaagttagatacaaaacatttttaagcctaggacttgagccatgtaggcacttaaagagaagtctaatccttggcatagctggcaaatactttatggcttattgtctgtactttcctgagtctcaagcacctcctggagttcacaagctatctgaaattgcccaggaagaagttctggtaatgcattatgggaccatccatctttccacggatctgctggtatacaaatctcaagagagcaagatattggcgtaacattgccatgagctcaacagaagctgactcagctgcctttatgcccaaaggaagagttctcagcctaatagatgcagaagagagtgaccagcttctccatgttttcccatggtggggggaggagaaggctctagaataatgtggcatctgggaaaagaggaaatacagggaaggttggcctcagtgtgaatttctacaagggggaaatacctccctcatttgaattatgagaagcagagttgtaggtaggggtgttgcaggaatagggttgaggagggggcagatagagctattaagaggtgtcacaaagagacactgagagctgctagtcctgcaagatatcatggaatgagtcaagattgggacctggaaatcagagacaagagcatgaatttgacagtggatagataaatgagttctgtctaagagcatcctgttttgttttgttttgaaatggagccttgcactctgtcacccaggctggagtcagtggtgcaatctccacccactgcagcctccgcctcccaggttcaagccattcttctgcctcagcctcccaagtagctggtactacaggcatgtgccaccatgccgggctaatttttgtacttttagtagagatggggtttcgccatgttggccaggctggtcttgaactcctgacctcaggtgatccacctgcctcggcctcccaaagtgctgggatcacaggcatgagccatggtgcccaggctcctgtttttattcatcatgtttttttttttaaatgaattaactacataggttatagaatattcacttgattgtcattatacaaaaatgacatgtactttttatattgaattgttcacagttttgttcttctttgaacactattcttcctagatacctaaacttcatgagccatttcaattttctgggcaatcattggcatggtctaactttcaactttatgtacctgtattagttttctatgctgctgtaacaaattgtcacaaattaagtggcttaaaacaatccacataccatgggctaaaatcaaggggccaggagggctgctttcctttctggaagttctagggcagaatctgtttccttgccttttcagcttctaaagggctgcctgcattccttggctcatgccccctaataccatcttcaaagccaacaaagtcaggttcagtgcctctcatgttgcatcttactgaccctgctcccatcatcacagctcagtccctgactttctgttctgcctctctgtgattacatcgggcccacctagataatccaggataatctcctgaagtctcttttgccatgcaaggtaatacattcacaggttctgggagttaggccataaacatcattgagggccattattctacctaccaataaataagggcattgttgataccgcctgaaatgcagaagatgcttgttgttctatagtgcatgtggtttatgtatgacataaagtatgactcactttggggtacgctggcaaatggacttttggacagttccaattatcatcagaatagatttgctaatttaattctactttttagagtggaattagattctgaagttttaaaattacgtgagatttgttcttctaacagaggagtctgtagcctttcattgaaaaaagaagagtctggggccggccgcggtggttcacacctgtaatcccagcactttgggaggcagagatggcctcacttgaggtcaggactttgagactagctggacatcatagtgaaaccttgtctctactaaaaatacaaagattagccaggcatggtggcgcatgcctgtaatcccaactcaggaggctgaggcaggagaattgcttgaatccaggaggtggagattgcaatgagctgagatcacaccactgcactccagctcggacaacagagcaagattctgtctcaaaaaaggaaaaaaaaaaagcgtctaaactcccgaagagaggattcagtgagaatattagtcatgatcctggcttgccattttcttaactttgaaattattctagtttgtaaaaaaaaaaaaaaaaaaccaacaacaaaaacactaattgtgaattagattgtactctgtattcattaaaagaaaaacttgacatgatatttagatgaacatatgcggtttactaaaacagatggtagagaatttttaccctcaagcatgtatttttaaaagtgtgtttttgtttttatgactttttgaagtgattggattaaggagagtaagaaattcttcctataacaatctattttcatttgttctttttggagaaaaaaagctttttcatagaggttgtcaaatgttgccatatgtttaagaatgaatttgaaccattcactttctgaatcttaatcccttctgaattatacgtaatttgacagaagtcaaatatgttgacttctgtcaaatatatatatttgtcaaatatatctgtcaggatatatgacgtctgtcaaattacgtatttgttcaacttaggtctgatagtggatgctcctaagtactttgttagtctatattatttatttatttatttatttatttatttacaaagaacactataattgtgctctttcactggtttttattttaatgcctgacttgaggtcaagaattatgtgtagaaagagcacagacagaacaaaatcataagttaataatgccgttatattactggaaaaattaagcatgcagagctagttatagcagtataatattttgggaaaatatttaaattatcgtatgctccttaggttttaaaaacctatgtttcattcacttaagacaagcagataatgtgctattaagagcacagactctggaaccagattgcctgggttaaaattcttggctctcactttctagatttatgtccttggcaggttacttggcaccacttggtttcacttttctcacctgtaaaatggagagaggactaaatgaatttatgcacataaaacacttggagcaaataaaagtatttgcaatgatgatgatgattgtttattattattattaagctttggagcaaaagtattcattaagtaatcattactgaccacctactaagtatcagacacttttcaagtcttaatgaatcattaaattaatcagatcaacatcagaaacaatttaatgttacagtaacattttataaccaatagtacattgcggttaacttttcattagtgttccatttgaataagtcagctgaaaacagatttgcctcttccttaaaaattagaaagcacatgctatttatttgggagggaacaagcaggaattgctcaaaatatacataacctaccagaaacacaatggcaccaattccttggagtaagaagtggaaaattcatttaagaagagatgtgctccagatctagctgagggtacccagggacaaagtggacatttcaagttaagccctgggatggatggatggatggatggatggatggatggatggatggatggatggattttagtgacgtttaagattaaccatgtttcacattgctagaggaaagaggtcttaatgtacgtctttatatgggcgtgcacctctgcacctgggtccgctgtaaccatgcatatggctttggccttgctcatcccacacagccatgtgagcaggcaccctctgcactaatgaccctctctaggcccaacttccctatctggaaaatgcagaaatcttcagccatgtgtgagcatcattgtgaagcgggcagagcacatgggctaattatatattgtatgagattccagacacaagaattaagtgttctctgtgctgttcagtctacttccaaaatccggctcaaatccaccccactctcaccatctctacttgcccttttgaggccatcatttctctgctggactctgcaccagcctctccctgtgatcactgtgttctcctggtttcatgactcacagacgagtgttctccttatttttaccctcggtttgtttggaatggttgggggttcacttttatatattcagaaacacttgttttaatactttgttctttgtagtcctcttctttctaatagttactcatagcttcaattctcaaaacacaaaacaattttaccaacccatcattatgtatttctctacttgctttggtctgacctagggactattattttggaaggtgttttaaaaagtaatttcatagtttgtgacttaaagtgcaagaacatcctggggttagtagcacaggaaaagacttgcatatcactttgttaacatttaaaaaccaccaggcactacacttaaaagatggatgatgaatgccacataaagcctacaactcctgaagcctcttgtccatgaggctgggtgagtgaaaaacagcaaaacctgagatctgtgatttttaaggtaattggagaaaccaatacctccctaaaatagttcccttaatagagtgacttactgaattgctcaaagttcagacatgaggaggtgctttgtagaatttgctggaaactggaccacacccaccaatttcttgccagtttgtggcaagtgggccaggttttgtctggcaacatgatgcatgcattcaaaaactgtattttctattatcctttcatttctacatttatagtataactagtttagagcacaaaagagatatggcaattaatatgggaagtgatagacccaacacatattctatccaattctatccccacaaagacgaccggactaagcagcagccccagggtcttgccgcatcgtttcctttcgggagcactcacccacaatgtgttgggtgccacaatgcactgaaaatgtgaccactgcccttgatcatagaactatggaaccttagtgctagatgagaccttagaggttttctagtccagtggttttttggattagaaactaggaagagcattacttggggactgtcaagtaaaaacatttttaaaaattctaccatcaagaaattacgctaagtgaaaggagcaagatgcaaaaagacactgttttatgattccactcatttgaagtacctagagtagtcaaattcatagaaacgaaaataaaatggtggttgccagagacaggggggaggaggaaatggggagctattgtgtaatgtgtagagtttcagtttgggctaatgagaaagttatggagagggatagtggtgatgactgcacaacattgtgaatgtatttaatgccactgaactgtccacttaaaaatggtaaattatatatgtattttgccacagtaaaattctgctttcatcaccgttgcttgaaagaaaagaaatttttacattgaaaagaaaggaaaattaaaagaaagatgaaagaaaaagaaagaaaaggggggggtgggaagaatcaatcttgaaggaaattcctttaaaatgattaaatataactttaggaagcagatcaacacattgccctttgtgccctttgctttcgtctttctcacagactagaccagcgccgactgtttcgcagccacataccagcatctggaagctactgtaacttctgcggtacaattctctcattttgcagatgaaaaaattcaggtgcagagagaggaagtgtcttttccacagccacagggtgtatttgtgactgggacagtcatttcatgactcacagacaagtattctttttactttattattataggaaattcgccttatagtttagttttgttttattaagtctttattgctattggcttcagatttagttatcacttatagaatcccttctgagtgccaggcattgtattttctattttcacttagcagacatttatatagtgcttatcggaagcaagacactgtgctaagtgcccgacaaataagaagtcatataatcctaacagtaaccctcagagatgagaacaattgttatcccctattttaaaaataaggaaaactagctgagtgcggtggctcatgcatgtggtcccagctactcggcaggctgaggcaagaagattgtttgagccaaggagtttaaggctgcagagagctatgattgtgccactgcattccagcctgcacagagtacagccctatctcttaaaaaaaataaaaaaaagaaagtaggtggggtggaactgagacccagattgcttaaatactttcccgaagtcatatatagggctagtaagtggtggattccaattcagttttgactcactgcagttaaactcaattacccaacctgatgataaacaatgggtctaatacttgtaaatacatttggtagaatattaattgactttacttatttatttatttgagacaatctctctctattgcccaggctggagtgcagtggcgcagtctcagttcattgcagcctccaccgcctggattcaagcgattctgcctcaacctcctaagtagctgggattgcacgcatgcaccaccacgcccagttaatttttgtatttttagtagagacagggtttcgccatgttggccaggctggtcttgaattcctgacctcaggtgatccacctgcctcggcctcccaaaagaatattaattgactttaaaccaaacaccgtaaatgtgttcttcctgactctgagatgtatctgaggatattgtgagatctttattgaaatcatccaaaatgggatgccaagttttggtgtgcatattaattttttttaatccttgaaaaaactatcaactgaacatcttgcttatggatataatttacatgtcttagtatgaagcccttaggatctgagtacagcacaagtgtaatttaaagatgtagctgagacagaccaaaaactgatcagcatcccatagagtgaaataaccatgtgccgcgttaggttggggtgatggtgtcaggactatcacacattgagttggttataaacctgatggtgatttagttgtttggaggagcattttcatcagaagtccaagtaatcttgcattggaaagtgaattagaaaatgcaaatccagtggcatgagccttaggatacaataccttattagagttgggatacccagtggtgcagtgtagtcagtttctatttggagctcggtcagatgagttttagttgatatttaggtaaggactcaaaactcctgaagtattatattctttgatttgtttttcaacttgcttcttaaaattaacaagcaatgccaagacagtattgtatttctatcttttctttgtcataactgtcagaacaaatagcccatagaaaagcatgagaaaaagccttcatctcaaatcgttaataacaagaaaagaaagtataggagctcccttatccaacaccatttgatggaatcattcttgaccccctgtcctcctgagaaaaagcaccagatcattcatgaccttctcaccactgcttcatttaggactatgaagacagtatcatagggtataatgaaacagttatctgcaatgatagaaaaatagtataagcatgttttttaaaattgtggaacctgaccaggcgcagtggctcatgcctgtaatctcagcactttgtgaggccagggcggacggattgctcgagttcgggagttggagaccagcctgggcaacacggcgaaatctgtctctccaaaatatacaaaaattagccaggcatggtggcatgtacctgtgatcccagctacttgggagaatgagttgggaggatcgcttgagccccggaggcagagcttgcagtgacctgagatcgtgcgactgcactccagcctgggtgaaagagagagaccctatctgaaaaaacaaaaaccaaaaaacgaaccccaactgtggaacctatagaaagaaaacttagccttggctttaaatgaggagaaccagaaagttccagggagaaaaagtatatgttcaagatgaaaaggataccttgtggtcagggaaatttaggtggaggacaagcaggttatagatgttctagttttgctggaaatagtgtcacctttccaactgcccacctataaacttcacagagttgttcactgtctagatctccagctcagagaagcagagtgattaaaattcaacatgcatgaatctcaatattatttttgaaaaacatgcctttaaaaccacccatttcatcaaaaaggttaaagggaaaaacatttctcaagatctaagcacagtcttaagggctggcgtaaaccgtgacagtttaagaatgaagtgtttttcttatcaatatgagcattctgtgaaatggttgattttgacagaggtagttgctgtgttgaccttttcaccgtcttgttttttgttcataaattgatgctgttattgaaacaatatgggtaagagtctgtcttagatatgtaattttttccatttattgtctccatggttttactttgtttaacagattttaaagacttcaaaagaatagcactaatatacccaggagaaaaagtcacataaagttataaggttcattccattttaaccgtgaatacatttaaacaaagataaataacatccaatgtcaaaataatcttaattccttgaccacattttaaaaataaaacaatttattaccatttagttacatcttacaggaaaacccttagataccagtaggtaaccattagatttttctaggtgaaagtaaatcatttctgaggaagcattctctttaccaaagcagcattatttccaataaggaagccactcattcatttagtccttggtttattaaacagttactgaggctgggcacagttgctcatgcttgtaatcccagcactttgggaggccaaggtgggcagattgcctgagctcgggagttcaagaccagcctgagcaatatgacgaaaccctgtccatacaaaaaatagaaaaagtagccaggcatggtggtgcacgcctgtagtcccagctactcaggaggccgaggtgggaggattgcttgagcctgtgagaaagaggtgaaccgagattgcgccactgcactccagcctgggcaatagagagagatcctgtttcaaaaaacaagaaagcaaacaaacaaaaaacagttactgagggcatacaatgagctaggcactatgctatgtggggggatttttaaatttgaaaaatacagaccctgctatcatggcatccacacttttaaagataaatttcttccacagtttgctaatagaaaacagccatttagcatgacctattaatatggagtgcccaaagtatacaaataaatagtcaatctttaaggcaatatgttgctaccaactctaaattttatcccaagaaacttgaaaactttttattgaattaaataggaatataaaacatgttatgatccctatgcaatatactaagccctctggatcctcaggttctgtgtctgtggattcagtcaaccaatgatcaaaaatattcagaaaaacacaataaaaaataataatataacaataaaaataatacaattaaaaaattacagtataactattaatacatagcatttacattgtatttagtactataagtaatctagagattatttaaggtatactggaggatgtatgtatgttatatgcaaatactatgccatataatatcagggacttgagcatccttagattttggtgtctgtggggttcctggaactggtaccccttgaatactgatggatgactgacatagaaggtggtcaacagtctattttccagttgggagaaaggcagtagcctagtaagctttctcagagagtctgtgtcttaatcaaacgtgtccctggtcccctggtattgaatattagtccctggtcacctcttgtcttggcttgttaaggtttaatgacttatccttcaagtggttttgtctcgaagagctcaaatgccatcattttctgagtctccaatctgtcatttgtcatgttgcaaaatgggcactatgattgtaccaagccaggcatccctggcactccgggaatactggccagtctccatgacttgtggggggctttagtgttttccaagatgaggcctggttgattcatttctgaatcctaagtattgaggtttgtgtacaaatacggaagtgtgtggggtaggaagttccgagcaatcagctttccttggaaaatatttttccttttcaaatttatggctgttttttaaaaagggatgttagaaactttggttaatttaaagatgggtatgtgttttcctctaatgatggcacacagttatgttcagtgaggactcaaggaaaccaccttttttgttgtctggccaataacttactgaaatgagcagtgctgatttacaggtctgggtggtggtgactgaaggcagaattttggggagtttcattttttgtttaatttgaacaatcagagttcatcgtgttttgcggaagaggaggaaaagcagcccaaacccacacgggagggttgggggagcatctgcttgacagcactctcagttaagccctgcagctacgtgtgctcaaagatgttctcgccaaaagccaatgctaatttaatgtgtatggaaattatttattctgagtcatcagttacttttcttagctatagttgttattggtactgtaatgacttggcagcgtttcatcattttttcttatgtctggctcacatttgcgtgtgttaactccatctcacaaaaacccaaacaaacacaaatttcataggacctacttggcatctggcagtgtttgacacaactacctaattcctttattgaaattcatgattgagatggtccatcttgaactgattccagcgttcaggcacgaaccttttcgctgagtcgccttgggccaatcactgaacttctctgagcattggattcttggtacagggattggattagaactctaagttacatctagctctgaaggaaattagagatttttgaacttgatgaacattttctaattgttcctagggtaaatgtgccactctttaagacttgttactattttaagatgccactggaaacacagaggccctgcaaaaagatggacattgggtccaccaagtatccagacaggggcggggttggatggtccaggagtacacaggtgacctcctggggagccaaggtatttcccccaaggtgggtgagaaagcaggacattttcaggtgaaacagatgctcaacagagccaagctttgaagacacttacatttgggggactggactacaagaaaatatgagtaattctctttagaagtggtaatggaaaaccacaagaatcaggatcattttcctcagctgataactcatgagggcatagaacagaattctagatcattccgtggatatttgaggaagacttatagttctcaaatgatcccatgtatactgataggtattatcagtacacctgatatatatactgtgatgtgtgttagcattttaggtggcttaatacataatacccctttagttatctcctgaattttggagcaattttggaccattgaagacaggtaattcatgtcaaaaaaaatggcttttgatttgcatcccaaagactccctaactcttctccaaattgaacttatccccctcaatccatatcctcaccccttcctgggacaaagcctactccatgcagagaacctagtagcaaagagtatcagaatcaaggagataggtttgttctaaaaaccagaaatgttttcttgctttctccaaaagttcatctatcagacaggttactaaaaggagatgggagagatgtcaggccaggaatatcctgtagctgaagttccttcacttggaatcccaaggggtgggaaggaaagactctttctaacaattagcattgaactcattgttgcattgggaattgcagtggaaaaatatgaggatatgtattcaacaaatatttattaaatgcctaccaagtacaaagcacttttctgggttctaaggtacagcagagaacaagagatacaaggtccctctttttttttttttctctcctttttttgagacagggtctcactttatcacccaggctggagtgcagtggtgcaaatacaacttgctgcagcctcaacctccacctccctgggctcaagcaatcctcccacctcagtcccccaagtagctgggactataggcatgtgccaccatgcccagctaaattttgtattttttgtagagacggggtttcgccatgttgctcaggctggtcttgaactcctgagctcaagcaatgtgcccaccttggctggcatgagccaccgtgcctggccaagttccctcttcttatggaacttacattcttggagggggaaggtaataagtaaacatatgaataagatcttttcagatgttcataaatgccttgaggagattaaatcagtatcatatgatagagagcaactagggatagagtgaaggaaggtgactcattaaataggtgaccaggtcaggccactctcaggaggggccgtatgggcgaaggagccagccacatgaaggcctgagggcggggtgagagggagcagctagttctaaggccccaggttggaaagggcagggtggactcaaggagcagaaggaaggccagcgtgtgcaggtgatggtgagtgtggggacagtgccaggacacgaggtcagagaggaagtgggtccagatcagctaggaatgtgaggtttcctcctaagataacagaaagcctttagagtatccaaacaggtgtattccaatcacctagggacttcagctgaagaccatgattcaggaagcctggcagggcctgaaattctgcatttctaacatcttcctgggatgctgttgctgttgctgttgctgttgctgctggtccatagacgtcactgtcagtgtcaaggctctccttctcctttaaaatgatcactttgggccaggcatggtggctcaagcctgtaatcacagcactttgggaccccaaggtgagaagatcacttgagaccaagaattcgagaccagcctgggcaacataataagatccctgtcacccctgtctctacagaatttttttttttaatgatcactttgctgtgtggagagtgaagaatcacagaggaagaagagtagaggcgggagaccagttagaagctgctgaactgcatgtgagggcataggcatccaggatagtgtgactgcagcgcgaggctccaaaataaaggggcccccagcaggtcccctgaattgttctgaataggtatatgcccccatatgcagctgcccaatattcaatttcattatctatttaaccggctaatattcggattcaactgttgttcattgagtacctactatattttagaccaagcactcctcaaactttaatgtgcagagtaatcacctggaatctggcaaaatgtggattcagttaaacaaagtttatgggaggccattgttttggattagcctcttgcactcggccgcagcagaatagatcaaaccagaatggagtcacttagtgctaagtgccgtgtatacaaactgaactttgaaacaggccagttttcctaaacaagaggaggttccaatcaacctgagtcagcataatcaggaaggcccctctcctttaaccctctgaggaaagtaactttgaaaccaccagttcacttttttgttttctgtctctgctttctttcacccttttctgtctctaaagccaacctctctgctcagctccttggaacacctattttgttttatatagaatgaggttttgcctgattctagaatcaaaaatgaaagcttattcaatctgtaaaataaatctgttgtaatttcatcttttgacatgatttcatagggctgaggtgagtcccgagagtctgcctttctaagaggtgacgttgatgctgctacacctatggttttcaaatcacactgtgaggcagagtcacttgggaagattttgcaactaccaatgcttggatcccaccaaaaatggattatcagcttctctgatatcagcttctcctccaacatttggaggatcccaaatgtggtatttttgaagaagtttcccagatgatgctatggtacagttaaggctgagaactagaactagaagctttcagccaatttccctggtatgtggctagtattgcttccattgtacagagaaggtaaaaaggggtaacttgccaaaggtcatttggccagtaaatggtaaggtggaggtttcaacttagttctaattccaaatttagagcttttttcatagtaccacactacctccctacttccctattttgggcaaaactcactttgctaggtattgaagggaatgttgtctgagtcggactccagtcaggaaacagaaactcgttggctattgcaaacagagggtatctaatacaagaggtttggtacaatgatattgagagggcaagaggaacaaaaggaatagttgcagaaggaacccaaaggaaggtatgttcccagagatcaggcaacctctaggatcctgggatggaaacttggactttgcatctggggctgcactgctagagatgctgcttctggtgctcatgctggaaccactggagccaggtttctcccagaccctcagccccatgtgaatccaaaccctgtttcaaaaggaatgtccatgggaaaatggggtttgatttacacgttcagttttcaggctacatttgctagaatgcacctcttttgtatgtgcaagaatgccaataggtgctctgaaagctgaattctttagctattcgtcatatcctagtggttagcatcagaaggaagccagtacagttgggtctcggtatctgcaggggattggttccaggcccacctgcagataccagaatccaagcaaacttaagtcccacagtggactctgagggacctgtggatacgaaaagtcagccctccgcatccacaagtttcacaccccaagaatattgtattttcaatccgtgtctggttgcagatggaacctttggatatggaaggctgactgtattttgaaaaaaatctgcatataagtgggcccgcccagtttgaacctgtgttgcttaaggtcaactaatgctctttggcattttgggactgcccctcacctactgagtccttcacctgtggagccccagcagctggacacccgggtgctcagtcttccactgcgttcactgcgtcttccccttcagtggtcaccctggtgggtggtggtcgcacagcttggtgtgtgtccttaccatgctgtagcctctggtatttattaatgaaaacttttctttgtgcgtgaccatctctgctttgcattcttcccaatgaccaagaacattttgaaatgaaaaaaaaaaaaacccaacaaaaacaaaattgtaaaattacaatgactcttattgatattttgatagattaaaaaaaaagactagtaagatttgaaatagaataaaacgtatttcttatagcttgtgaagaatgtttttaaaaagcagaaagatctccttttattaagtgaatacataaaaatgatgatagaaaatttcttatggcatcagtaattaatttatattcattaaacaaatttccatacctgcatgtatttacataatttccttctcttatgattaatttaatacttaaggagaaaatgaattattgattattttaatgccagaattataccctgcctcaagtttcatctgtgggaagtgctattccatgtaactaaggagacagaaaatcccctaagttgatagattggtttgtttcctgttctactttggtttaattactatttgataattactatttaaaaatttcaaagcacttttcattttctccctagctgtgctttataatttgcccaagggggtctgttttgtttttgttttttttttctgtcatgtgtttgaataaatagcaaattgttgctgctttttccagggaagatgcaaaagagctgtgtcatatttctttgtgtaagcagttttctgaattattttctttggtctacctagaacaaataagtctctgaagaataagaatgaacacttaacttttcactacccttaaaatactataatagcagtacattaatcatgtgtcaattaaaagccaaagggggctgggtgcaatggcccagacccataattccagcactttgggaggccaaggtgggcagatcacctgcggtaagggagttcgagaccagcctggccaacatggagaaaccccatctctcctagaaatacaaaaattagctggacgtggtggcacgtgcctgtaatcccagctcctcaggaggctgaggcaggagaatcacttgaacccaggaggcagagattgcagtgagccgagatcttaccaatgcacttgagcctgggtgacagagtgagactctgtcccaagaacaacaacaacaaaaatcaaaagggcctcccagagcagcacatagtgtttttgctgtcattcttaggatctctaaagtctgccattacggtatagaaagtgtcagtgaaataaggaaaatttgtcttaattactttccaggaaaaaccaaggtaggcctcagttaatttgttgtgtagacaagaaggggctttccaacccatcctttctcatctgtgttttgagggagagtcagatggtcatatgcacacatctgttatatgtaactgtcttacaccaatcattattttatttacaagatctagctatttgagagagattgcaaaaactggttttagctgcttgtgtttcaagtcagaagtgcgtgaaggaggtcaggccatgatcactacagtgtggaggccgccggctgactttgttgaggaaaatgaggtccagcctgtagaagggagctagggagtacagagcccgaaggaaggtggtggggagttttctcgtctgcacatccctccctctgtggttatcccagcaaagtgggaatattatttaaaccatgtactgctttattttgctggagcatttgatatgtttaaaaagtgtcagaccatttcctcggcaggcatatgcttgcacttagccttaattcctacccttggagaaggcaaatacagcgtggccctcgtctgtatattttaagaggtttcttataacaggcctagtctgtggcaatcctagtgagtagtacttagtgggtttacaaaccactctgtcgcggtgatgacatactctgtgtggttctgggagctaaataaaacaccggaaatagatattaaataaaataaagaacacgcctatgtaattattgccagaaatgaaattttgcaaccctaaatttgaatgtggtctaggcacctgaagattcctgtagctaaacaaacatcatttcccagattaaaatttcaggaaagcaacgtctatcaagtgtcttatttgggtaaaatattttgaaaatgttttgactgatcacagggggaatgggaagcagatggtaagtgagacaggtgcccctaaagtccacatccccttctgaatggctccatttcctattacattagacagcaaaggccactggcccaggccaatgtcacttatgttctgctaggggacttttggccaactcagaagatattggtccttactgtggaattgttttgtgattttaaaatatagatctctttaaaccctgaaaaaatatatttttaaaaggactaattttttaaacggcagtgatccaatcaatatgattgcagtttgagcttaaggggcactattctcactcaagtctttggatttttctgtagcctttcccaaaagtgagctaatgttttgaagtgtcagttatttacttcggttctgtctggtagaaaatacacaagttgtctcatttaatcatgaaggtaactctcttcggcattttgcaggtaagaaaattgaggctctaagaggtgaagtaatttgcagaagccactggaaagtggctgattccagattccagacccagctctgtctacctaaaactacatcatctccctaaaacacctcactagccatgctccaatgcaaatgggcctagcaagttcaaatacatttgtaatttgcctaggttttccatttagctgaagttaaccacacttccagtataatccaggtatttatggtttttgtgttttgttttttttctcccatttacagcacttagcataatgttctgcatagagcacatacttaatgaatacttgctgaattaattcatttcagatacgttgagccccgtgaaagctgcttaatttagaaggctcagagtaactttggttaaaaaggttcagggatggatcctctccaccctttcgttcacctggtaaaatactatttcaaggactaatttataccatcgtctcctttaggtagctttctctgacccactttgtcactgaggcagaattgtttcctcatctctgtatgacttagcactgtttatgtacttccatgtcacttttttaaaagcaagaatgaaaataacttttatttattgtgcaatgtgctagacattaaactaaatactctacacattttgtctctttaatcctcaaaacagccctgggaggtaaggctgttgtcctatgttacaagcgaggaaagtggggcttaaagagaataagttacttgccccaggtcttacagttagtgaatttcaaagatgcagtaggaacccagttctcgcctgttttcaatatattcttttcttattaagataaaatttgcagtaatgtgcacatatcttacatgtacagtttgatgagttttgataatacacacatctgcttaaccgttgatccagtcaagatgtagaacatgtccactgatcagaaagttacctcattgccccttccctgtctgctccagccactcaggattagggctgcctgttctttatttaaatcaattaatttatttcttattttattttattgtttctctcagttgaattttattttattttttcctgcttttattttagatacaggggtacatgtgtaggattgttacatgggtatattggacccaagtagtgagcatagtacccagtgagtagttttgcaacccacgctcctgtcatttcctgcccctgtagtaggttgcagtgtgtattgttctcgtgtttatatccatatgtgcttaatggttacctcccacttacaggtgagaacatgtggcatttggttttctgttcctgtgctaattcacttggcattatggtctccagctttgctgcaaagaacatggtttcattgttgttgttttttttaatggctgcatagtattccatggtgtatgtgtaccacatagtctcgatccaatcctccactgatgggcacctaggttgattccatgtctttgctattgtgaatagcatggtgattaacataagagtgcatgtgtcttttttggtataatgatctgtattccttcgggtatgtacccagtaatgtgtttagctgggtcgagtggttgttctgttttaagttctttgagaaatctccaaacttgttccacagtttgaaactaactgaactaatttacattcccaccaacagtgtatatgcgtttctgtttctttgcagcctcacagggctgcttgttcttgaacttcatagaaattgaactctagagtatgtattcttttttctctttcatgtcttttactcaaaataatatttttgaggttcatccgtgttgtgatatgtaaagatatccactacatcagtggttcattgatttttattgccaagcagtattccatttcatgaatatatcacggtttatttattcattgtcctattgttgggcatttggatggtttccagtttggggctattgtgaataaggccactgtgaatattcttcatctatgtacaagaatgtacaaaaatctttttgaggacatatgctttcatttctgttgggtaaatacttaactgtgtaatccctgggtcatagagtagaaacatgtttaactttataagcagctgccaattttccaaagtgtctgtatgactctacactcccactaacaatgtgtgagtgttctaattcatatctttcccaatatttaaaaagttttatgctactttaaaatagtcctctttcatttatgcagccaaaaaacacatgaaaaaatgctcatcatcactggccatcagagaaatgcaaatcaaaaccacaatgagataccatctcacaccagttagaatggcaatcattaaaaagttaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcctgtcctttgtagggacatggatgaaattggaaatcatcattctcagtaaactatcgcaaggacaaaaaaccaaacactgcatgttctcactcataggtgggaattgaacaatgagaacacatggacgtaggaagcggaacatcacactctggggactgttgtgggttggggggaggggggaaggatagcattaggagatatacctaatgctaaatgacgagttaatgggtgcagcacaccagcatggcacatgtatacatatgtaactaacctgcacattgtgcacatgtaccctaaaacttaaagtataataataataataaaaaataaaaataaataaataaataaaatagtcctctttcccatttgactttgagcctgtcaaggtcaggaaacatgtaccattcatttctgcatccaccatgcttagctcagtgtgtggtgcaataaatatgatgcacatgaaactataatttgagaattgtagaaacagttgtcaaagtccctttcagcagtgacaatctggaaacctaaccatgtgccatggggcatgcaggtagttttacactgaaaagactttggatagttgccttcagagggtagcagcctttcaaaggtgaagtggcagattggtgatctccagaaggaagtgagtgaccagccaggcatgggctctcctgagtgaggcaggctggtgagtcccactgtgtgctgggaggccatgcttcagcaatatgtccatctgacatgaacagttcacttggatatcagtggaagccataatgtcttagcttgtcgacctctgacctgctatcttttaggatgatgttttagttatctgtagcaatataacaatatgagaaggcacttagcagcttaaagcaacaccttattcattgcaacacatacttattatctccaggttcctgtgggccaggagtctggcataacttgacagagtcttctgcttcacaaggctacagtcaaagtgtcagctggggctgtgggtgagtcaaagcttgactggggaaggagctgctagcaaactcaagtggttgttacaggattcaggtcaacgtgggctggtggattgtgggcctcagttgcctgctgaatgttggccaggggccgcccaaggttccttgctgttataaatttgtgtaatatagttgctgcctcagcattcattttcaggcctgacataagatgtttgaaacccagtcactccctgtcacctttggcccagttaaaatttcccctcgtgtggttgtttgtaatttggcctccttattccttacacaaggacatgaataccaggaggtggggagaactgggaggttctcttggagtctgtcacagatggtccattagaattctttttaaaaagtggaagtaatacagatactgtgaggaaagtagttgttttgacccaaagagaatattatattttttactgttctaatgaatagtttcaggggctccagctttatctccaacacagagagcctgttctgggtaaattatctgcagttcatgttcactggcacagaagattgattggaaaacatgaagtgatttctggataaatactcatcagtgggttcattcagtgcagatgaattgagtcttttctataatctcccactggacagagcttttgctttgaaatttgtcatgggttaaagagattggcagagtgaccccctataacctaagtgtaggaagccagatatttttgtcagcaaatttgcttatctggaatggaatgattggccctgaccagacacggaaaaaaatcttagggtcatataaaagtaacttgtcacacctgttgggagaatctttttaagaagtaagtcacatgtatgagaaacagagcaaacaaaatattttacttgttaggagatacctggaagatgttcaggctttaacacttagctttggtgagtttagacagtcaaggaagacagcagagtcttgttctgccctgaccatggtatagttattctacccattcttggttgttaaaaaaaaattcaatgttttttcccgcaaacttgaactaagcacaaaggcttattttcagttataaaaaacatgattaaggctgggcatggtggctcacgccagtaatcccagcactttgggaggccgaggtgggcggatcatgaggtcgagagatcgagtccatcctggctaacatggtgaaaccctgtctctactaagaatacaaaaattagctgggtgtggtgatgcgtgcctgtagtcccagctactcaggaggctgaggcaggagaattgcttgaacctgggaggtggaggttgcagtgagccgagatcgcaccactgcactccagcctggtgacagagtgagactccatctcaaaaaaaaaaaaaaaatgattacactattctaataggtttgaaagttttgagaaactttcaaactctgtttcttatacacagagagagagacatatgacaagaaattgattacaggaattggctaacacatttgaggaggctgcaaagtttccataggctctcttcgagccggataaccaagaggggccggtagtgtggctcagtccaagtcagaaggcccaagaaccaaggaggctagtgctgtcactttcggtttgaggctaaagaccctagagccctagggcccactggtacaagtcctagagtccaaagaccaaggaacctggagtcctcgtgtccaagggcaggagcagaagggtgtcctggctctgcaagagagataatttgcccttcctcctcctttttgttctgttcaggctctggatgagtgggcggtgcctgctcttgttgagggtggatcttccccactcagtccacccacttacatgccagtctcctctgaaaacactctcaaggacacacaggaagcaatgcttcaccaagtcatccaggcatccctcattccaattaagttgacgcctaaaattaaccattgtagccatagagctgaatgtaaaaatttaaaaattcatctccttcataagctgcataaacctccttctttgagtataagaattaatcatcccaatgaagtagaaaatagtatatttatgtcatctagttgaaaaaggcaatattaatagacatttggaaactccttttgccacatttcaagtttattccgggcagtttaccttgagaaaaaaatgcctcttttgatggatgctgtattagtccgttctcacactcctataaggacatacttgagactgggtaatttttaaaggaaagagatttaattgactcaccattctgcaggactggggaggcctcagaaaactacaatcatggtggaaggtgcctttttacagggcagcaggagagagaatgagtgctgagcaaaaggggaagcaccttataaaaccatcagatcttgtgagaactcactcactatcatgagaacagcatgggggaaactgcccccatgattcaataacctccacctcgtcctgcccttgacacgtggggattattacaattcaaagtgagatttgggtggggacacagagccaaaccgtatcagatgcagaccgaaagagcaattttattttagttacaacataataatggtgttatatagtgtataactatagttatatagttacatatatatagttacagttatacagtgcttactgcttattatgtgccagatactgttctatgtggtatatgtgtgtgtgctggggatatatacccactctatgatatatactaattctcaccttgctggttccctggttaatgagctaaataaatatttgatgcctacccactttatatttctatgagtgtagtgttttcactttttgaaaattatactttagtcaattctgtgatacagatactattattattccagttgtatggagaggcacatgagacacagagaagttgagtagcttccccagggcttcatagcagcccacggtggagccagcatttgagtgccagcagcctggaccagcgtctgctcttaactatcatgctacaccccgtcttgaagaatttattttctttgcatatgtaggccatagccacccttctgacactaaagaagcacaatcaaccagagtccaaggcaaaccagcacatttcatctacggagagcaaactaatcaaaaaagcacgcttgctccagcctgacccaagcatctgggttaggacaaccaatctaagaaagcccacacttcactattttaaagaaaataaatccttggcaatagtggcctcattatgattctgaagggcaacataaaatgcttcccagatgaattagtaaacaacaccaaaagttgcaggaatggatggaggtctgtgaagtgtctcaatgggcaactggaagtgcagcctccaggttgacatatgggattacagaggaaccaagaagggaaaaatgatggaaagagatgagcagtttctgaagtgtggttgtggtatcactgatgtcgtggactctacactgatacctgccctcactatgattcccgttgtcccactcggacgaggccttcaacagagctgcatttagaagccagggaagattttcccgttgtatcatctgtggtctttctactggcaactctcatgggattccttggctggagggtagagcaaagcatcagaacccctaggctctgcctttgaaactccccatatcattcagaatgggctttaaatggcatctgtgccattccagaactcacccttgtgaagctgatggctcagggcttcctgctcttgtttggaggtggtgtcagtaggggcagaggaaggctcagccagtctttgtggaccctggtagccaggctcgctcctgctcctggacattttgagcaacaaatggctattgtcatggacttttagcatccctcatccctgacatgtagcctcgggacagattagccagctggatttactttaagaagtatgtataatatatttgtatacacacacatatatatacgtacacatttacttatagtttttactgatgataaaatgaaatgttaccagtataaaagcaatttggacatcacaaaaaattataaagaaaaaaatgcaaatcttgaactagaaaaaccaaggtagaaaattcctggaaatccagccactcacagatactgctttatttactaaaaagggaccattagcattttaaataccttttcatgcaaatctctatgcatatatacatataatgtatatctctatgcatacagatacaactgtttgagaatttaactatgctaagcagactgttggcaaacttttctgctcagccaggcgacctttatggtcaatcaatgctggtgtaaatcaccattttagcccatagaaataagaagaatgttgtgactgggctttcctgtggtgaggtgacggctgggaatagaatgatcagaacatctgggttcgtgcaatttttcctgaacctttgcagactttatgtgtacattgggacgagggagtcactaaagccgaggggagccctccagctcactgctccgacaacttagagggcaagtgccgaaacagaagtggctggtgttgactgcatgtttacggtggctgccaactgaggggctgcccctgatgaggccgagtgagtgaggcccacactgcatgtggctgggaaaggtttcaaaccatgacttcttacctttgttcaaaccagatgcaaggaatccgaggatgatgtctgggtactgatttaattagcagcaaaagggattaagcaaaccagcaatcatgctctttcatctctgtccagaaaaggcgtttttacctgcacccatggttgtgaatctgtgactgatgccagtgttgtcattaagaaaggacctcaagcaaagcagagtcgggaacattttgtgtttaaaatgtttagaaacaaacatggacagagcccactgatttttcctctgggaaaaagacagtcactgtaaatagacaaattacactgaatctatccgaaacatatgttgcgtttggctaaatgctaatctcttatttgccctcctgctgccaaggcccgtgctgcgtgccctggatctggatgtgtgtttaaacgattatagttcaggaaaagagcctaggcctgttcatgttccattgaggctcctgttctcagacttactgattttcaatctggagattttactgaaatatatattacagtctcttaccatgtaagccaagtctgtttttactttatccatttgtatggagaaatatcataatcctcagagatctggagcataggagattgctttgagggcatgtagggtaggagctgcctagtgaactgttcacttggcctggaatgtctttctctcttgccaatccccacctttatcacttaattcctatttatcttttttattgaagctcaggtagcatcttccccgggaatcctttgctgaccgccctgagcctgagttggttattcctccactgggcttccctagctgcccactgctttcctatctccaaacctccccagacttgtaaggtctgtgagggtcagaaccccccaacccccatgtgttatgcccagcaccgaggacagtgcctgtcacatgactttagtaaatacctgttgaatgaatgaggacacttgtcttcttttcttttcttttaaaattctggggtacatgtgcaggacatacaggtttgttacataggtaaacgtgtgccgtggtggtttgctgcacctatcaacccatcacgtaggtattaagccccacatgcatcagctatttttcctgatgctctccctccctcccccaacaggcccctgtgtgtgtattcccctccctgtgtccacgtgttctcactgttcagctccacttataagtgagaacatgtggtgtttggttttctgtgcctgtgttactttgctgaggataatggcttccagcttcatccatgtccctgcaaaggacatgatcttgttcctttttatggctgcatagtattccatggtgtatatgtaccacattttctttatccagtctgtcgtctgtcattgatgggcatttgggttgattccatgtctttgctattgtgaatagtgctgccatgaatatacatatacagatatctttataatagaatgacttatattcctttgggtgtatacccagtaaagggatcgctgggtcaaatggtatttctggttctaggtctctgaggaattgtcacaccgtcttccacaatggttgaactaatttacattcccaccaacagtgtaaaagcgttcctgtttctctgcaacctcaccggcatctgttctttcttgagtttttaataatcatgattctgactgatatgagatggtatcttattgtggttttgatttgtatttctctaatgatcagtgatgttgaactttttttcatatgtttggttggccgcatgtatgtcttcttttgagaagtgtctgttcatgtcctttgtccactttttaatggggttgtttgtttttcttaaagccatttgttcttcaacaggggactcctgtactccaagtaacactttctgctcccagagccacttccctaccccctgcatacccaaaatactggggtgatattttagatttccagtcctccagatacataaggacaaaaatgtgcaaccttttgcatcatataacaaagttctttctttcttccctaacagatatcacacatgatgaagtctgatagctagtgtcgggtagttgacagaaaaacaaacaaaaaggtttttttaaataaaaaagcaagcctgtgggtcttcagaataaaatcactttgattcagctataaaaatatgacttagaaacattgcagtgagcattgccaaatacagctcctctgctaccgtctgtcctggagctgcacacctgtccctgtaccgctgagcccacgctgtaggatcttggaattggggcgtggacttgttcattgtgagcacacagaatgtggacatgattctgaatgtgtggctgtgttggaacttgcccaatctatttcaagatgataaattacatacttccggaaaggctattctgttttccccacagaagatcttaactactctttgtcttctccttttatagaactgaaaatttaattttgtctaaatgtgcttttcttcatatttacttacattctcagcattacagtatactgtctacagaaacacagtcctagtttttcattttaggaaaaggtgattcattatggaacaaatcttaattttaatattaccatgctttggtagaagtcagtgttggaaaactctagaaagtattgccttggaataaaaatatcaggtgggggaaggagcaaggatagctgggggagggctgagcttctatttcctgatgaattgaagttcacatatggatggggtgagatcatggtgtaatacacaaaacttgggtcaagagggtagaaattaaaggtaggaaaacattttagaagcctctgttgctgaaatatttttgcattgtagtggatattaattattccgatgttaattattcgctaggggtctgtgttagtccattttcacactactgataaagacatacccgagacggggcaatttacaaaagaaagaggtttaatggacgtcgggttccacgtggctggggaggcctcacaattatggtggaaggcaaggaggatcaagtcacgtcttaagtggatgccagcaagcaaagagagagagcttgtacaggctttttaaaaccatcagatctcgcgagacgtattcactatcacgagaacagcacgagaaagacccgcccccatgattcatttacctcccactgggtctctctcccttgacacgtgggacctgtgggagttactattcaagatgagatttgatggggacacagccaaaccgtatcagggtctttcctggtttttacccagtgtgcttcaaacagtcattgctttgcagcctacttgcctcgccggggatttgttatctcctctcatagtgctctaacaatttccttttgttctcagatcactgccctttctcaccaggggaggattcactcacagaaagcaggtagtgggctgtcttaggtaaagaaatacccacttctggtgaaagccaggtgaggaaggccagtgggaacagacgggagagaaggaacaagctctctgctgggaaggtcactgttcccagggaggacttatttggaggctgaaagccagataactaagaaaattaaatggtagtttccaatcagagtaaaaaaggatccaaggaaggtggggatgagtttctggaagtggttttggcagaaggcagtttcatctttccatgcacttgcacacaggtagaaatctgcattttttcacctgagttttgctcactaatgttcataatattaatacttcgggagaaaaaggagacccttacgatgagattcactagaaagctgagcaagacatgtatcctggagttggccacgggtaccactgcagatgctgggcaatacagtttgtgttgtgtaaattatacacacttgagctggcaggaactagggcagcacctggacctgacaaaaaagtcaattgatagatgacacatttcctcctttgtatgttggtgatcaattctaactttttacaacctagtcaaattgcttacagctgaaaaatatggggttttgttttgttttgtttcgttttgagacggagtttcactctgtcacccaggctggagtgcagtaacgcgatcttggctcactacaacctccacctcctgggttcaagcgattctcccacctcagcctcccaagtagctgggattacaggtgcgtgtcaccatacccggctaatttttgtagtttttagtagagatggggtttcaccatcttgaccaggctggccttgaactcctgacctcgtgatccacctgcctcggcctcccaaagtgctgggattacaggagtgagccactgtggccagccgaaaaatatgttttgattaatattatgtaaggtaaataggggaaacgttcacaaagatgattcatgctaaacaaataaaaccagagccacatccatcagcataacgtagtgcaataaaatgttatatatcaaagtacgcatctactaagtcctattcatcggagacagccacaggtgatagtgtatgggcagaggtgccaccaacctagcatgtcctgcatgggggcttttcccttagtcaataaaggccagtgactaggcggtagctacctcttgaagagatgggactagggttgcggggcgggctttcccacataatctcttgtgggatgtcagagatgatctgggtaaatcacgtgtttatgcgtgagttatttgccttggtcaggaaggctgcctttgaactgactagaatagaaaaatgacaggtgtaaacttgccctaagttacatttcaggttggtcttcataccaaagcttatggagaattgggatctaaactgttactgtggttgaatccctgactttctcttttttcctccttttttgaggaggaaaatcagagataacattttagaataaataatttattatagctgaattacttaatactggcaatgagagctttgtgatatatatattacattatataataaattacatatattattacatatattacttatatatacataatatataaactatatgcctattatatataatttaaaggagggaatgaatgtaggtgtagtagtatgtcatcttagaattttttgggcttttcatcatttttatgaggaagtcaattaacaacatcttgaaattgttaaacacattcagtgaacagaacttggcttcaactgtgaattttcaccacaagctctgcaacaaattgtagggatgctctaaggagagccacagctactctcacggtcagagccccctaagcacacacatacacaccaagctgattctgcctgtcattctcatgactatacggtttcccactgtaaatgtatattccttttatcacaactgagttgagtcatagccatcctttaaggcacagcgaatgtattacgcccaccgtaagttctgccaacattgtatctactccttcccgtgaatgcacagtcaattaacacaactgggtaagtatatctaacttaccaagggcagaacttagagcacagactgtatttgcaccatgacattagatactcggttatagtcatcttaactccaattctgcatatgaggaaaagagactcagaaaagctgagtggcttgaccgatattgtagagcttattcatggtgaagattccaggtggtcttgaagtgctcttaccccttatgaaatttcccagatgtgaggcagatgttgcagtgagctgagatcatgccactgcactccagcctgggagacagagtgagtctccatctcaaaaaaaaaaaaaaaaaattcccagatgtttgaggaggaagaagcatagcaagtgcttctccacctctgtttattttttctgtctgatccaggtctgggtggctagtggttgagaaaccacaggatagtggtttctcctgtcagtgaataggaatcttcattaggcaaaaaacaacacttgggcgaaaatgaaaaaaaacccaagtatgtgttgaatgcaaagagtatgtttacttgtagcaacattatagaatatattgtgtaatgcaaacatacacaatgccttctaagactgtgaaagcattttttattagtcagtgttctgtagaggcacagaactaataggctagatgtatatatgaagggagtttattaaggagtattgactcacacgatcacaaggtgaagtgccacagcaggccatctgcaagctgaggaacagggaagccaatccaagtcccaaaacctcagaagtaaggaagcctacagtacagccttcagtctgtggccaaaggcctgagagcccctggaaaatcactgatgtaacaagagtccaaaagctgaagaacttgggtctgatgttcgagggcaggaagtattcagcatgggagaaagatggagaaagctgatttgatggtgcccacccagatagagggtgggtctgcctctccagtccactgactcaaatggcaacaccctcacagacatacccaggaacaacatttgcatctttctttttttttttttaattatactttaagttctagggtacatgtgcacaatgtgcaggtttgttacatatgtattcatgtgctatattggtgcgctgcacccattaactcgtcatttacattaggtatatctcctaatgctatccctccccccttgccccaccccacaacaggcccgggcgtgtgatgttccccaccctgtgtccatgtgttctcattgttcagttcccacctatgagtgagaacatgtggtgtttggttttctgtccttgcaacagtttgctcagaatgatcgtttccagcttcatccatgtctctacaaaggacgtgaactcatcctttttttatggctgcatagtattccatggtgtatatgtgccacatttttttaatccagcctatcattgatggacatttgggttggttccaagtctttgctgttgtgaatagtgccgcaataaacatacgtgtgcatgtgtctttatagcagcatgatttataatcctttgggtatatacccagtaatgggatggcttggtcaaatggtatttctagttctagatccttgaggaatctccacactgtcttccacaatggttgaactagtttacagtcctaccaacagtgtaaaagtgttcctatttctccacatcctcttcagcacctgttgtttcctgactttttaccattctaactggtgtgagatggtatctcattgtggttttgatttgcatttctctgatggccagtgatgatgaggatattttcatgtgtctgttggctgcataaatgtcttcttttgagaagtgtctgttcatatcctttgcccactttttgatggggttgtttgatttttttcttggaaatttgtttgagttctttgtagattctggatattagccctttgtcagatgggtagattgtaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctaggtcctgaatggtattgcctaggttttcttctagggtttttatggttttaggtctaacatttaagtctttaatccatctcgaattaatttttgtataaggtgtaaggaagggatccagtttcagctttctacatatggccagccagttttcccagcaccatttattaaatagggaatcctttccccattgctggtttttgtcaggtttgtcaaagatcagatggttgtagatgtgtggtattatttctgagggctctgttctgttccattgatctatatctctgttttggtaccagtaccgtgctgttttggttactgtagccttgtcatttagtttgaagtcaggtagaatgatgcctccagctttgttcttttggcttaggattgtcttggcaatgcaggctcttttttggttccacatgaactttaaagtagtttttttccaattctgtgaagaaagtcattggtagcttaatggggatggcattgaatctacaaattaccttgggcagtatggccattttcacgatattgattcttcctatccatgagcatggaatgttcttccatttgtttgtgtcctcttttatttctttgagcagtggtttgtagttctctttgaagatgtccttcacatcacttgtacgttggattcctaggtattttattctctttgaagcaattgtgaatgggagttcactcatgatttggctctctgtttgtctgttattggtgtataggaatgcttgtgatttttgcacattgattttgtatcctgagacttcgctgaagttgcttatcagcttaaggagattttgggctgagatgatggggttttctaaatatacagtcatgtcatctgcaaacagggacaatttgacttcctcttttcctaattgaataccctttatttctttctcctgcctgattgccctggccagagcttccaacactatgttgaacaggagtggtgagagagggcatccctgtcttgtgccagttttcaaagggaatgcttccagtttttgcccattcagtatgatactggctgtgggtttgtcataaatagctcttattattttcagatatgttccatcaatacctagtttattgagagtttttagcatgaagggctgttgaattttgtcgaaggccttttctgcatctattgagataatcacatggtttttgtcattggttctgtttatatgctggattacgtttattgatttgcatatgttgaaccagccttgcatcccagggatgaagcccacttgatcatagtggataagctttttgaggtgctgttggatttggtttgccagtattttattgaggatttttgcattgatgttcatcagggatattggtctaaaattctctgtttttgttgtgtctctgcccggctttggtatcaggatgatgctggcctcataaaatgagttagggaggattccctctttttctcttgactggactagtttcagaaggaatggtaccagctcctctctatacctctggtagaattcagacgtgaattcgtctggtcctggactttttttggttggtaggctattaattattgcctcaatttctgaatctgttattggtctattcagggattcagcttcttcctggtttagtcttggggagggtgtatgtgtccaggaatttatccatttcttctagattttctagtttatttgcgtagaggtgtttatagtattctctgatggtagtttgtatttctgtgggatcggtgatgatatcccctttatcattttttattgtgtctatttgattcttctctcttttcttctttattagtcttgctagcggtctatcaattttgttgatcttttcaaaaaaccagctcctggattcattgatttttttaaggtttttttgtgtctctgtctccttcggttctgttctgatcttagttatttcttgccttctgctaggttttgaatgtgtttgctcttgcttctctagttcttttaattgtgatattagggtgtcaattttagatctttcctgctttctcttgtgggcatttagtgctacaaatttccctctacacactgctttaaatgtgtcccagagattctggtatgttgtgtctttgctctcattggtttcagggagcatctttatttctgccttcatttcattatgtacccagtagtcattcaggagcaggtcattcagtttccatgtagttgagcggtattgcgggtgttccttaatcctgagttctagtttgattgcactgaggtctgacagacagttttttgtgatttctgttcttttacatttgctgaggagtgctttacttccaactatgtggtcagttttggaataagtgtgatgtgtgctgagaagaatgtatattctgttgatttggggtggagagttctgtagatgtctattagatctgcttggtgcagaactgagttcaattcctggatatccctattaactttctgtctcatggatctgtctaatgttgacagtggggtgttaaagtctcccattattattgtgtgggagtctaagtctctttgtgggtctctaaggacttgctttatgaatctgggtgctcctgtattgggtgcatatatatttaggatagttagctcttcttgttgaattgatccctttgccattatgtaatggccttctttgtctcttttgatctttgttggtttaaagtgtgttttatcagagactaggattgcaaccactgctttgttttgttttccatttgcttggtagatcttcctccatccctttattttgagcctatgtgtgtctctgcacatgagatgggtctcctgaatacagcacactgatgggtcttgactctttatccaatttgccagtctgtgtcttttaattggagcatttagcccatttacatttaaggttaatattgttgtgtgtgaatttgatcctgtcattatcgtgttagctgcttatttggcttgttagttgatgcagtttctttctagcatcgatggtctttacaatttggcatgtttttgcagtggctggtactggttgttcctttccatgtttagggcttccttcgggagctcttttagggcaggcctggtggtgacaaaatctctcagcatttgcttgtctgtaaagaattttatttctccttcacttatgaagcttagtttggctggatgtgaaattctgggttgaaaattctcttctttaagaatgttgaatattggcccccactctcttctggcttgtagagtttctgccaagagaccagctgttagtctgatgggcttccctttgtgggtaacctgacctttctctctggcgcccttaacattttttccttcatttcaactttggtgaatctgacaattaggtgtcttggagttgctcttctcgaggagtatctttgtggcattccctctatttcctgaatttgaatgttggcctgccttgctaggttggggcagttctcctggataatatcctgcagagtgttttccaacttggttccattctccccgtcactttcaggtacaccaatcagacgtagatttggtcttttcatatagtcccatatttcttggaggctttgttcgtttatttttactcttttttctctaaacttctcttcttgcttcttttcattcatttgatcttcaatcacttataccctttcttccacttgatcgaattggctactgaagcttgtgcatgcatcacgtagttctcatgccatggttttcagctccatcaggttatttaaggtcttctctatgctgtttattctagttagccatttgtctaatcttttttcaaggtttttagcttctttgcgatgggttcgagcatcctcctttagctcggagaagtttgttattactgattgtctgaagccttcttctctcaactcgccaaagtcattctccgtccagctttgttccgttgctaccaaggagctgcattcctctggaggagaagaggcactctatttttagaatttttggcttttctgctctggtttctccccatctttgtggttttatctacctttggtctttgatgatggtgacatacagatggggttttggtgtggatgtcctttctgtttgttagttttccttctaacagtcaggaccctcagctgcaggtctgttggagtttgctgcaggtcactccagaccctgtttgcctgggtatcaccatcggaggctgcagaacagcaaatattgcagaacggcaaatgttcctgcctgatccttcttctggaagctttgtctcagaggggtacccggccgtatgaggtgtcagttggcctctactgggaggtgtctcccagttaggctactcgggggtcagggaccaacttaaggaggcagtctgtctgttctcagatctcaaactccatgctgggagaaccactactctcttcaaagctgtcagacagggacgtttaagtctgcagaggtttctgctgccttttgttcagctgtgccctgcccccagaggtggagtctacagaggcaggcaggcctccttgagctgcggtgggctccacccagtttgagcttcccggccactttgtttacctactcaagcctcagcaatggcaggcgcccctcccccagcctggctgccacctcgcagttcgatctcatactgctgtgctagcagcgagtgaggctccatgggcgtgggaccctccgagccaggcgtgggatgtaatctcctggtgtgccatttgctaagaccattggaaaatcgcagtattagggtgggagtgacctgattttccaggtgccatgcgtcacagcttcccttggctaggaaagggaattccctgaccccttgcacttcccgggtgaggcgatgccccgccctgcttcggctcatgctccatgggctgcatccactgtccgacaagccccagtgagatgaatctggtacctcagttggaaatgcagaaatcacccgtctctgtattgctcactctgggagctgtagactggaaccgttcctattcatccatcttggaacttccaacactttgcatctttcaatccaatcaagttgacgctcaatattaaccctcaccggaatgttatgtgttgaggcaataattaatagttatccttggttgtttcagaaaatgtcatgattaatagttatagtaaagggaggaattgtaacttgacaaaatagtttggtctagtgtccagtttacagggcattgagatggttttctggtttcccttgttttgccctcagtacacaatgctcagtattcagaaaggctgatgtctattttctccacaagtgctaataaaaatttttaaaatgtggtgtgcattatttatatagttgttttattcataaaagatttaaaatctaggtaagctaactcaaaatgcgactttgtactctgcgatttttaggcctagaagtggtcatgactgtgaacattatgttggcttggaacctttaaaagttcatttggtctgtactgcaggtggcatttggatgaaagcacaggtggtacatacagtacttcgatgactccatctgtttggtgtggcatgtttaagaatgacttctgttaaagggatttgactcgaaatgcaagccctctttcctggcgtgttggtcatttttgtgacattagtggtggaaaagaagctcaaaatggtctctggagtggagtaacagcagggcttacttttgaaattgtctttcaaatgcccttttgggcatggggtcaccgtgtttaaagcttttgaaagactccccacagaaatgaatcaagtgttgcattttcagtgtggtgtccaattttgtgatcagaggtactgtagaggaaagtcgggtgttttcttaaattcctttttctttttggaaaagtcatttacttattacgtttaatataaagaatgttttaaaaagagagagagagagagagaaaacacctggttgttagacaagctggctccatgccaaagtgaaatgaaacatacagcaatcaaatgtcattagcatccaggtccggcattgacccattctttccttgctgaaattgtgtgtgtgtgtgtgtgtgtgtgtgtgtgtgtgtgtgtgtgtgtgtgtgaattcagagaagaggcaaattaatgtggcttagagtgttgaaaaatggacttaagaaagaaaatggggataggaatggctaaaatttggataggtggaaagatgggataaaaacactccaggtgaggaaacaaacttttgttaacttgactttgaatattttggggactatgcatggaatgtatgtctgaggcttttaaattgagaaagcatgcttcgttagacaattatctcttacatgtatgcacagccttatgtgacattatttatataactttagaatatatgtgtgtgtatgtatatgtatatgtgtgtgtatgtatatatatatacaaatacatatacatattggggaaagaaagaattaattagactttaaattcttccctgcttttttccatgacaatattgattattttataatcaatatttagtgataactaaatatatttagtgataactaaataaatttagtgataactaaaaaatgaaataacatagtttagaaaacctacgatgagctcccaaaccttatttctctcgtttatttatttgaaagacatttttcaaaatctgcccctttattaaattgctgatgttatacagacagaaaaaaccagtagtcgggggtagatctgcaaaataaggacgtcaactatgggctgtggaaaccggctcttccaaatctgtgctgcccctaccattggctagttgtcccttcctggggaaattttttgaccccttgagggttgtttcctcgtctacaagatgcgaaaacaacatccacctgaagattgaatgagagcactacctagtgagttgcctaatgaacaactcatgatagacataataaatgccagttgcattctattttcctgtacctcagaaaaatatcaaggcttccctacctaaacattcattttccactgcttcatatctctattagctagtataacttcattctctctttccagctttcatcagcacaatttcattataatattaatttctcatttataaccccgtgttattgtttttattctccttacaagttgtttttgcttcaatgcctctttgtactatcatgaaatatatttcctccattgctgagtgatctcttcaattattctctgttacatgtaccttcctttgatttatctttttacgacctccacaaggcattttttttttctttaggtttgtaatggctttgcttgattctgaaacggtcatggcctcgagggcaaccagagtcttgttcttactgcctgctctatggcttctctagtaaaacctcagctgtgaaagcaagtatctttcacttctcctatgctcaactaacttcagtctttgtgtcctgagatcagacaatctcacatccacgtaaccccaggtcctaccactgcactgggcataaaccaacacatttgcctgctagtcacagtagagaaaaatctgtgaaacctttgtcatttggcaggcacaaagtcattcttgagagaaaaacccagtttgcattaatcaaacagctttcccttcccatttctacctttctttgaggcattgttgaatacacacacacacacacacacacacacacacacacacacacacatatatatgtacgtatgtatgtatttttgaaagccattttatttgtaaaattctgtgctatagcaccgactctttataaagagtcatacccatgttaaaatgtcttcttgatatcattaatatccttcttcttgatatttattattcatactttgatatggtttggctgtgtccccatccaaatctcatcttgagattgggtgggatggagctggtgagagataattgaatcctgggggcagtttcccccatactgttctcgtggtagtgaataagtctcgtgagatctgatggtttgataaggggaaacccctttcgcttggctctcatgctctcatctgccaccatgtaagatgtgcctttcaccttccgccctgattgtgaggcctccccagccacgtggaactgtgagtctattaaacctctttttctttataaattatccagtctcaggtatgtctttatcagcaccatgagaacagactaatacacacttgtttgtaggattgaaatctacatgataaataaggtgatttttaaaagatgagcagtttgctgtgcttgttgctgtaagggatcttcagggagtccctgaatctgagaattggaagtaaggttggaagatcatcctgtgcctccctccatccaacacagtaatcttcttaatgtctcagtcagaggctgttcatcactgatgagcctgccactgatgagcagtcctggcatcatcacttcctctgcaaaggacactgtgatctgaggccccactccatgtcaggccactccttagacaaaagctctgtcttctgatgagcttctgctcccttttgcaccatgataatgactttatttttagtaaggatagactcactcaattgatgttttctgctgttggggaaaaattgttttattaagaagcattttccaacaagtaagttgatgttaagtaggcttggatatatttggaattcacgaatgtgttttctccattagttccctgaaaaccagaaaacttgacgtttgttttaatgcaaagatgaactctggttttgtccaacagagctagtgctggcctttgctttcaagccctgtaatctgcatcaaccctcaaattcagtgattcaaaagtgagtgactcacttcgtctttgaaaagaccgtgaatatttctagatttatgagcaattcaaaacagccaggcttttagaagggatttcccaactcattttgttgaaaggtaggactaagacttctctagaaaagaaaccgatctactaagtactaaagagtatttatgagccacggtagactttatttttcagaatcatactacaagtgtaggaatacccaaaccctgccagggttttgaaaattacattaatttatgcccaggtataacccccccatcataaatcctgaaaaatgtgcaggaagactgtgacaggccattctaagagcgtaacaagggctacatctttcagcaccagactgatgtttatgtatgtgactacttggaagatgttttacttaatgtaccatgttcttaaattggctctattttaaatataatcgtaagagttacactttatgtttgtatgccaggtagtttataaatgatgattttaaccactccccgtttcacaccaccccagccttatgaggtaagttttattcttcctgctttacctctagggaaactaaaactcagaaactgcaagaccttgccaaggttacgtccaataagtagatcactaccttgggctgttggctgccatactcacattcttcccctgcattctttcccttgtgccttcagcctatctttggaaaggaatttctgatgttaaggcacctatttgtttggctttggtgtagttttgttttttggtgttgtgtttatctgtgcatagagtaacatatggaggtctgggaatccttgtttatcttccaaaattatagttctgtgaaccacaaaatttcacgtaaatcctattaaagctgatgtgaaatagaactagagagatgataggaaaaggagagtgatgaatttattaaagcttactcccttttaatagacaccatcaggctcatgtgttaggttgctagttaattttgtgaggattacctttccaaatgacttcaataatttccactgctctattcaaaaccttattttacatttgaaggcctaataaagaagaaactatgatcctttccttgtgttacttgaaagtttataggaaagcataatcccagatgggatggttctatctgtcccacaacatctgtataagaccgacgctggcatcaaacgcatttcatccacacacgcttcctaaatcagcatcagcatttatgagcaactcttcaagtctcttgttcacatgcatgtcattttaatgcagtttatttgaaacatccggtagaatgttccttcttacccgtttccctaaagcatgagaagaattggcaagtgatgagtcatttctctgtcaaacataggattgatgcatttagaatgtggaagacacagtcatgaccagtcacaccaggccatgggccagaaacccatcaaacaggaggcagagctggaagcacaattttattttacccatttaaaattatgtgtgcattgacaccaaccttcatgcacgtgacccataacccagcaagaattatttcattcatagaaagtcaccaaggcctacttagtcctcacagactacttctattggattctgggtttagctttcccccagcttcacagtggtaatgtttcacacacacacacacacacacacacacacacacacacagtggcagcaggaaaccagtctacccattgccttgctgtgtataccaccctggactgagacttgaacccagtccgagcccagctctgacactacccagccatgtgacctgggctcagcttcctttcctgtgaagggtgagagtctcagtgccctcctgacccctggggttgatgggaggggctgctgagatgatgtgtgacaacattaaagttctgcacgcatgtaagctcatttcagatgtgccccaatccctttggcatctttgtgaggacttccatttgccttttgaatgagactacctcttctgattttggtttcaagtcgtaaacacatctttaacttagactcaccatccagcagtcccctgggtatgcagatgccctgcactcttcccagtgccacaccctgctgcaggtgcatggtgccctggccaggtgcgcctgcccttctcttgctgtcagcgtccctcttttcttccagatacagctggggagactccctttacatggagatgtgcctgactccactacaggatgcatttactccggtcttctcttggttactcacagtggcctgttccctcctgacctggggcccagcacaggctgcccaccatctcctgggatgctctcaccctctttcctgctcttcctggagttcagggcctctgttctcccttctcacatacatcactctgtatttactctttgaaagactcatcacactcataaatcaatacttattttatcatcctttgtttaatgtctgtcacctctttttctgcagacttctgagggacagtgctatggactcaatggctgtgtccctctaaaatctatatattgaagccctaacccccagtgtgatgatatttggaggtggggcctttgggaggtgattaggtttgagggtagggctgccatgatgggattgggggccttataaggacgaaggagacagccaagcattctctccctctctctctctctctctctctctctctccctctctccctctctctctctgtccttctctctctctgtccccctctctttctgtcatgtgaggacacaggcaggatgagggctctcactggaacttgagcatgccagcaacctgaacttagacttcctgcctccagaactgtgagaaataaatgtttgctacttaggccacctagtcggtggcaatttgttacagcagtccaaactaagactgtatccccaggatccagcacaatgcccagcatagagattttcagtaaatcttagatgggtgcagtagtgactgtcctgcctctgatttctacccgtcacctgtcacactccctttatactttcccagacagctagcatttcactcacattgctgcacaggcctggtctcctatgagtttgagttatttactgaaattgatattcacaagtattacttcttttcaacaaacatgctaaagcatgaacttctacattagtgtagtaaccttggtaggctgtaaactccccacagccacatgcaggacacttggagtattgcttgtaggaattgacttcaaggcttgaagcttttaagaaaagttctctcaatgaggatatatgtgtgtccttagagaaagaatttcattacataagagaaacccactcactccaattcaggtttggagagtaagctaggtaagcaagcttgaaaattgtgaccacttagggtcaaaaatggcaggtagtaaggttgtcatgctgtggagtgagcaagcacctggggctgttcttaaccttcactattaaccagccgtgtgtcttagctgaattacttaacctctcattgctttgattatttcctctgtaagttgaggggtgtggtgtactatatctatggttatttttctgttctgaaatcgtgtatgtggctgtgtgtgtgcatgcacgtgcatgtcgcgggtgaaatgtactgactcgtaacaaagcttgagagaaaatcaggcttagtacaatggcagtttggttggattaaagccccctttcaaagacaacactcttatctgttgatgttctatatgtttgttaagtaaagcaatacatcaaaacttttcaaatcatggaatatttaaaaaatgataatattttgatggtacactgaagtaaactggtgagatgatggtgtctatatgaggcttgatgaaaactttcaccgcatatttttatgtaattattcataaaacaaaatacaaaatattagggaagatattaaattttgaagttgtgggaaacctccaaataaaaaatgtatcagtttataattgagagtgatgacctctcttcggatttccaacttgaaatgcttcattcagcagtcttcagagagtcaccacttacaagaaattttgctcatagaaagaagtgacaaaaaataaaaaatcattttcacaactattaacttcctattgctgctgtaacaaattactataaatgtagtggcttaaaataacacaaaataattatcttacagttcatctgaactgggttttaatgggctcaaattaagatgtcagtagggctgtgttccttctggaggctctaggcaagaatttgttttcttgccttttccagctcctagaagctgtctgcactccctgactcgtggccccttcctccatctgcaaaacacatcctccagcgtcacatctctttctcccactctgactgtcttgcctggctctgacaaggacactgtgattacattgattcgtcccaagtaatctaggatcttccagcatcctggaagctgcctgcattctttgactcgtggtctcttttgccacgtaaagtaacggactcacaggttttggagatgaggacgaggacaactttgggggaatcattgttcagcttatcgcaaccacccttcaaaaattcccatcaactgaaattatgtttaaagaatcaagcagagtttccttttctgttgctgacaaatgtgatgctgaaatttcttgcaataatgtgaatggatttctaatccaagatcactttttatatcaaatatttcaaagtaatggtgactctgcagaatgggcacacccttgcagagcagccatcttgtagctaaccgggaccaggaaaaggacacgtcagctagaagaagacaggaggtggccagaggctctgagtggctgctgagatgggggcccccatctcacttgtccctctccaccccctgttatcaccctgctgagcactgtgctggctccttgggttcccaggtgatgaggctcttcagcagccctttgtcctcgatgggcgagggacactctgcctgaagtacacatctagctggggggtgctggatgttgctcccagagctgagaccccactttgcttaggccacccctgatctagacagatcagcctcaaagggatgaagatctcacaagcctgccgtggctcccaggtgggaatctaagcaaggcagggagtgtgtgggtatggaacagggcttcagagtcaggctactggtgtcaaacccaggacctcctgatgattagctgcctgacatggtgcaggtcacctcaccttcctgagcagcttctattgtaaactggggttcttgcctcctaggttgctgtagaatgaggtccggagagtgctttgcacagtgctgagaacagcatcaatgctgatcactgatgatgagaatgaggatgctggtgttttcagccttgtcttgttttctttctcccagggtaaattcttagtcatcttcaccttacctgctctgtacttatcaggggtgcttcgtgcaataagcacatgatggaaagtgtcaatcgttgtggcagccacatgacatctaggtcctgatagaagaggccctacccggctgctggttagaggcttgccatgtgcagggctggggctgctgcgttagcaggtgtgttagcattccacaggtgagatcagttgactgtagcaattacttcaaatggaatgaaacagaagccttaagtgattccatctctctttgatactccatttctacctgcataagatcatataacattatgatgaattcctgagctaatttggaaattatacatatttatatttcggttgttattatagcagtagtgcactgatcatttgattccgaaagtaatttccttctacaaatttacccttgacattctaaaatgtatattcagatttaatggaaaaaaagatgtgttataaaacaaggcagtgtttttgagcctgaaatagtaagggaagagcattaatttgcttttaagtttaattagaaatggaatgactttctaaatcataattgatagcattttaattaggatattatttttcagtgtctggaatgctcatttttcacatttgagatcaagaaagtacttttcgggatatgtttgcctttgttaaccggttgggtgagccttccagatttttttaagcagatatttttgtaaaaatatttaaatattgattgttaataaagccatttgttttaattcagtggaaaataattttattaaggcttaaataaagctgtgccagcaattttccttcatcacagtgttttggggctgcattaattataagcaatggagctgctggagacatttacacagcacacaaattcctcattgttagcaacggctggtgtgtgctgacagctacctcttagagaaatgcaacccatggtttaacggtggaaagtgtggcattagcataatttcttggcagggacaaagctggggttgcagcattgtcttcaacagtgactccttcgttaacagtgtcttatcaaggcctggactcccggggcgacatgccgccacatgatcgtgtcataggtaaccggaatcctgtgggaaatggctgcttctgaataaaaggggaaggatttaaattgcttatgattatgatttgaaaaggacctgtggaagaaagattctgaaaggaattgcttgtgtttgatcaaaactgacacagtgtcacggcagcttctttgacattgacagtaatgcatgttatagtttccataaggtgatctagaattaaaacattgtattcttcagagaccaattcagactaaaatagatctgctaatgcaaggcttcagagtcaagaataaattatagcccctgaggttctggaagttcatttgcatattgttaagtgtagttcagataattggaaaaaattttttgtaaattttagaagatatatcaagacagtattggaaagtaatagaaaatatcaaataattattttatattaatatttgtcctttatacaataaactattccctgacctcaggattccttttgattttgtgaataataaatagaattataaaactaaatataactggctgggtgcggtggctcacgcctgtaatcccagcattttgggagactgaagtgggcggatcacctgaggtcagggagttcaagaccagcctggccaacatagtgaaaccccatctctactaaaaatacaaaaattagctggacgtggtggcacgcatctgtagtcccagatactcgggaggccgaggcaggagaattgcttgaacctgggaggcggagtttgcagtcagccgagatcgcaccactgcgctcccgcttcggcgacacagcaagactccgcctcaaaaaaacaaacaaacaaggaagctaaatatgactggtaaaatttggtaatataagatgaggaagtagcgaccatttattgagcatttactgtatcctggacaggcagtgtgataagtgctgcacacatttaatacatctaatttacatttgattttaaatttaaatttacattaaatatatgtattaagctgttcttgcattgctataaagaaatactggtgactaggtaatttataaagaaaggaggtttaattggttcgtggttctgtaggctgtacagaaagtatggtgctggcatctgcttctgaggaggcctcaggaagcttacatatgcatggcagaaggcgaagggagagcaggggtctcacaggactagacaggaatgggagcaagagagagagtgggggaagtgccacacacttttaaacaatcagatcccacaagaactcactaccacaaggacagcaccaagccaggagggatccacccccatgacgcaaacacctcccaccaggccccacctccaacaccgaggattatatctcaacatgagacttggaggggacatccaaactatatcaatatatttaattatcttaactctgtgacttactgtcctcaagttgtaaatggggccattaaacatcaagaaaattaagtgatatttccaaagtcactcggctagtagagggcaggtctgagatttgaacccaggtcatttgattctggagcctgcaggattgactctacaacccctgggccatgttctttgtcactactcagttctactgaatccattaagtgattcccctgaggctccttttcaccatccctcttgcataagcgtgattgtgtctgattgtggctatttaaaatacacagcaccctgatcattcatttcatagtcctttctcttgtcagcaattctaccaatttcttctttattcgttttgttgtttttgttgttgttgttctctattggattcacgtgggcatggcattgggctcctctgtgctgaccacgtttccttatctcctctccatcccagtcgtacagcctggaaagagggggtgcgtttcagggatgagaccagagggtatctttgcttcagattttccagagccttcttacttgcggatcctgtgggcccatgaagtgtgtgggggatcatgtatgagtgtggggggtcatatatgagttggggggggtcatgtatgagtgcggggatcatgtatgagtgtggggtttgtgtatgagtggggggttatgtattattgtgggggtcgtgtatgagtaggggggtcatgtttgagtggggggttgtgtatgagtgcggggattgtgtataagtgggggcatcatgtatgagtgtgggggtcgtgtatgagtgcggggggtcatgtgtgggtggggggatcgtgtgtgggtgcggggggtcgtgtgtgggtgcggggggtcgtgtttgagtgcggggagttgtgtatgagtgcggggggtcgtgtatgagtgtgggtatcgtgtacaagtgtggggggtcatgtatgagtgcagagatcgtgtatgagtgggggggtcgtgtatgagtgcgggggtcgtgtatgagtgcgggggtcgtgtatgagtgcgggggatcgcgtatgagtggggggatcgtgtatgagtgtggggggtcatgtacgagtgctggggtcgtgtgtgggtgggggggttgtgtgtgggggcaggggatcgtgtttgagtgcaggggatcgtgtatgagtgcaggggtcgtgtatgagtgcgaggggtcgtgtatgagtgggtcgtgtatgagtgtgaggggtcgtgtatgagtgtggggtcgtgtatgagtgcgaggggtcatgtatgagtgcagggggtcatgtatgagtgtgaggggtcgtgtatgagtggggtggtcgtgtatgagtgcagggggtcgtgtatgagtgtgaggggtcatgaatgagtgcggggttgggtatgagtgtgaggggtcatgtgtgagtgtggggtcatgtatgagtgcgaggggtcgtgtacgagtgcggggatcatgtacgagtgtggggatcgtgtatgagtttggggggtcatgtacgagtgcggagattgtgtatgagtgggggggtcgtgtatgagtgcgggggtcgtgtatgagtggggggatcgtgtacgagtgtggggagtcatgtacgagtgtaggggtcatgtacgagtgcggagattgtgtatgagtggggggttcgtgtatgagtgcgggtatcgtgtatgagtgcgggggattgtgtacgagtgaggagatcatgtacgagtgtgggggatcatgtaagagtgcgggggtcgtgtgtgagtgcgggggattgtgtacgagtgaggagatcatgtacgagtgtgagggatcatgtaagagtgcgggggtcgtgtatgagtgcggagatcgtgtatgagtgcggagatcgtgtatgagtacgggggatcatgtatgagtggggggggtcatgtatgagtgcggggatcgtgtatgagtgggggggatcgtgtatgagtgtggggatcgtgtacgagtgcggggggtcatgtacgagtgcggagattgtgtatgagtgggggggtcgtgtatgagtgtgggggatcgtgtatgagtggggtgtcgtgtatgagtgtgggtatcgtgtatgagtacagggattgtgtatgagtgcggggatcgtgtatgagtgcggggggtcatgtatgagtgtgggggatcgtgtatgagtaggggggtcgtgtatgagtgcgggggtcgtgtattagtgtgggtgtcgtgtatgagtgtggagatcgtgtatgagtgcggggggtcgtgtataagtgcgggggtcgtgtatgagtgcgggggtcgtgtgtgagtgcggaggtcgtgtatgagtgcaggggatcatgtatgagtcgggggttcaggtatgagtggtggggtcaggtatgagtgtggggatcaggtatgagtgtggagattgtgtatgaatgtggggattatgtatgagtatggggattatgtgtgagtgtggggatcatgtatgagtgtctccaggactgacagaatatcccctggtggtttaagtcaagtggggcccagagaaactctggacagatagagggtgatgctcttagttcctctttttacccataaaacaagaggttcaacagaacaatacattgtttgcaggaacaatatgttctgaaattataagctctgaaatttattcttgaaaagatctttagggccccagaaaggtttaggctcccatatggtttaggggataagctctatgcccggaggtgccctgtgccagcccactcccaggcaacctgtgagctaggcctggccctttacaatttccttgcacccccttggagcaggtgctgaccagaacagcttgatcaccttcccctgtcactgggagttctgtgatcatccacgctccatcagcattctcttttgacaagaagcttgttttgtataatctcccaccggaaatgatggaagtggcctgagatgaagatgagcctcggtaaaatctgttatgttttacttctggaaagtgggattcagcctggattatgaagtacatgaatttgtgttttgcagctcagtggctctcaaccttggctagacagtagaattatgtgaggaactttaaaaataccaaataccatggacttgtcccagaataattaaaatcagaatcgctaaggctgggccctgacagcaacatttcttaaaagcaggcgagtagaatgtgcagagagggctaaaccttgagtgagaagatggtgaggcagtgaaggcggctctaatactgctactgctacttgtagtagtgcagctagtactgctagtgaacagttactaggtgcctatcatgtgctggtgttgttctgagcatttttcatagaacaaaattattctcatgcattccttacaataacctatcagcttatttcattttcactgatgtgtacttggaaaaccttgaggaggtacagcagtgtattcagagtgaaatcatgtttcatggggcattctctactacaaaggtgaagtttaacctgtttgtctaggtgcaagatatctgacttttcttttttcttttttttttctttttttttttttttgacaaggtcttgctctgttgcccaggctggaggctggtgtgcagtggcacgatctcagctcactgtgatgtctccctcctggattcaagtaattctcccacctcagctgcctgagtagctgggattacaggtacccaccaccaggctcagctaatttttgtatttttagtggagatggggtttcaccatgttggccaggctagtgtcaaactcctgacctcaggtgatccacccacctcagcttctcaaagtgctgggattataggcatgagccacagcacccagccagatctctgacttttcatatccattgtcttgtcatagaagacttaggtggtcttggacagcaaacatgccttggttctgccagctgagacccaggtgtagtacagtaaacagtgatcttcagattctgagttacaaatcctggcctcctaattcctagaatcagacttcacatgagtttcttgaaatgcatctttgctaaaaatattttataaaactgccaaagtaaagagatcttgataacatactgccatgcagagactcaggtagtacatacaaagtcctccaagtgctccaactaactcctgtgtacttggatgtaacgcctttgtacctttccatgtgatccctcatgttacatttacaacctccctgggagggctccatcatgaagggctagatgggtaaggtgaaatttagattgtgttgtaatttagctggttgcaaaatctgagatcacttgccttctagtcaggtcatttaaaaaacatattaggcagggtgtggtggctcacacctataatcctagcattttgggaggccaaggtgggtggatcacgagatcaggagatcgggaccatcctggctaacatggtgaaaccccatctctactaaaaatacaaaaagttagctgggtgtggtggtgggcgcctgtaatcccagctactcaggaggctgaggcaggagaatggtgtgaacccaggaggcggagcttgcagtaagccgagatcacaccactgcactccagcctgggtgacagaaccagactccgtctaaaaaaaaaaaaaaaaattaaaccgttagtgtagtgttgttggttttggtgtattcttctatcaatgtatagagtatgtaaccaccaccatctgcaaggtatagagcagcagcatggagttcccagggatggactagggcgtcaaagccaccttttgtctcctccgcttacctgaggggcctggttaagcttaagtttctctaagaggttaagctctatggccagccctcactagtgatttcttggcagttaggtgacaaactcagaaagtttggctgatgataggaatgggaatgtgtgaagtttttcccgcttgacaagacactgtaattcatgatccccatcagagggacttgagccatgaaaacaaggctggaatcaaaactctaaaggtataggttacttttcagaaaaaaatgaactgatttacccatagaggcctctgaaaataagaatgtcctgcctggcacagtgctgccgtctggatctgagcctggggtgccctgggtgggtatagacaggacatgtggaggagggtgtcaggagcgtgcttgtcctctgtcctggtccagacccttgccagcccacttccaccttttcttcccttccccgaatttagatcttgagctccatgctcaaaggcctggagagtttggggctgcccttccatccccacaacttaacacccaccatcgactccttgacaaggcagagtagccagaagctcctttgatgcctgggagcctctccaagaaagctcgttttgataacagcactcatcctttgatctccacagggagcaagttaccaacttcattttttaaaattctgacagttttgttgactttgcactctgatgaaagcgtaaaatcctaggatgaaaagctctacctacatatcaaataataaaatagttataccctagaagaagagaaactcactgtctcctgctaaagaaataccttctgtctatgcaacttttctttccccctttctatacctctcttataagggcaaagcatttatagcctctgagttctaagaaaccatgggagcacggtgatctgctggtgagataaccgagataacagggcccatggtccaggtgccaacaccgaggacccttgttcctttatgtgcacagaaagaagcattaaagagagttgtctcatttctggttgggcgcagtggctcacacctgcaatcctagcactttgggagtccaaggcgggtggatcacctgaggtcaggagtttgagaccagcctggccaacatggtgaaaccccatcactactaaaaatacaaaaattagctgggcatgttggcgggtgcctgtaatcccagctactcgggaggctgaggcaggagaattgcttgaacctggaaggcagaggctgcagtgagccgagattgcgccgttgcactccagcccgggcaacaagagcaaaactccatctcaaaaaaaaaaaaaaaaaaaaaagagttgtctcatttctgtgatgtgacatctgattatgaaagtcttctacagtgaaggaatgggggaggaggaaggtagaaggagggaaaagaaagaaagaaggaaggggaaagataagaaaatgacgaattatattagaatatttttgcattttatggagcaggaggtgtcaacagtagtcagcctgtatgggtttgaattccgctgtttgtttactggagatgtgggtaaaatgcttgactaatattgctttgaggggcgcttgtgaggattagataaaatgatctttacaaagtgcctgccaagtagtaaacactcaataaaggttgttatacaatccagtggcaaaaaataggattttcatttcttatttggtttctagatccttctacagaataggaggtgctctgtaaatactgattgaatatgtagatgcgagaatgcctaatgaggaggtagagaactagtgcggcccacattgcccacatctcttcttaccatgctgaggaacttttgtcatgcgtatccgcgcatctcaattttgaggtaatgcttaactctaccagggaaagaatttagtgtagacataactgttaagacagctacaaagccagtgtccttaaaacaaaaagtcattgaatagaaaagagatagaattgaccattttgctgtgatacactgttctcttattttagtatttctcacttagaactaacaaaggttttaactgttgagtcaaaggtatgccataggacttagaccaataccaggtggaaggtagtgagaaggattgtctagaaggaagtgtgagatgccgttagacatccaagctgaggtgctaaggagttagtaggtacccgagcttggagtttgaggaagcaatcaggcatttaaatcattctttttaggagtttttaggaacttcagttcttatggaaacattgagtattctacacatccatgtaaaagcttaacagactggacttcctgtttccactgaggttgaatagaaatgacagtaacaacagtcacaatatttaacttttatcaagggcttacttggtgcttaatcctgacttgggtgctctgtatgcattattccacttaatcccagaccatgtctatgacctggataccatcattctcttcatttacacaaaaagagatagatacggagaaattaagaaaatgacccagtatcatacagatagctaagtcatggcattgagttataaggggataaattatgagatggacttctgcacaatgtgtgtcctctaaaataggtcttttcccccaaactccatgattagtgcttctgttcacttattaaaaacactgggccaggcgcagtggctcacgcctgtaatcccagcactttgggagcccgaggcgggcagatcacttgaggtcaggagttcaagaccagcctggccaacatggagaaaccctgtctctactaaaaatacaaaaaattaaccaggtgtggtggtgcatgcctgtaatcccagctgctcgggaggctgaggcaggagaatcgcttgaacccgggagacggaggttgcagtgagccaagattgcaccactgcactccagcctgggcaacaaagtgagacaccgtctcaaaaaaaaaaaaaaaaaattgcagaccctttggctaaggagcaaactgggctaatgtactagtaatagttccttcttacaagccattgctaagattttggtataaagagttagttaatgtggtatttcgttcattaagtgaatactgagtacctgctattttccaggctctgttctaggaactgaagcaatgaacaggtcacacaagtccctgttctcataaagcttgtacactagctgaaagagaaagacggtaaacaagtaaatgagtgtgctattttagacagggtattcagagtgggcatctataaagaagttccatttgaatagagactgaatgaagagggtggggaagagcttttctggaagaggatagagccagttcaaaaggcccctcattgacaagaggctggagtgctctgaaccacagagaaggctgtggtggctagtggtgcatggagggggaggtggggcctgggtgatgcagggccttacagaccatggcgaggagctgactcttttgtgtgtagagaaattgagtttaagcagagggctaccatgatctagtagataaggctgaacgatctctctggttgctatatgagtaggagaggaaattggtgatagagacacaaggcatctctcatatggcccagagggactggtgagaagtggtcagatttgagttatattttgaaagccaagccaataggacttgtctttgggttggtacctatagcataggggaaaaacatggatcaagaatgactcttgggctttggcctgaaaaatgggacacgtttggaggaagggatatattgtataacccaataaggaagacagtggaggcagaaatttgcaggatggaattggagcaaatagggttctgttttggacaggggaagtgtgagatgcctttagacatccaagctgaggtgccaaggagttagtaggtacccgagcctggagtttgaggtaggaatcaggcatttaaatcgttcttttttaggagtttttaggaacttcagttcttatggaaaatttagtattttagaaatatttagttgttgaggctgtcttcgatccttgagattgattcctggagaacatgctggtgtgtgctgggatttctcacgcttcccctggggaaggcatattcccatgctgagcagatgggagctccaggcagccgcaccagctgcacggtggtagaatatttctaaatagttctctaggcacaggcagctatttttctgaattctttgactcatataacctctttactaaatccaacatagatcttacatcctattcatgcacgctctcagtggagttcagaagtacattaattaaggtctaacaaattgttcatcatgttcacatttaaaagggtcctaaaatagcccaatcatgggcatgctgggtgtttgtgtttaagtgtcttatacactaaaactggaccctgatgttcctttactatatacaaatggccactgtgaacaccaagtgggctataaatcagaagatgacaaagaaaaggggaaggatgatgactcagtatggaaaaacctataagccagaacccgcttatttattatgtttggatacatttccccagttcaactgtccctggcttaagccctgcttcccccttcttagtccagtttcttaagtcatttttgctctctgctgtcaaaagcacctttcatccactcagactaagacactgaccttatcccccaatcatctactgttctctagaggtattcttgcagttccgttccatgattttctacatttcattccattagcttgtttggtcatttttacttttctggtgagatgattttccctagactcacaagagttacccctcttggataggcgccttcgattatactgattgcatctttggctccccaggtgatcagatgtctccagatggtaatgtttacagtgcctgcctcacacagaagcctgagatggcaggaaggactctaggtaggcttttcagatgggtagatgcctgaacatgctctggaaaaaccagtcttctctcctctctgcagtttaccagctgtgtgactgtgcataggttactgagtttctccaggcctctgttctctcctctgttaaaaggggacacttctaatccatctctggtatttgcattaaatagataaatacctgtaaagcacttagcagagtagctgctactgaaaggaagtcagtaaactttaattcccttccaaatccctctgagtcttttattcatcaggaaacaatagccgtgcactctgaatacacacatgccagtaaatggctattagtgaagacaaatcaagctccggaagcaagctagcctgaagagagaagagaaacagacaattttaagacaaattggagaaagagagtatggggttcaggaccggcagcatcagtatctcttgggaactggttagaaatgcaggttctcagactggggctgggcagtcttgtttcaacaagccctgcgggtaattctgaagtacaataacatttgagtaccaatggtctaagctaaactcagcagataatgggtgagaataatggtgcgtgttactgtgtgtgttatgtatgtttgtgtgcatacataaccatgtatgtagaatgtttgtaacagctgaaactattaatcaaacatagtaatatcagcaaaatccagtcaaaccagtgattaattccccatttttctttggtactgttgtctgagcagaaatactgtataactagaatgcttatcttcaataactttgcactaaattcatttgggatttaaaaaacggattcatcaactttttcctttattttctaggaaattccacttacttggatgaccatggaccacctcctagtaaggtaagatctttgcttgtgatataagtcccctttttcttttatcttacttacagcctccaacaagcagaacagatctctcctggacacgaatcattcacaagaaacagtagatgacatatgtgaaattgatgtttaacttctaacaaggaggaagcagaaaagcatgatgatagcccagatgacagggagaaggagccattgttgaatcagtggctgttgctgcccaggcattggagcctgagactgacttcagacctctggcagcttctcctgtttgcacctcattttcatttgccttggcatcgatgctggcccacagtgtgatagccacacccggcctccccatgccttcgggctttggggctagactcacatctgtcctgttctctccagcctaactgggttgggatactccacttgaggccctgccaataccacctcaaggctgccctggcctggcctgtgagtccacttttgtttttcctgtaagcagttttgtctgacttaaggggcagaataatcctttagtatagtttccctaacactgtttactttcttgagctcaatgaaaaccgaatgctaatctactgaaaagtgagcaaactagaacaaattgatcattgtatataagaaaatacatgcaatgcaattaccctttattctaaccgtatgtcccttgtacttttttgacatcattttttttccttctaggaaatgatggggattgttgatcagtacttgggaaggggttgtgcttggcaaaataagaagttggcaaccctctatctgtcacttcaagaatgttctttctggcctgtgaaatcttaaagtgtagatacaagcactctagctctccctgtacttggttgttttcttagtctttgaccacttaaggtgatgcctacaaaatgcagttgtaaatacacggtgagaagataatgaacccccaaccttagaggctttggggaaatttactcctgtattagtccattcctgcattgctataaagaaatacccgagactgggtaatttaaaaaattccacaggctgtataggaagcatgatagaggcatctactcagcttctggggaggcttcaggaaactttcaatcatggtggaaggcagagaggaagcaggcgcatcttacgtggccagagcaggaacaagagggattgggggaggtaccacacacttttaaacaaccagatctcacaggaactcactgtcgccatgacagcaccaagggggatagtgctaaaccctgaaaatccaccctcatgatccagtcacctcccaccaggccactccgacactggggatgacaattagacatgagatttgggtggggacacagatccaaacaaatcagccccaaagtatgtttagaccacccccacattcatgagcatgaactttggaagaagatatttctggattcaacactgacgctgccactttctagctgtgtgacagtggatgaattacttaatattttgagcctcagtttctcatgtgcagggtgggactaaaaataccgcttacagcacaggatgcctaaaatgattgaatgagctgatgtatgatgaacacttgacactgacatgcgataaacattaaatcaagggtggctgctgttaactgtactgcagtaacattaaaattattgatgagtggtacagcagtatttatcacagtcgtggaatggttctaccacttgatccaccacctgtttattgaatgcctgtgatgctgcaggtggtagaaatacaaatatgaaacaaaacaagaacaacaacaacaaaaatagcctctattctagaggagcaaaggaatatagaggattatgttctctctggggataaggaccgtgtctaactcgtctcagtatcctcacattcttgtattagcctcaatgcacagaggcacatcatgactattcattaaatttcactgaattagaccatggaatccagagctggaatctgaattaggtcttctggcttccatcccaggttctttcactgagccagtattctcaaactttagcttgcatcgaaagtacctggaggcttattaaaacacagattgctgggcccaggccccagagtgtctgattcagtgggtctggggtgggagctgagcatgtgcatttctcacaagctcccacatgatgctgatgctgtcagtctggagttcacattggagagccactgttctaaaggccatgaatataaagagaaccatttccttagacattttctgtggtgtttttactgttaatagcctagagagagtgatatggctattatctaaagtttatttattaatgtaatgatgactcaccattgtaagttttcttgtagagaaaacatttttagaggggtcagttacctgcctaggagggacaatagagggggaaaagaagaatggtgccgaaggtcctggtaggtgtcctcaccagtgacttcctttttctcccaggtagggaggggcaaggtgaagcactccatagccccctgccctgtcatgatattattgagttggattaggtggctctgtcaatgggacccatcagctgttttcctcaatggctttttgttcctggcttggtaaacaggattttatctggtctgaagacccagaccctttttttatgaacttgcctttttgacctttttccttggtggccagcctgagtcaacactttggtcttcctgctggtcttgctgtggctgggttgtctgtcctgcctgcctctttgctgggattgtcagtgcctagattcggtgttggctggcttcacttccccttctcccatagggtcttccctagctgtgcctcttccccctgcccctacagtctggtcttcaactcccccatatctcccccaacccctaactaaagcttcttgtaatatgcaaaaatgatcaggttatagcagattattcagacccctttagagtaaatccagttttataaactctttactaagtttgaaaattgggagcataatctctttaaatcagcagaagtttacctaatacagaagctttcactataactgtattttcattatctgggattggagcagcaaaatactcttgattttctaagcagtagccataagaagaagaatataaaaatgggtaaaaatattactggtatgtgaacatcttctcatccgttcttattgcttctggcagggtggaaatgaatctcagaagtgatgaggtcagacttccggataaaggtcccttaagtgtcccctggggtggggcctcagtggtttaggtctgtagaccactggcttatccagggacagggtggcatgcagacgatgaggactcacacatgcctggcctctggaatgaacccttaccctggcagggaaaagcaagactcagtccagacccatctttttcatatttgcttagtgctcaaaaaataactttttgatgccaagactgaaagagttgagatctagataaaataagatttttaaaccctgaaaatatactgacgttacaggcgagttctcattttattaaatgttcaatttcacaagtttcacattccacaagtaatagccatttagggaatggggtgtgccacacaacacatactgggcccccgtcctcattctgtccaatattttcataagaaaaaacaaagccctctgattttcacttgtttttaaaatccacttgaacctcacagctcacctcggtttttgaactaagccgctatttacaggtcgatgttaatattttctttcggttgccacattttaccactactttgtatgtacacagaatacggtggtttaaggttagagcactgactaagaatcaccatggagatttctagcaaatgaaacagaaagattattttaagtacaaaaacaaaagcatgatagctctttttgtgaaattgcacgcatatgtttgtatgtatgcctacagagacaagcctggaaagggtaatagtgttttctccaagtggtgagattttgggaagcttctacccagttccttatactttaatgcataatttgagttcattaaagtaacacctgctcaatctaaaaatcagaaaaagaaattttctggtatgagagaagattacagttgggtttaaaggcttcagtgccgtggcctctgcagcatcatgtgcagtgtccacagacccgagaagctgacgtttcccctccttggcttcacttcacctgggacgtgggtacctggtgcaagcagcgggcagcagcaatgataagttctgttggtaacaaacaggatgtggatatcatttcatatacattgacatcccaaaccccatagataaggagagctgttctaaccgcctcaaagataataaaatcgctatccatatctgttttttcctgtgtgccacacactatgctaagcactttgcatgcaaaatttaatctctataaatgatataagagaggaagtaatttttaaatccttactttacagataagggagctggattttagagggacaggctaacttgccaaaggtcacacactaagtaagcattggacttgggattccagcccagggctgtgtatagctccagtgctcatgtttttaaccatttcaaaattactaatttaagtagaaatacaataattttctaccttatttctaaatttttgcacttttaaataagcaatctggtacattgattagtataatacacaaattttaaccttcagtataccagaaaaaaatagtcatcaccatttaccatttgggttcaaaggacacttaattttttaaaatcaatgcagtgaaccttttcacatctactttatccgttttcttccagtaacctttgtatacttagctaccttcagcacctgaacgttttcaaactgtatataaagtaaattttggtatacagacttgaaaaggtgaaagaataccatcccacattcatttagcaaaacaggatggtccgggttcttttcacaaaatattatttgagggaatccttcctcttgaacgactgactgtataagaatagcatgttttctttttgtccttagaaatatattgttcattcaatatatttagagagtctaagagaattaatctatcatgtcatcatctgaagagtcgtagtctgacgtttcgtttccatgatcaatttcatcatcatcattagagtcttcagtgccgtcgtgtgatggcttgcattcatctctgatgtttctgttgtttgtgaaatctcatctctctttctgtcagttatcttctttttgtcattataggcaagaatgaaaaatttgaaattctccactctagtcaatgaaattaaaacaaactacaaagatgatgtctctagtctccttttatatcctccaaaaagatgatgtaatactttgggtaatacaataagaaagatggagggtgatgcaatagtgacaatttatttcactaatgaatcattcccttaggctcacattgtttaatatggtagctattagcctcaggtagctatttaaatctaaattaattaaaattaaaaaaataaaaattcagtttctccattgcactagccacatttcaaattctctgtagctatatgcagctagtggttactgtcttgcacaagaaaaatagaacattttcatcatcaaggaacattctactgaatggcagtgttctaatccattctattgttcttatatttttctattactttagtcttcttaaaccttatttgggaataattgatatataactggtgggtaattgttcctgagatgataaaatagcaaactgtttcaagatataggaataataaaattacaaagatgccataatggatcttagattttcttaaacggtctgctggacccatatggtagttgcaaggtagaatgagttttattctctttctttttttaaaaaaaagtattttctctttttctttgtaatatctctaagaaagaataaagttataaaatattaatccatacaaatagctagaactgcttcaaatttataaaacctaaaaaactaaaagtgggtccaatggatgctaatagtatattgagggttaagatatattactgatatctacacttacatacaaaagcatttttatatataaaatattatgtttgcatataaagtattagtattcaaaattccgttgtaaaatgggttcattagaaggcggcttacaattattatgctgatccagcaatctccaaatgaatgagaagtagtaatatgaactgagataatatttgtatagtgctttgcagtgtctggcagtgaaccattgctcaataaagttgagtccttcctacctacacccccagaagctaatttccctttagtattgattgtttaatgcctacttagtctaagggatcaggaagacatttaaagaattgaagatgatctctgtaatctaacagcttataatctggttgtgtcatgaggtttgatggaatcaaagacagagagcacatgcttctgtgactgatagattcttaagtctaagtgacatgcattcatccaagtgtttactatgcatcaaatttgtcttgggctctgtgctgggtgctgaggctgtcaggccacagaatgcacagtctatgccctccgggagtttagtccagtcaaaggacaggctggcaaacagattcatacagtaagtatgctaagtgggctgctggatgctatgatgaggatgcacactcaacacaaggagaatgcaggaagctcaacttgaccttttttccaggtgcaagtcctgaagtttgaataggaggaactaactaggtcagataacctgggatgcggacaggcatggtggcttatgcctctaatccgagcacttttggaggctgaggtgggaggatcgcttgagcccagagagttggaggttacagtgagctatgattgcaccaccactctccagcctgggtgacagagtgagactctgtctcttcaaaaaaaagtctaggatggaaaggatgagaagggatgggcctcactgctggagttttaagagtggtaggtgggaaattgagatatgaactgctttgaggagcttggctttaacaggaaagagagaaaagatgataggcagtggagtccatgtctacgtaattgtgtagtaggaaaggaatgatcagtcacaaatccagttttgaatggtgtcatggattgaattatgttttcccaaaagatacattggatcctaaccccagaatctgtgagtgggatcctgtttgtaattaggctctttgcagatgaagatgaggtcatactggagaagggtggaccctaaagacaatgattgatgtctgtataagaagagggaaatttggacacagagatagagacccacaggagaatgcagtagggacaatggaggcagattgggattatgctgttatgctgccacagaccaaggtacaccaaggatggctggcagccaccaacgagcagagaagcatggagcaggttccccctccaaacccccaggcaggagccagccctatagacaccttgatttcagatttctgacctcctgaactgtgacggtaaatttctgttgttttaagccaccaagtttgtggtactttgttacagcagccccaggtagcaatgcaaatggattgagtttaatatcttcagttactaggatactattaagtattatgccttttaggcattatttgatttgatttaagaaacattgaaaccatttttagaagcttatcaggataatttcagtgcttttttttttttttttttttttgagatggagtctcgctctattgccaggctggagtgtagtggcgcgatcttggctcactgcaacctccgcctcccggattcaagcaattctcctgcctcagcctcccgagtagctgggactacaggtgtgcaccatcatgcctggctaatttttgtatttttagtagagacggggtttcaccatgttggccaggatggtctcgatctcttgaccttgtgatccacccacctcggcctcccaaactgctgggattacaggcatgagccactgcgcctggcatttcagtgcatttttaagttttttttccaaccttccataccactcaggttttccccccaaccttctttcttcacttttcctcatcattctcatgtttttagctgtgttattagccccaacattctctccaatttcttctatttaaaattcattcctgctgttcaaattgtgttatcttctacacaaaaaacatattatattacatcatatttttctctgaaaaggatctcagtgacaattcatttaagacaaagttaccgaagagagagatcctgttgccacacaacagagggacatgagagcaacaaagaaaaacagtaaggaagtctgctgtctctcaaacaatgtgcccctatttctacaggaaacttctcagcctaactaaccgttaggctaacaatatgatacagtttggctgtgtccctaccaaaatctcatcttgaattgtagctcccataattcccaagtgttgtgggaggtagccagtgggagataatcatgggggtggtttcctccatactgttcttgtggtagtgaatccatctcacaagatctgatggttttatgaggggaaactgctttcactgattctcactctcttctcttgtctgctgccatgtgagatgtgcctttcaccttcagccatgatcgtgaggcctccttagccatgtggaactgtgactccgtcaaacctctttcttttgtaaattacccagtcttgggtatgtctttatcagcagtgtgaaaatggactaatacacaaaactaccacaagttcctaagaaagattacatttttttccccttttaataacttctttagatttagagacacattgacagaaagaggttccatgttctatagtaaagaaaccatgatgtccattccttgctttgagcttaaagatgaaaacccaaatatattataatgatagtaggtaaattacttatagaaggtattgggagtacaatgaccttcagttggcttggttaagcattggtgaccttggagaagatttctggatccaaaagtccccatttcccggagggcaggattgctggattttgtgtgtatacacagtctcctttggttagcatcacttttacttgcaagagtagatttcagagaaaaatgaatttcttgtttctgtctcccaaaacctcaaagcctatttttcaggatatagacatgcccatccacctggttttcctcttctctgtgaggacctgcaagaagcaaataaatctctggcacaaaattgtgttgtgtgcagggccgccctgcctagcatgcttccatgtggccacagctcctgaagccattgctgctgctaagagggtgcccctggttccacgctcctattcattgttctgtaaagaacatgcgatgtggtaaaaacccacattgtctgattttctttgaaaaacaaagaactggcgttctcaagaagtttataatactttcttatttttgtctaaggctgaaatgatgaaacctctttattttcaacttttcaattatttttaattatgaactattccaaacacaaaaaaaatgaatgagactaataaaatatatatccagtatgtccaatgcactcacccaccccttaggctgaaaacatgtgactgtgttaatttgctgcatgcttccttctgaactttctgttcattcttggtgcctgggaggaggctgagaagcatcggttttagaatcagatctcagttcaaatcctagctacgtcactagttaccctaggtactctaaatgagtacgtcacctctttgagcttcagttttctatttctaaaagaggatagtaatgcccacctcttaggattgtgaggctgaagtgagatcactggaatgcacttagcatgatgcctgacacatggtagcacccagcaatgggtccttggttctatagctgtttccttgatgtagattctggtaactcagtttgctataacttagagcaagcctagttcccagtcccccaccccaccccacaccctattttcgttggagttttacttttattttacttttaaaatttttttaaaatttttttgagactgagtctcacactgtcgtccaggctggagtatagtggtatgatctcggctcactgcaacctccacctcctgggttcaggtgattcttgtgcctcagcctcccgagtagctgggattacaggtgtgcactatcatgcccagctaatttttatattttcagtagagatggggtttcaccatgttggccaggctggtctcaaactcctgacctcaaggagtttgagacctgacctgcctgtcttggcctcccaaagtgctgggattacaggcttgagccaccaggcccagccttatctttttatttttaatttttttttttagagacacagtcttgccctgtcacacaggctggagtacagtggcacaatcatagctcactgtagccttgacctcctgggctcaagttatcttcctgcctcagcctcccaagtagctaggattacaggtgtgtgccactatgcccagctaactttttttttttggtagagatggggtctcactctgttgcccaggctggccttgaacccctggcttcaagtgatccttctgcctcggcctcccaaagtgttgggattataggcatgagccactgcaactggcttctttggatttttaaaagcaattacatgccaattggcagaccagatacgaatctcttaccttataagaacattgaggtcttgtaggtatccccgctttgatgcctttgggctaattcaggacactaagcaaggcctttcacaatcccctgccattttgttttttcctaagaatatattgttctctgtttcaaacctgactttaccaaaagtcctttaaaaaaaaaaatcctacaaaagtacaaaagtgaagctgcttttcattttatggaagaatcaattgcactgggtaatagatttgtgtttaatgattcatgataaatatatcaggtttagagaaagagagacctagcaagacagaatgaggctgggagttaggaatcagtttcactctgatgaacatgaccttgaaagagtcccttccaccctctcattttttttatcattgcaagtgataggaaaattaatgatgtgaacattttatttttaaataattataagagcttctgagaccactgtatgctataaagaactttatgctttggtattctgttggagatgggtaattaatagcttataaggtaaaataatctgcaaaaggaaaacaaatcaaccttacataatagggttattgtttttttaatcccgaagtcgcctgtattcccacttcactcttacttcgcgctcatcacatttcttaaaccatttatgtggaagtgtttggcccagctggctgctttctcagatttcaactttcagtggagatccatgtccaagttcagacacagtcctaaatttatcaattttatgagcatgtaatgtgtctactcttgcccaagaagaacataatgaattcatttcttcctccacaaatgtttagtgctattaagcacatctttcatttttctaattaaaaaattctgtgaagccacagttttaaaaatatgtagtttatgtaattgttcttttagtatcttccccaccccaatccccaggggccagttatcattgataagatgttcaccaagccttatccagaccagcctcagttacaaaatcatgagcttaactggttgttggggctgggctgtctataacaaaaatgaagggctttaaatgaagcatgaaattttaaaatggcacattgttgttggaaagcatatttaatcaagaaactgctttagcaaattaagaaaacccatgccaccattccttggcagagtggcagttgcctcagggctctgcaagttgtagtaacttaatcatcttagcagctcccaatatagcatatagctacctaatcctttttttttttttttttttttttttgagatggagtctcgctctgtcgcccaggctggagtgcagtggcaggatctcggctcactgcaagctccgcctcccgggttcacaccattctcctgcctcagcctcccaagtagctgggactacaggcacccgccactacgcccagctaattttttgtatttttagtggagacggggtttcaccatgttagccagaatggtctcgatctcctgacctcatgatctgcccgcctcggcctcccaaagtgctgggattacaggcgtgagccaccgcacccagcctacctaattcttttcttattttttattagattgtatgatcatttctttgttttaaaaattatgcatgcttctattatgttttaatttggaaagtacagaaaattatagactagcaggaaaaaataattacccacaatgccaccacgcaagggcaactaaaatgaaccattttcacccatctagtctttatagtatattaataatattcaagcctcctgtcacatttgttgcaaatatttcatcagtccttgtatgtttaatcaaagtcgtgcatgcacgtaacacacagagtttacagaaccaaagtgcttgttgaaaaacagtggtccccgatggcgccctgcacgtcactttctgctcttttatctggttctttagtattaacttcatatccctggttaacctgttatgttgctgcttccggatttcactcagctttaggcattgtctgtgcaagagaaggatttagctctttcactgcagctgacccacctcccaccccccatcacccttctgtgccatctagccttcttgcctaggtgtatgttattggggctaaatcaatgcccagtgattttattgttgcaactaggtagacaggagtgacagctgagccattatgattatgtctcctttcctgcttatcttttcatttcctttataacaaataattctcttgttttgtaaatttatttacatacttttctatgatccccaatttatccttgaactcttcttcagttgtgtaaatctccctggagccttcacacacattaggtgttgtgtcagtgtggagttgatgaagtctctcctggggtcttcttgcctgctcccatcagaacggcttgctcgctcaacctcatgctcaggtgtgtcttgggatctcctttcactctcttctgtatcgatatggtttggctgtgtccccacctaggtctcatcttgaattgtagctccaataatccccacgtgttgtgggagggacccagtgggaggcaattgaatcatgagggtaggtctttcctttgctattctcgtgatagtaagtctcacgagatctgatggttttatcaaggggcgtttccctgcacaaactctcttctcttgtctgccaccatgtgagatgtgcctttcaccttctgccgtgattgtgaggcctcccagccttgtggaactgtgagtccattaaacctcttccttttgtaaattgcccagtctgggatatgtctttatcagcagcatgaaaatgaactactacatgtattcactcctatttcctgcattaccatattgtatttgttcctttttgctgctgtaacaattacagcaagcttagtagcttaaagcaacacacatttattgtcttacagttctggaggtcagaagtctgaaatgggtctcactgggctcaaattgaagagtcagcagagatgcgttccttctggaagctctggggcaaatccatttccttgacttttccagcttctagaggccaccagcatttcttgacttatgtctcctttatcttcaaggccagcattgttgcatcctcagatctcagactctccttctcctctctccttccttaatttatcaggacccttgtgattacattggactcacctgggtaatccaggatcctctcctcagctcaggattcttaacttatcacacctgcaaagtcctttttgccatgtagggtaacatattcacagaatttggagatgaggacatgggcatctttgggggaccatcattctgccttctttcctcagcctccagtagcttctcaagaacaggcgcatgggacagaagtcatctgaaatactgcatttctgaaaatatctttatttcatccttgattgatagtttgacatgatatggaattccagattggaaatccatattaatcaagataggttagggtgatgcaattataataaactccaaaatcttagtggctttgcacattcgagtttatttcttgcttgtataagaaatagcttatatagctcagggatccaggctgtttccatcttgtggcattaccgtctcaacacaggacctccaatgttactgtggcacagagcagagaggaactagaggggcacgtagggagacttttcagcccttcagcccagaagtgacccgtgtcactttttttttttttttttttgagacagagttttgctcttgtcaccctgactggagtgcaatggtgtgatcttagctcactgcaacctctgcctcccgggttcaaatgattctcctgcctcagcctcctgagtagctgggattgcaggcgcctgccaccacgcccagctaatttttgtatttttagtagagatgggggttttgccatgttggccaggctggtctcgaactcctgacctcaagtggtccacccgcctcggcctcccaaagtgttgggattacaggcgtgagccactgcgcctggctgacttgtgtcacttctgtgagcagtccattagccagaacttgtcgcaaggccccacttaactgacagagggctgcaagatagagcatatgaatactctgagcattgactatctctgccacaaaatcatgtcccctctgagtatgaaggtttttgccagttttattctagcttccagtatttctgttgagaaaacgaattcctgattttttatatgaacatctaatctgtctctgtggaagcttcttattcttcgtgttctaaaattgtataattctgtgtctggtgtgtataagtttcatgtaccattccagatacttggtggactttgcaatctagaaacagataccctgttctggaaactttgcttgatgttttattttccagaaagataggatttcactctgtaacccaggctggagtacagtggtgtgatcacagctcactgcaaccttgaaatcctgggctcaagtgatcttcccacctcagcctcctgaatagctgggactacaggcatgtgcaaccatgcctggctaattttttttttttttttaattttaatagacccaaggtctagctatgttgcccagccaggtcttgaactcctgggcttaagcgatcctcccgcctcagcctcccaaagtgctaggattacaggcatgagctattgcatctcgcctggttttaatttttacattttttaatgaattttgagtctcacgttgttgcccaggttggtcttgaactcctggccttcagtcatcctcctgcctcagcttcccaaagtgctgggattgtagctgtgagccaccttgcctgtttcttcctctacattttcattttttgtcattctgaacctactcttatttggattttggacctccaggagtagttgtctgtgtttcttggccttgttcctctcattttttcttttctttgtcttttttgctctactgtctagaagagttttgaaactgtcttccactccttctgttgcatttcttccttgctgttctcatatgtttcatttacaagagcttgttgttgttgttgttctctgaatgttccttattataacattctttggttccatacggggtctttacatttcacactaaaggttattataggtatttttattattttttggttgctattctggatggaatatttttccactatgttttaaatttattgttgtaatactgaaaaattactgatataatgtcatgttactgaactttttatttcaataatttttcatttattttctttttcctttttttgatagagaatcacataattgacaaaaagcatgcattttatctctttatccaattctgttttaagttttataacattatccagaataatattatgtaatgtaaagtccatggtgggagactgtgtattaattatcatgtcccccacatttaggacatgtacctatttagttgacaataaatacatgtcaaatgaatgaatgatggttatagacagtatctttcttttgcttcaagttttaataatattaaaaatgttctgtcattgagtataattgtaatttttagtttaagatacatattctttatcatgttaacaaaatattatttttaaattttctgaaagcatacagttattcaagaaaatatgtttcctttgtgggttgtgatcttgcactcaggaacatgtgctgaattagtttaattcaactttattttataaactaataggggtaaaaactaatggggacagacagtttgagacgtgcagacaggcactatttctcagtatttgatttgttgtaacatttttactggtgaccggaagaggaaatgctcagaaaaatctgagtttgcaggtgactctaatatgcaggtgactctaatattttttctggtactactgaaccacaggactatctactaagctcagagtctctgtcacctgtaatgtaggggcttcctcccaggaaaatactgcagcccaaagaggctgtcaaagtactggacaccctggagcacagaatataacagtgtcttgtgcaagccatgatttatctatgtcagagagtttctatgcagttttagtcaacaaagaccaagagaggcataactggctggagaacattcagaaactaataaccaaaatgatcttgggaggtagaagcaaagactaaattaattatgattcttgtcagaagggacattgactctggaaaatcatcaaagcctataaaatcagaagcagtgtgtttgaggtgaacacaaaactcttcaccaaggccttgaacacaactgtggtctgaaattaaatagactcaaagtgcctcaaatcttaaatacgatatatcaaagacaaattgaaggacatcttgtttcttgtgggggatagtaaacagctggacttcatttgcccaaatgacagtacaggccaaaactataaatcagttcctataaaagttgatatatattcatggatgatgaatccacagtagattaggaaaagtgcaatgttgtttagagggacagcctaatattttggagttgatgttcttgaatccagtaagatcattcttattttatatatataataaaataagaaaattagcaaaaattatttccaatatgaatattatttagtggttattgactcttatttacaatttagtaatgcttttcttttttgagacagtctcactctgtcacccaggctggagtgcagtgacacaatcttggttcactgcagcctccacctaccaggttcaagcgattctcctgcctcagcctcctgggtagttgggattacaggcacccaccaccacacccagctaatttttgtgtttttagtagagactgagtttcatcatgttggacaggctggtctcgaacccctgacctcaagtgaagtcctcagtctcccaaagtgctaagataacaggtgtgagccactgcacccagccaatttagtaatttttggttcttgtctccaaagcattcactgggtgctcctgctcagattccccatcttgtaaggctttccttgaagcctccacctcctgcagctgccctaggcagaagctcaatattgggaaggcatcagcagcaggagtttgaagatcctggtccaagtcccggctcctactcctcctagtcctcatcctggcaaagccaagtactctctctctgagttttgtttttctcacttataaaataggaagtaatgatttcccagtattcttcacattcacatttttgtgaaaaggaaatctagttaacatttctagacgtgctttgggagccataaggtgctggcttcgcaatgatgggtacagatggagtggcctgttttccaaacctctgagtcattacttctctcttccctggtccctgacaccctgcgaatgaacccccatgtggcctcttgctctggcaagctggtttgattatgtgcagggctcctctgcccctgaagcctaaagcctagtgaaaggcagactgggtggagaccctggcagttctcttctaggctcacaccctcatcttgaccttcagctccccttcctccactccatggaaacagaattgtcaatgtatccccctaaaacctagggtagagcaaaaccagctggaccttcccctctgcctttccctggggtgagacctagactccccattggctcccttcccctccccagcccccattaaggggaaattgggagtcatttactttctgtactagctgtgtgggacatgagagaaaaatgagcaatgtgaagccagccaacaacagaaggagacccagggaaggagccaagtggaaaacagcctgaaaaacctttgtgccatcctttgagcgtatcatttcctaccaccagagcctaattctgtccttgaggaatatatgatcttaagacttcacctcctctaagaggaaggcagccttgggctcctgttagagatcttagtgtgcaaaactgcaaagcacttagaatgtcacttctgaccttataatattcttctgtaacaatagctggcacacatcattatacatcatactgttaccggtatgcatatattgttatctccccagctatattgtaattcctcaagggcatggaacatattttatacatcttttttggcttaatggatatgtactaattatgtgtacctagaggaatcctttcatctggcagtcagaggtatccagaatgaacttgtcagttacgtaagccccatccagcatgattccatgatgcagtgcctctagcgcggtgctgtaggacgtgaagcatcacaggtgatttggagaggtggatgcttcttgcccagagtcacttacctgcctggctttgatcttcatgcttctgccgtttctttcttcctcttcaaaaccagatgtcttcctccccttggccaaaaagaatataccagtgaagtggtatgtcagggcattaataatgagaagtgtgcagactgtagtttatgaggatttcaggttctttgatttagaatatgattgtttgctacaaattaacttcatcatgggtgaatatagcaaaaagtgggcaaaagtaactgatctgggcttgtcatctgtgcacttaatggacaaggtatgagggttatctaattgatgtttctaaagtttcaaaatgtgttcagatacacaatggtcactgaggagagatgttattagcttgactgccattgtattaggttggtgcaaaagtgattgcggtttttgtcatgaaaggtgatagtatagtatttgggggcttaacttctgaagcttagtgaacctacattcacttgaagactctgcctcttactaactgtgatttgggacagatttcagaatttctgctgtcctgtttcctcatgtacaagggatcctatttgatagggttgttgagagaattaattgaaagaaaccatctaaaatgcttagcacaggcctagtctatcctggattaatgaaagtctagtcagttgttggcatggtatgagttagtgggtttgatgtgcacacataaatgcctgtgcaaatactgaggaagggttctaggagtcacagcaacaagcagagtttgagttatgtaagccttcaaaagtgtgtgttctgaccactgatgttgccatttcaagttattctaaactggttaaccacagatgggattaaagcaaaaattatgaatatattttatttattttattacggtaagacaaaataacagattaacgtgtacacaacaaataatgtgagagaaaaaaaatctctgtttggtaggattagtgttttcacttgtattcagtctggccaacacgggaattgatgctattttaagtatacttttcagccataattatccaagtaaaatcaaaagcagttgtttattgaaaagtactgcatttaagataagaaatttagtatattgcagaccacagtttggagatcacactgaattatatcctacaaggaaatatcattctagataccttatagaggtgtacttatactaaatgttactccagatctcaggaagcatatgttgtagggataccacaacacacataggggagaaatgcacttttaatgagccctactaatttgacattcataattcagaagggagataggctgacatgggcctttttctctgtaaagatcaagaatgtgacagatgattgtaggaacaattactttacaaaagagaaccacctcatttcaaggacctcttagtgcaaagaaagaaaagggtggccattttcttatggccttcagtcatttctttggtttatttagcactggctcaggtactagtttcagggtgtaaaaatccccgatgcagagaacattctgcaactctgcaatacgtacagagccctagaatggaaaagtgctaacgaatttcatgacctaatttaaattccccagtgtggctaattggggaactgtgttttactgatctgaattgctaatttttatagatattattttaacagctgtccatttgtaatttatgtcagggtgtttccagggcttttttttttttttttttttttttttgacagagtcttgctctgtcacccagccttgagtgcagtggcacgatcttggctcactgcaacctccgtctcgcaggttcaagcaattctcctacctcagcctcccgagtagctgggattacaggtgcctgccaccatgcccagctaatttttgtatttttagtagagatatggtttcaccatgttggccaggttggtctcaaactcctgaccagggtctcattttagctaagtgtaattgtatatgttttgtggcatttggctcgagtcaaatcaattttaaatctgccagaaaagtttgttttaactagtttttattcctagtaaaaataggctctcattactaattattttgagtaggtatatatagtatatttttaattggtgatatattggaatacccttttagaataataatgtttcatctaatcagaaatctaaacaaccacttggtgattactgtgtactcaaagccagttagtacattagcgaagtcaccaaaagaatcatttccatttcaaaatcttgggcgtttggtggtatatatttttattttagtgtatgagaaagtcaaccattgctatcccaaatgacagaagttattcttttgcttattacatttaattatttttctttgccatttaattgtaatacagggcttctatattttgaatgtgtgttaaacgaatttagatttataattttatattttaatgattaatatcaaattctctttttaactctgtgaacatgagtcatttgaattactcagttatgcagacaacatattttcagctacctatatctagttcaaaacgtgccaatgaaagatctgttttcccttattttagttacaaatgatcttgtaatcaggattagttcaaaaagaacaaaatatttttacagcataacaaaaggctgttgatgataaacctgaatcatccatttattggaggtctgagaacttaaattagtctatcagttcatgtgaatctctttcttaaaccttagcaaaaaacatttcaatagtttactcttaatcatctaattatttactgttgattttgtggttgtatgaccattgaatgcttgaattatagctcaaagctatcattcattcaaaattaaggattacaaggatgtgttttcatatattgttttgtattatgctacatttcactttttattggaaataatatttatcttgtaattttctctttgagaataagtatattttggtaaaattcctcttcagttcactttgtgagaaattcaaatttaataggcagtaattgaacttttttaaaagagcactgatctttaatggtaatcattgtgatggctgctaaaggatgtaataggtagtttcatttgcctttggtcctgagcaatctgaacaacagaattccaaaagtcccattcatatagagagatgcccgtgcgcttcctaccgctcagatacggtcatggtttccttttaatggtggtaatggcaccaaaagtagatgtttgattttttaatattcttccacatatatgtataaaattaaaatttcccatcttactctaaaaagactctacttgtattccaattgcaggcacccaaaggtgctttgtgcaggcagtttttgtttagtttttgttttggcagtagagcctgtaggtcctcagggatgcagcggctctcaggatctacattattcatgcatcgttgtttaacgtccttctagcagcaaggatgtgtgctggcagaccacctccactttcacttagaaaattgccagctagtgctcctgccttctaagtgattactttgctttgctcgaagtatctatatgaagataaatcttttgctaggtagcaattcctcaagcactgtcccccccgccacagcaaaaatgatggcagatatggtgtgttcaaatgactgctaaataggcaagctgcattttcacaggatagtgtataatattttaagaactattgtcttgattatgcaaatatagaaagaactagcaaagcttactggggaaaagcaataggaactgttctgcattgtttttggggaagaagtgtttgctatttaatgatttggaagtttgcttcttgttattggaacttagcattagtttgattaccttggtaaatacacatacatttcacaatcaaaatagattatttaaatctcccaaggtagcctgggatgctttttttttttttttttttttttgagacagagtttcactctcgttgcccaggctggagtgcaatggcacgatcttggctcaccacaacctccgcctcctgggttcaaacgattcttctgcctcagcctcccaagtagctgggataacaggcatgcaccaccacacccagctaagtttgtatttttagtagagatggggtttctccatgttggtcaggctggtctcaaactcccgacctcaggtgatccgcccgcctgaacctcccaaagtgctggcattacaggcaggatgcttttttgacacccccacttctactcagctttctttccttccttcagaaccctgttcagggtgtgaaggacaagttaagccatctccgtctctctcatactgcagcccacctgttctttaggtcataaccacagactcacatctttaaagaaagttagcaaatcaactcagaacccttacatgggtctttctctcctgctgtctcatcaatcagagcaagttcaactttctactaaatttatctatatttatatatgtatgtttataaaaggtatgagttaggtgtgcaaaaatgtaacattatgggttaaataaccttatttaacccataccttacatgatttaaggtattactaaacatgcatcctaaggtaaataaacccagcacaggaactgcccatttccactgatgatagaaaggtgtctgtttctaatcgtttagtctcagcttctcaggggtctccccttctcatttctttcttcctttctccttccggctgatccaagttcccagggggcctttggggaacagacccttgtccaggcgctgtcctctgtccaggattgtctcagttcactaggcctggtcttgggattcagcccattgcttccacgtctgaattggctggccctgacccctccagggtctctggtgaagcccagaggccctgcatccccccttgccctgaccccaggcacctctagcccttttttcagagattcagaaaagttccagaaatgttcttatcatgaattgccccaggatcgtgtgtctgagaaggtcactcagtcatcaccactctgaagctcaagctctaatgagaagctggacctctctctgagaggtagagcctcagagctcacaccctgggaggccagctccttgttctgtaggactcccagaacattatctgcgatttctgtcaacctgttcttccctagatcacttggcccaagggagagaaccactagaccttttcctagggacccaaacagcttctgaaatctgatcttgtccttctttatccttatcctgttgactgacggaacctttgtctccttttgggaggcaactagctcttaccttattcttagcaatctttggttctgttgatacacttgatgccttccccttcaagttttactctttagaattccacatcactctcctctcaatcatttggcgttggaaaattttggctttcaggacaaatagctttcccaaaaagtcacaaatgaaaatttagaagctaaaaagagaaacagaagatagaaagtaattatcagaaaaaaaaaaatcagacatgaaaccggaattgtcttcttttgtatattgtctccattcctttttaaattacatctttcttttgttcttgtattaattgtcttattaattccatgctttttggaggggaaaaggatggagaaagtggtaaacagcctcaaatcctttttgccagcaaagaaatgatcatttaaaatagattcaggccggccatagtggctcacgcctgtaatcccagcactttgtgagactaaggggggcagatcacttgaggtcaggagttcaagaccagcctgatcaacatggtgaaaccctgtctctactaaaaatataaaaattagctgggcatggtggtgagcacctgtaatcccagctactcgggaggccgaggcaggagaatcgtctgaaccttggagacggaggttgcagtgagccgagatcatgccaatgcactccagcctgggtgacacagcgagggtctatttcaaaacataaaataaaataaattggaatactctatctatgcgtcttttatgtggcaccttgtgtggctttcctgagttcaaataagccactgaaaaaatacctcagtgaaagtttcaatccatgagttgtttcttttcatctcaaggctgcttatcagaggacataaaacagcattaactgtgacagaagaaaaggacgaaggccgagcaggcccatatccctgcgtaagtcctgaaccatgcttcgttaaagtctgtactttgaagagtttcaggccttgttgttaatcaataactctagccatgtagtgtgcagtttaagagaacacaaggatcaaggagaagcaactcttatctacattgcttttgcctgtaatggcttccataatttatccacaaggagaaacaagcaatgagaaaaatcctccctggccggtcagagcctgttcatattttggcaacaaatgaagctaaggagttgtcaggtgtggtagattattcccaagaggatgtgttttatttttatcttgtgatgaaacgccctctgatgagcacagcagatagcacttttaacaaactctctttggagaataagtatttaattctattacagaatgccaacaaggtggctgtttcacaatgaactgtcccctgtgaagtactgtagagcagatacagggtgcacctcagttgttatttgaaggatcagttatcagtggtaatgtgcacttaaatccactgggaatcttgtgaaaatgcagtaggtctggagaggggcccaagatttggcatttctgacacgcttccaggttattttaatgcctggtccctgtttctcacttcacacagcaaagttttagagcaccttagagatctcaaataactttgtgcagaaatttcttactggattagtggagccagtaaggacttgcaatgccattggcttttatgggcccctcagcttgccaatcattagggaaattgcccaactggaaactaatagcttaagcaaggaaaatcccgtccctggccaggacagcacctctgcaaacatccatccggaattgattctgatgttctgactgtgcatcggaagggtagcttgaagaatgcctttattttagactctgcccacctgcaggctacaggactcatttccaggactgtgtaaaacattgtatctataggagcaagcaatttctacagtccgtatttgggaccaaaaatctttttttttttttttttttttttttgaggattggaatgaccaaggaaccagttagaatggatcagatgtatttctgttgatttacaaaagataatttcattgtcagtaatgaatgtccctaaatgttttggacacaataaggagtttcaggagaaaaccgtaatagtgagtagttatccttttcttaggattttgattccttaacatgaaatgctgattccaatgctttggctttcctatgtcagttcatacaaacttctgattttattaattattgcttctgtagagaataatctgccatattagacgaaagtcattttatcaaaccaaggaaaaatattaagtctactagaaaatataagagttttattgactattgtctttaaatttttttaaaattatggaacagtttaaatgtacaaaaatgaaagtataggttacaaagccctatatacattaatcttctagctgcactggttaccaacttatggtgctaggggctaaatgtgtctccccaagattcatatgttgaagtctaatccccagtgtgatagcagtaggaggggagcctttgggcagtgattagttcatgagggtggaacccttataaatggaattagtgcccttataggaagagatacaacttgctcttggacttcccatcctccagaactatgggaaataagttttcattccaatgcagtattttgatgaaaatgtgtcataagtggtgctgaatgttttccattgtactgcattaggagatacataaggtttggtttctctttttttgcaatattgttaaatacagtcttaactttaagtatagtcttaactttcatactctcatacgagagttcagaaatcttacccgaaactcgattctacctttgataaatgaaatatggcagtggtccccaacctttttggcaccagggaccagttgtgtggaagataatttttccatagattggggggtgggtggggaggatggtttcaggatgaaactgttccacctcagatggtcaggcattagattctcacagggaacgtgcaaccattaatatatcccttgcatgtgtagttcgtagtcttttctatgatatgtagtccaatttaatttgcaatggtttgaatgtttgtgtcctcccaaaattcgtataccagaacctaatccctaatgtgatagtataagagttcacgctcctatgagaatataatactgccgctgatctaataggaggcagaggtcaggcagtaatgctcactcgcccgcccaccactcacctctttctgtgcagcccagttcgttacaggccacggaccagtaccagtccatagcccaggggtgggggatccctgaaatatggtatatagaactaaatatataaaatctaatatatacattgatatttatacatgtaatataaaagattatgtctttcaggcttctataacaaaataccatagactgggtagcttataaactacagaaagttatttctcacagttctggagggtggaaggtcaaaaggtcaagatgctggccgattcagtgtctggtgactgcctgattcctggttcacagatggtgccttctcacatggtggagggggcatggcaattctctggggtctttttttataagagcactaatcccgtttatgcctcaggacctaatcacttccccaaagtcccacctcttatactatcacattagggattagcttccggcatatgaattttgggaagacacaaacattcaaatgatagcagattaaattggactacatgtcatagaaaagacaaaattaaagtggcctatacaagatagaagtttagcaaatctaaagataggcacctctgagtggtatgacatccccacagtcatccaggaaccatatttttgcgtgtatgtcttccatgcttaagattgcctcatgttccaaaatggcccctggagctctagccatcatatctgcttctctggctggtaacataaatggagataagagggtaggaaaaaaaagccctacctcccaggtcagccagtcccagaccccaaacaaggatgtctgcatatttcaaaatggcaattcataccttcaaaaaaagcaggaaatgttggaaagtcaggattcccactgtgggaagctgtcaaaatattaataaggtatttcaaagactttgggcagccacaaacgataaacatccattacatgtagtttagaattgtatcctagtgcaactgttattatgtgaacatgattaccaaatcttggaaagaaaagattggctcaaatatgaaaaataggggaatgcataagaatccagagaaatcctttgctaacatattgtcagtatttgataaatttttgtcctaacaccaggctgaaatggaagctcaactcaggtttgcccaagaagaagcaggactcctgatttgaagggtggtgtgggggagggtttctagcagggaatggatgcttaagccagtggtgggacatagatgttacatagttttcctcagtgctataaagaaacatgaaacaaatagcttctccagcaaccagagccaacagactgtcacttctctaaacatttaagctgctttcctgcagttctattttcaaagtaaatgatctattcagctgtttgcttttgttgtttgttttggcaggaaatttgaatagggacagaataatagctaaaattgattgagtacttactgcgtgccacacactgttttgggtagtttacatttaaacatcacaggccataatattggcgttattactagccattttacggatggataaactaaggcacagagaggttaagtaatttgccgaaagggatgctgcaggtaagagctagaactgggatttgcactctggcactatgctgtattgtaatagatccaccgtaacacatatcctcccgtgagtatattttgcaaattgtgaagggaagcaaggggagggagaatggggcattggctctaagttgcttcattatagagagtgaaacggggagaagagattgtctggggttcacagtgttagtgcagacatcgttctggatcctgggtgccgccccctctttagcgcctcactcactggcggatcttagcccaggaagctgagggcaaccttaggccctagaacttgccacccatctgagctcccgtcctcctttctgccgctccttcatgtcctccacttctgagagcagttttgagtcacatcccttgtgggagatgcctcagccctaccctgaaactgaaccctgcccccacatagccccagcaccttgcgtttgagcacaccacttcccaggttgtgcaggcctcagattttgagtacagtgtcgtaatacgtatttggcctgtaacttgcgctgagatgcatggataagccattttaatttagctgtatagcaaaacccatccttgacagaaagtgtggactaacacagaggcaatttcttcctgccttgctcatcacgttgcatagttagagccaatccctcaagccctccttcccttcctcccttccagctcccatgtgctcctctggtctgattcgacaccatggcctagccttgtgcagtgtgcaaagaggagaaaggagtgaagaaagggaagaggaggggaggggtcctaggcagggcttggaggctgtgacagtcaccctgtaggctccaaattgagacagtggcctggggaggaaaggctgcttagggcagcagcacccccccaccctcctttcttccccctcagccatttgctctgttttctggaatatctgcctctctctcatccaccaactgtatacactgccgtgagggctgggacttaccttcatagctgcatttagcccattacctagtacacagggccatgcatatagcaggacctcaataaacatttaatgaatagaattcagtatttattatcacagtccttgaactcacaaaagctgaagtcacatactaactgtatataaagagaccgtctttaccccatgagtcttaaaagcggggttgcttggaccattcgtcaatggaagaattacgtggcgtgctgttaaaaatgtaggttcccaggcttcacctgagagtgtgattctgtggagctgggggtctgaatttttaacctgtgtccccagtgactctaagttacaggccaaatacgtattacgacactgtactcaaaatctgaggcctgcacaacctgggaagcggtgtgctcaaacgcaaggtgctggggctatgtgggggcaggggtcagcttcagggtagggctgaggcatctcccacaggggatgtgactcaaaactgctctcagaagtggaggacatgaaggagcggcagaaaggaggacgggagctcagatgggtggcaagttctagggcctaaggttgccctcagcttcctgggctaagatccgccaggtagaccgtggaactcattttcagaaatgaccgaagcagcatttcttgatctttcttaaaactctgtcgctcttgcttgatactctatactgccctctctgtgcattgataactgtgggtcccgggtggctgcaaaccacatgtgccatgcaccagaaggggcattgttgtgactgaggccggatgaccttaagaatgaaacccaagccctcgtggggttaaaattccagaagtaccttagtatttgctgcaaaaccatcggtaaggaggaaaaccccactgctttatgaattgaatactaacctggaactactcccaaatcaattggactttggtttctcattcagaatcttcactgaatgttcttaagtgagttttaagataccatttccatgtaaaaagcttctaaagacttgtttgagagtgtacttggaaaagaagcatttttatccggtcttacatacgtaatcaaaattaatcgcttttcccccagcctatctctgctactttcagctgttaaatagccatttgatttaatatagcacctcattcttcagtgatcttcagcagctgacacctgaatttgtctgcagacaatgtgctttttaaagaattggcctgctggtgcttttgatgtaaattttatagggccatcatctttagatttttctttatcaaacaaaatactctcttttttattattcttacttgcattctcatgatgattaaaatatcacaggaaatgtgtgtggttgagtccatatttcctaactatattttatgattaggctccgccagatggctcctaccatacataataaaatgtcagaggtgcagcggtaacctcgttatggtgtgcatttgaactcagtcctagcaccgtgctaggtccctaggcacatccttttttctttactttccttatcttattctttttattgttaaactttttttagttctatttttaatttgtgcatttttgttatttggaagatagctttgttagccaccttgcatcccttctggaatagactaggagatgtataaatatgtatctttaatgaacatgaatagagaaaaccaagatatttctattgtccagcttttggttcattttgattcccaccaccatctttgcatggctgttgctgtaagcctgtgatctttactatagtactctgatttcctgcaagaaaaatgaaactgaaccccgttaatacccagtctccaactcccaagcattccctacatacaaatgcttcctcccacacagttaggatatgtctttctcctccagatacctctaccatggggtgcacctccacctcctctccaacaaggctgtcaagggttctgctacctcctcactgccactgagcgccttccaacatggctgccaccaccagaggtcttgccagctcacagctgtaatagttcctgctcccactacctgctccagcccagccaaaggaaatgtcagagtcagttagaagctgggagaacccctctatctctccatagtgtgctcagtgtcagagccgtgtgtgtgtgtgtgtgtgtgtgtgtgtacacttctgttggtaggggctacaagtagatgactatcaacacctgcttctatagccacagtgaattcccagtccagcagggaagaaggtatgtctttaaggtttttctacataatgaaataattatgctttcataatcttgtcccacaggtaccatggtggtcatggcaaaatgcagaacccaaaagttttcaaaatagtttgtcttctgaaaactgttattcagtgccaagtttgttcttgatgtttttcttctaaatattttgtcctgtttgatgaaacaagtaatctatggtcattatttctaaaacatatttccttttttaatggctatggcaccagttaagccttttagactttccagggtgttgccaggtggcttctgactactgtcatccattaaaatggcttaatttgagtttgaggactagacaggaagacacaggtttaaaggcccatatttactagaataacattgttaaaaggaaacattttaataaattaacagtttatttgagcaaaatatgattcatggatcaggcagttttcaaaatcataagaggttcagagagagctgcactctgcatcatgggcagtatttatagacagagtagaaggcaggtacacaaaaaacttgattccttacagctcagctttgcgttcactggatgtggtctgatcagttggtagcctgttattggctgaagcttagaccggcttgtgattggctgagacccagctatctttacacaaattagactcccaattatgtttccattcatttaaatacatggtagattttgtttcatcttcagggtttttgatgctagctgttgacctttagaggacacattgtgagcctcttggtcctaattgctgtacgttttgagacagatcttgctgatgtctttggttccagcctcgcccccaccactccatcctccacactggccaatgtggtctctctggaggccccctgcttcaccctcttctgatgccctgaggatggaggggtaggagcaaagttcttccctccctttttccactccaaccctcctgcccaccctcgagaggtttctttgtttgcttttatttgtttttgagacaagatcttgctctgtcactcaggctggaatgcggtggcccaatcctggctcactgcaatctcaacctcctgggctcaagcaatccttccacctcagcctcctgagtagctgggaccacaggtgcatgccactatgcctggctagtttttgttgtgttttgtagagatgagattccaccatgttgcccaggctgctctcgaactcccaggctcaacctactcactcgtctctacctcccagtgcttttgttttttaataattccttgtgatttcttgcctgctcttttaaaagcaagactgggactctttaagagatggtgtgttatttttaataaatctctgtaccctgaccgtgttcccatcaggagcgtcagaaggacaaacagcagctaagtgagcctctaccagcgagtgttatagacccctttataagctctcctcattaggcatttctggcacctaaaatagatggctggagaggtaattagatgcagttacttgcaaaagtctcagaggcattttcttgatagtacacaagaggagtctattaattagttctaacaaggaaggtttaaataacatcagttaatggccaattgctggtggcaaccaggcagacagaatccagagtccctgggctgagcttcatcctttgcctggaaggggaagagttccatgaagacagagctcctgcctgtagtctctctgggaagattaaatacatacagattaaggagttgagaataatttagtgccaagctctgtactaataattgtaagtccaacaagtgaacaggagaatcgcccagagatggagaagacgtgagtgtttgggtccaacagcaatcataacttgctttttcctaagtgattttgtgtgttgtatagtatgcttgttgtttgttgggtggttgtgaaaaagcattccatccgtatggggagattaggctggagccccaaaacaaaaactctacctctccagggactctctgtctggcagcctatgaggaacaggtattgtgttagaattaattaagcatttccctctctggagccatcctttggaatgcacacatccctgggaggagagacccaccaagctttctgcactccaggtgaacagctatagagaaacttcctctgagcaggatggacctggagcatccttgtgggttatggaagcacaggaaggggacagaggcccttcagcatccagtcgcagtcatgaagtgccactccccatggtctggtgcctctggagccccatctccctccagttggctgtccccactgccgccacccatgccccactcttccaccctgtgccccagccatgtgatacatctctacccagagcagggctccagtccccaccctctcctcaaacacccagcatcatcagagccagaattagtaaggaggacatcggccacaggaaacaacctcagatttaacatgagaggggagtggagaagagagcactggaaagtctcatggtggggaagagagataaaatgtacactattgttttcaaaaatgtaattctattcacataccaggaaattctcccttttaaagtgtacaattcagtggtttttagtatattcacaaaattttgccaccattaccactgtccaattcaaagcatttttgtcactccaaaaagaaaccctgtacctattgactgtcactccccacatcccccatgacctccaacccctgacaaccactagcatactgcctgtctctatgattttgcctacaggattctgagcatttcatataagtggaatcatacaatatacaatatgtggcctttatgtctgacttctcttactcagcataatgttttcgaggtctgtccatgtaggaggtatcagttcatttctttctatggcagaatactattccttatttgcatagagatgatctttctttttcttttttttttttttgagtcggagtctcgctctgtcccccaggctggagtgcagtggcacgatctcagctcactgcaagctccctctcgcgggttcacaccattctcctgcctcagcctcctcagtacctaggagtacctaggtactttttttttgtattttctatagagacagggtttcactgtgttagccaggatggtcttgatctcctgacctcgtgatccgcccgcctcggcctcccaaattgctgggattacaggcatgagccaccatacctggccttcttttattattattattattttatttatttatttttgagatggagtctctctctgtcacccaggctggagtgcagtggcacgatctcggcttactgcaacctccacctcccaggttcaagcagttctcatgcctcaacgtcccaagtagctgggattacaggcatgccccatgacacctggctaattttttaatttttagtagagatggagtttcaccgtgttggccaggctggtctcaaactcttggcctggcctcaagtgatccacccatctcggcctcccaaagtgctgagattacaggcataagccttttagtgtccagctgcctgtacccaactcccacccttaaaaaaaatgcttatgcttaaaatagtgacattgcatggacataccatgttttagttatctgcttatcatttcatgggcatttcagtcgtctccacttttgggttattatgaataatgcttctacgaatatttcaatacaagactttggggacatatcttgggtatacacctaggagtggaatttctgggtcatatagtaactctatgtttagctttttgaggagctgccagactgttttccaaagtggatgcaccattttacattccaccagcaatgtaggaggcttccagtgtctttgtatccttgccaacatttgtcattgttcatctttttgattatagtcagccaggtggctataaagtggtatctcattgtgattactccatgttttttaatcagtgtttaaagggttagcatgttctgtgtttcagggatataagcaaaatgctagagtctcttcctaattatttttagttacagttttaagaataataggctttggctgggtgcggtggctcatgcctgtaatcccagcactttgggaggccgaggcgggtggatcacaaggtcaggagatcgagaccatcacctgacccaggatgagggattggccagtagggtgtgctcagaattttagcccctccccactcctgggggcctttgtccagggcaggacttagatatacaactgtacttggattgtagttggtcgcttggaagccagataggccggggttcctgttttcagctgggctgagggctctgacattcaacaaaggatttaatgcccctggacctcggtttcctcgtcagtaaataatattggtgatatttccttctgatgactatagccctcttatggtattgtgatgattcaatgaaatgagctttataaagcagctggtctaagacctgacaaatccaagtgcttactaaacagtagttaattttatgtcttatcctaagggacttgacacaggtattattttctctagaagatgggtcagcaaactatgacccataggccacatcagtgtaatattttacctcccacaagctaagaattgttttgacattttttaaagggttgtaatcaaaacaaagaatatgtgacctaagtttcctgattcttgctctaggcccttctctgacagcccctcgtccctgccctgctcacccccacttcagggccagatgtccctactcattggtcccttatcaccttgtacttatctctgacatagcccttttcacaaagaaatccctaggagacaatcagcagcttctccatcactgcatcctcgggcacacagtaggaagttagcagctgtgagttcagggaatgaaaggggagttggggagaagaggacactgaagacggttttgccagccacacagttttgcttaagtcctaaggggagaggagactggcacttggctttggctgtcctcctgtgcattgcatttgagcagagcaatgcccttgtcccaattgtatccccagatacgttagtgtggggggacactctgaatttcccctaggccgtcacatgtgggctggacttcccaggaacacatttcttggtaattcacaactccctttcggagaagaaacttggcctgtgggtaacagaccccaacccaatagctcttgggcctctcctggaaagacacagctttctctcagccaggctgcatgaattcaggatttgcattctcttggttggggctgggctgagagaaggtggaatgcgtgtttttgagattctaaataagaaaagcaggcgtgactatgcctgcttgattctattactttggggcattttcaaagaatttcttgtctccacttatttttctaatattcatgtttatgttgaattcctcatgcagaaactgatgcattgcttttaccccagagctttcactgacgtttgatggaattagctctgcaaacactgctgacatgatgtgccctcctgttttggttccttctgtactaaacatgatttttacaatgaacttgagctctgtgtatgagagaaaaagaaggagactgatttgtgacctgactacttgcccccataaaaaagtccagaagagcccaccgattaaagcatataagatgaaggcaggacagcaacggtctgaggggagcagatgtttaaggtgcttccagcaatctgagttgagcggtttacaattctcaggcaaaagcaggcacaagctttttcaacagataaggaacacctttaaaaagaaagggacgaatgcagatgaaggacttgcaactcacaatgacttttaaactttctacaaaaaaaaagaaagaagaaaaagagaaaaaacctttaaagtttatagtagtaggttttttccaaaggttgccaatgtgtaggttgtttgcaaacattgcccagtggaagaaaggggggaatatttccaagtcacaattctacacgtttaatgtcaaagcctactaaatattactcctcttgaatcttcaaaggaattgtgtataaattcctgaaaaataaaattgcatttctgcacttggatgcaagtgaccctttggtcactccccatgatgactggatgaacatagtttaaccttgagagcaactctcacaactaggtcaaaagttgtttattgaccacataatttccaggtgcaagatgctttgaatttttaatgcgcttacactaaaattacacaggggctgaaagattgtttagctggacttctgagcaaatgagtgtggttgttattgttgttttaagtagaccacatacattcacagaagggaactttaccgtgacctagcagattacaaaaactacagtgagttcctttgacagcttgtgagtagagaaatatatttataacaaacatttcttcttctccagctacctttggcttccaaccataaatattttataaactacccccagaaatgtttaatgacagacttttaaagtaattgaagaaagaaagcagcacactttatgagatcctttccactgacatattttgatcatcgatacagcatttcgaagctaatagtgctgttactacaatgtcagtgtactacaggatcaaaaggaatgatatgagacttagaactcttttcactgtgagtgcacttgattttgattttctcagaggataatacctgtagccatttttaaaaatgaataaaattagcaaaaaattaaaaagagaaaggcctatatcagaaatgcattgggctaacaaacagaaaacctgacaagagtgacccacacaagtggagagccctttttatttcatgcattaagcagtccaggtctggtgtggtggcactgtgatatcactggggtctacctcttatcttcgttctctgtcttcattagcttgcagatcttggcttgtagcatggccctcatgcttcttgcctcatggtcacaggattgcttctgcaactctaggcgtggtgtctgtgttccagggaggagaatagaatggaaagtcaaggcagaggactgaaaaacaatgccagaggaatctgtctgtcattaaaaattgcccaagaggccaactcagcagtgttcatttataactcattcatttgttgaatgaatggacagaactccatcactctatcactcccaacttcaagtgagtctagggtgactatttttagctgggcatattgttacctagaatgaggtcatggttcctttaggaagagaggaaagtagatattaggtaagcaactagcagaatctgctatagggggttgtcatttcaaaatattctatatagttagtaataggtttgaaaaaatgtttttttttcatattgaaggtgaggactctatggggatgaaagaaagcaattaacaatacaataatggggtatatttaccttctgaatttaaaatattctctgaagacattactgctggagcatggtaagaattcatccatcattcagttgtccttacgtccccgttatgtattgagctaagtacagttgcaaagagagagaacaaaacaaagagagagtgagaaagagagagagagagaaaggggagggaaaggggaggaggaggaccagtgggagggaggaaggggaaaaatcatagaaatacattgaagtcttggccttcccatagccttacaggctagtgagttcatcaggttagcgtaattggtgaaaaaacaattatataaaccatcataccactaattgccatagttgaacaaactttactttggattttctggtagccaagaaaaaatggggccataaatggtaatgtcgttctcattttccatgagaagaaaaaataatacagtcatttgtcctacagtgtagtggattagagagcttgagtaccagctctggaatagactttgaacaagttatttaatccccctaattcccagccttttcttctttaatatgggagcactaatactcatggttctgaggtcattttacaaattaagtgagatattgcgtgaaaggcaccaccaaattaagagccctgggatgaaaaaaaatgagaaagatagaagacattgtgctcaatgacatccccattccaaaacagaactggattgtgagatgtcctatcatatggtgtcacttgagagctgccaaggatatgatgccaaaatgtcactcagtcaaagcagctctagatggggccaagaagttatgcttcaatagacagctttttgatggtccaacttggaccaaggctaaaaattcaaaatgtacagagaaatggatggagtctgtatcctcaaacaatctcccttacttttgacatctttcagccagccctttgatagacataagcagctctccatccaagggtacagtccccagtgaaggcctggaggggaggtatttgtgtcactggtggaggatgagctcctgcactacaatgacataggttggacagtggccttacccagactctgacccaagcaagtgctcaacccatcactaagattttttttttttttcactctattgccctagggcaactacagtctgagatcagcaatagactcttaaaacctggggctcttgccctcattttaaacttctgtttccttcatttgtttctttaactaaactctcctgatgaggattttcttattgcttagtcaggtccaacttcttgaccattataggggaagtcagaagttttatatccatccagtgagtctagctatagagacaattgttgctctataaactgtctttctcttttcctctttctatcagatcacaaaatcccaagagatggaaaatatctgtatcaatttataaaaatattttttgaataatgatttattttatttagcactgtttgatagcctgaatgtaataacagttccctataggaaatgggttcccccatccatcctggtggagatttctgaaaaatctgtttacccaggaccaggtaacagatgaaagcaaaaaccagccaatagatactgtggaaaagagcattccatgatcagatctatgctggtggattgcgtctagattccatgccacatttgttcaaaattaattcaattatgaaaaaggtatacttgtgaaaagcccccaacatgtaggcagttaagacataatttcatctgagagcaatttaaatgtcttattgccatctctagctaaaaataccttatgatttctggattcttgtgtggagttaatctcccagctcaagttcaccttgttgctaattctctatctcatttcagtgtgggaagcaatgtcattttatgtagaaaggaatgtatttcatctctcctcttctccagctatcagcaaatctatgcctagggcagggagcagctgtggggatatggataggacacagccatggatccttcgcacatgttgagaatgtccttggtgtttgctgctcttactcccttttctgtagatgaggaatggagattttcatgaacaggtgtttgaagaatcaagaacaacagggcctttgagtggtggggtacagcagaccctactggttacttactccatatccattctcccacagcctccccctctttagcagaaatctgacttgttcaagttttaccctaagaggaaggcagttccaccctagctcatgagtgagtcctgattaatctaagcctagcatggttgtcttatttcctttgctcatggctagttgagatgtacactggaagtttagaccaaaccaatggaacatgagaaattttctcagggccttctaggtaggattttcagatcttaaaggaagcacccaggaaagatagtctcttcttgccccagactttgtaattctgcatgggatggctggaactgcagcagccatcatgaaacataagaaaagctagtctgaggacaatgctggcatttccaggatggaagagcgagatggaacaaaagtatggaatgaggcctaaaacctccatacctaaggacttttgtaagagaatatattttcctatttatttacgagagaatgtattctctttattgtttgagtttcgttgggtttttggttacctgcagatacaagcatcctcgtattgatacatggagatgtaacataaagcagagaagttctttagccatgtttaacccatttgttcttgagctgcaactcagttgtcctgctgtgttgctatgctcagtatgtatgaggggaaacactaggccagagagttgatgaattttgtatggtgtgttttccttgcatatcatacgtgcaacacacagacacacacacgatgtgaaaaatgccaagaagccaattccacatagccaaatcaaacatgggagggaggctagaaagtttcttattaatgcaaatcaataagaattgggtaggtgtactttgcaaagggaaaatggctatccctttgaagccatacaatttctagagataccaagactccgttcaaatgccgtgttctctgtgaccccttccctgagttctcaaggccaagttgatcaccccttccgttctcataccactgtatgcatatctctagtggggcgcttaccacatggtatcagcgcaagcagtgtcagcgttcaattcccttgttagattgtgagttcttacagggcaagagacttgttgtaacctttgatgtattcacttattcaacaattatttattgagtgcctactatgtgccaggcattgagctgaacactgaagatacaatagtcagaaaaagcagatgtggcccctgcagtcatggagtttaaaatctagtgagacaggcaatcaaataattacagcagtcaaccaatttcttatgcctaaccaaatgactagcacgcagtaaatgctcaataattacttgctgaatttagtcacagaattttcaatattctgtgccaccttttatcttcctggaagctagcctaagttcatacgatggtggaaaacctcctaggggaaagagaggtgaagcccccacatgcaggctgttttcaagcatctgtttgtattgcacttactaatgtcttaatggccaaagcaagtcatgtggccagtctagagggccgtgtggaaggaagttacacggtgcagggataggaagaggtgtgactggtcaggggccattatcgtaccaatctgccacactattttaaattatgggttatgttatataagcctaaaactcagctaagagatttaaacaatgatcatttgaatctaagaataagtttctcagtacaattcacactcaagaaactaacatttgattcagacatttcaaatggaaaataatgatgtgattcacagtgaacagtatatccaagcttttggtcttaaaatctttgcacagtgctttgatgagagaggagtcttggcagccaagtgtggctgtttccccagcctttatactattttcagtgagggcagtctcttcttctgagggttgtaatgagaataatggactctttccccactaacatccagagaagatcattctaaatcgagtggttggcccatgccaacaatatctgctataaattatgaaacctccaatcaataatcaatacttctcctctatttgtataatagcaaatgagttttgaggttggactcagagtataaattgttaactaaaacaaaataggataaatatagagaaatgaaacttagctttagagcagactcttaaaccttagaagtctgtataaacaaaagtgtctatgcatgttttatttggagatttgtgtgattaaacaaaaatgtattacagatctgaatggagagtcaaattaagtgtgtgggtctagtggagagattatctatccaaacgcatttttgtaattccgtactctggtccaaaagttaatgtaaaaagccaatcgaattgattaatactaaaaatggaacaactgcaaactagaactaatttgagaaccctcctactttcatcctcagagtttgtctaataaggacttttggacgactgaatacatagcatgtaagaaagtgttagaaatggctacaagtctgatgtgactgcaacaatattactcataatgtttttgagcacaacaaaaacatacagggtacatccacatgcataacagatgttcacgggaagatgaggttaaacaggacttccacatccacgtgggtttctccacttaattttgatcataaaagccatagagaagttgaaaggcctcttagaagagtggacagaagccgccaagcacaagtgcagtagggctaccttgtgtatgcaaaaggaagacaagtcccacttggaaatatgccttcaggaaggtttagcctcgcaaacttgcactctcccattgtgcttacatttcatgtgtgtggcatgtggatttcatttctctttctgtcaaacatacaagtattccatggattcctatggacccaactgcagtttgaattttagaaactgtaacatttttggccgagcgcggtgcctcatgcctgtaatcccagcgctttcagaagccgaggcaggtgaatcacttgaggccaggagttcgagaccagcctggccaacagggtgaaatcctgtctgtaataaaaatacaaaaattagccaggcatgatgctgtgtgcctgtaatcctagctgttcaggaggctgaggaatgagaatcactggaggctgagaagcagaggtagcaatgaaccaagattgtgctcctgcactccagcctgggcaacagagcaagacctcgtctcaaaaaaaaggaaactgtaacattctgtggtaatgagatacccagtttatggctgctttttgcctattatttgtgtactgaccacagaagcttaaagggtactgtggcattaaaagtgaatctctttgttcctcatatgtatatttttttcatatttgttaatttgaaatttgaaaatattcatcttttggtctatggcattgatagcattcaccagtgtcacctgaaatttgagttcctgctcaaactggaagtcttgtatttttttcctgaagcactcttcaaggatccaactatggtagcttaatcattacatctagaaaatgacttatggctccttgtgaaaattgcttctttgtatgaaaattctggtacagcatgcaggctattgtgttctgggaatagcatagtgatgatgtgcgttatggagataacaggacattaggtatacagaatggaattaatatttagaagtgcaggatgccactcagataaccctgtggtcatccctaagtattgtgtagccctcggttaacatatggcacatggacagggaggagccttgggaatcattaggttcagtgccctcattctatactttgaggaaactttgacttagagaagttgttcaggatcatttgctcatgtcactcaactacttagagtgataaagccaaggggaatgccagagtttcataactttcagtccagggaaccttcgacttcaacatactttttcttctgtaacgtagcaaatcaggggtttcaaaatattatgaatgttaagaaaaaattggtagattttcttatagttttaagagataactgaaagagcatcctttataataataaatatgacagcattggttctacagcacttactataatcgtattttcatcccaatagtctagtctatactctttattaattatccactatatacataacagatagattatttttattaattatccactatgcacataacagatagacccagatggacttgtaaatgatctatggctatatttatttttctgtaggtagcattacacatggaattgtttcaagtgggaacaggggaagagaagaaagccaaaggttcagatttggcatagctcttggagaagatgggcttgaataatgagaagcacgcaggatgtcatttgagagttgtggatggaaagagccttctgttcaggaggattgcaatgaggggaaatagaattctgagatcggttctgtgtatttcctcccctagaatggaggaaaggagactgggagcagaagagatgatggtaattagaaaacagatgtgtgtggctcagatggtttgatgggcaaaggccagtgagaatcactgccgagttctgggaggctttggcgatgatctcaaaatgggaagcttgaaatgattaaaactgtggaaaggaagagaaagataaaaggaagataaaggtagatttattatgggacaagcccaaacaagaataggacagccaaggtgtccaaaataaaactgggaacgcctatggagttggaacccatgtcatcagcacaaattactggaactttgttttttctgtttctttaatgaatatattccacaaacaaggaaacacggtaaaatctagttttaacttttaaggcgttttccagattatatcttggtagcaatatggactgaaattaatttaatagcttcagaagaaaatatcatttattgggttataacctaactttcccctttttataagtgaggaaactggggctcaagggtgtgaagtgactggcttctagcaccacagtgtcctaggaactttaacatgaggatttgctgagtggatttaaactgctcacagtcctatggacagtgaggaacagaattgtccctgaattcaggccttgcacagccctggctgtgactctttcaagtgttagtttgattaaccatgaaatggagttgctgaaaaatcatgaactgcagttttattcgtcaagcaaagtcatttcacagtcagtataatattcatgctaagggtctaatgctttaacaacattcagtataaatttcagttaacctacacattcagttaaccagcacacctgttctctaactagcctgggagagtgtgagcatacttatgaggttaattatgactggtaaatgtgagtggagctcatcaacacacaatgagaccccaggaagacacaacagtgcccttcgccccaactcctctccaggatcacgcaggcaaccttctccccagccttaatccctcagaaggcttcaaggacccactcagccacttaatacagaaagctgggagtcctctgtgacagcacttcctcaaagctgatggagttggcagagggccctggtgagctttttagagagagactcctgactctcatcctagactgtgattcagttcgtcttagagtgtggcccagaaatctgcatttttaaaagttctgtgaggaatttgaatatacagttatttgcgaaccacagcttgtactatattaagtatcattttgcagagaattaaaagcagcactgatgttaattcttccaacattaccaatccccagaagagctctatagactctgggtctcatagactatgaaagtcttggtccagaccacatttactttttacctagaaagccttccttctcttctccccatttcaaaccagggctaagctattgaacttgtggatgtcatctggtggtggttcctgtcgtgctcaggatcttggaaagatttctgtttatctggcacgctccacacaggcctgtcaggctctggggatttgtggcatttgcagaacttacaaggcaggcagcataaaaatatataattcatagaatgaaagattttggaggccccttcacttttacaaattggccataaaatagaaatcacagacataacattcatataaccgcagttgccaagaatgaagaatcacttgggggagggagagggtgcttgaggagtttcatgtgtacttctctatagggcacctaaagaaagagtgagcattcaaactctctgtgcaaatgataataggaacattaaagtagaggatagagttctcggcctgacaattgcaagtatctgttaaggataatgaagatttcgagattgatcctaagaggtctttaaaagtcttttcacagtgattgagtttatcatttgagggcatttgcttgtcctgatagacattccaaatatacttaggattttgtatacattttactataacttactgcttcttggttttttcctttcccagtggaagcagttgacaatatttgaggcagctgtctactttgaccgcctgtgatatatcaggggaaggagggaagggaaaagtatacatcctgccaccttcttctccaattagctgcgttgacactctgggcttccattagctttctagaaagagtccttaggaaggagagagaggctaatctgctcctgtcagttccacttaagccttctggggacttgagtcatggctgagtaatggctgatgatactggttgtgatcgccgactgttgaaaaacagtgtattcaatgaggttggatacatgcaagacataaaaaaggaaagaggatctctgtcacagaagtcaaactaaaaattctcttcactatttgatttgtatattaaagaagtgtcatcttaggagtcaggagagccgagagctgggctttcgtggttatgtgtcactctagctttgtgaccttgaagatgccaaatgatatttctgggcttcagtttactcatgtaaaaatagttgtaatatctacatagtgtaaaggaaaatttcatccaaatcaaacacagattgggctggagatgggggtgatagagggtgatagttgtggctagggggtgttgaatggatgaattattctaaattgcttctggacctcaaactccattatgttaggaatctgtgatccacggggagtatggggggcacacagagggagttacttggatgctactaatgatacttaagccatttgataatttacactcttagagaaatgcacagccagagtaaaagacagttatgctgtttcattctgtattgttaaacaaggatgaaaagggtttacatgtcacagaacctaggacagggtcagtccctccctccttaaaaatcagtccttttttttttttttttttttttttttttgccatctttccagaaagtgcatttcaaataaaaggtgatgaacatttttaaagcagaccttcagaaacaaatctatcttattttctttttgtttatttatttttatttttttgagactaagtatcactctgtcacccaggctgaagtgcaatggcgcgatctcagctcactgcaatctctgcctctcggcttcaagcgattctcctgcctcagcctcctgagtagctgggactacaggcacctgccaccactcctagctaattttgtatttttagtagagacagtgtttcaccgtgttggccaggctggtctcgaactcctgacctcaggtgatccacccacctcagcctcccaaagtggtgggattacaggtatgagccaccatgcctggccatcagaaacaaatctatagttctaccaggaacaggaggaatctgcttcttgttaacactgtatccaacatctacacattgatttagctgcttaattcggcaagtttcaatgcattacataggttcttttagaaaatgattaaaaaccccaccctaaatttcagacaggtttacttacgtttgtggtagtgcattaggtgtctttaaaactcacaaggctgattccagaaattttagtgaaaacacatttcctgcttttatgttcatatcatgtaggtgtgtattggtatttagagaaatgatagaagtaccgtcactgtgaggatgttaagccctcctttatctcaagttattatcgtagacccagctgcagaaatgacacaggatgttttgttcttatagacgcgttctttttaaataacaaactttcaaactattagttggaagcttgccacaaactaataaaacaattagaattaacatcttttaaaaaatgaattacccaatagcctaaaggtaaataacatctttggttattagtaaaaagaatcagatagatactaagcctgctactgtgctgattacccaaacaattcaggagaaattaagtgatttcacctaagttttctaggtaagtgcctcagttattcacttaaactgtccaagaggcacctgtactcttgtaataaagtacttacctatgtggtaactcccatcttctaggtcattaattcagatgtaacacattcttccttgctattccgtaatgtgctatgagacgggaaaaaatgcacctatcccaattgttggacagtttgtttctatggaggaattaaactctgagtttatgttggcagctctgtcgtagccataatttcataccccagcctggttgtaatggaaactccaacttataaatgctatttgtaccattaaactaaacatgaaacctaattcaaccttcctgatcataaccttgtagccaagaatgtaatttatttttctgaatatctggacttctgtaattgttgccaatgaacaggcttttgaagtactcactgattaaaccataagtaacaatgacctattaaaatgaccatctttttattttctctgatgacttcaaatagcatttggtcagataaagcagctgtatttgaagattctcttggtttcacattttagtgaaattgttgtgttaattagtgttaagcagcacattaaattcctcagagcagttagggctcattcagtgtctgtttaggctctttatgtacaaagcacattctaggcactgtgaggacacatagtagactggccctcaagaaacaaggtattactcataagaaaaaaatacataatggaaaaattgcaccaaaatggcatgtgactggttgttaagtgaatgatatagatattatattttattccagtgacaactagcctttaagcttcaaatttattaaatgctaccctgcatacaaatatttcaggaaaattaaattaacctataattgcaaaggcaaaaattcaaatgacctaccataatatatttatgtttgcagtgtatttatgattttctactgtgctttattatttagttttgagctttttaaaatgaccttctgttatgagtatgtgctgaatgaaggaatcctttgattattgtcagttgttgatcaatgctgagcattcaaaatggagaaatatctttattgcagataaaaatgattaatcatagatgcttttcataatagctatgaaaaatatataataaagtagataatagtataaatagtatataatattatatcaaaatagataaacagtagtatatcaagataagaagtagataatagtatataaaaatcattgtccactaggcaattagaaaggaaaaagaaaggaaagacattcatattggaaaggaagaagtaaaacttctctgtttgcacatagcatgatcttattatagaaaatcctaaagaatccacacaaaaaaactattggaattaataaatgagttcagcaagattgtggaatataagatcaatatagaaaaatcaatcgtatttttaccaatcagtccaaaatgaaactaagagaagaattctatttataatgacatcaaaaagaataaattcaacaacagcagtataaggcatgagcaatgaaaacaacaaaacatcaaagaaacgaattaaaggagaactaaataaataggaagacatccatgttcatggattggaagacaatattgttaaggtggctgtcgtaatcaaatttatctacagattcaatgcagtccttatcataatctcaactacttttttgggcagatattagcaagctgaccctaaagttcacatggaaatgcaaaggacacagagtagccaaaaacaatcttgaaaaggaagaacaaagttggagggacttacccttcccttcccaatttaaaaacttagaacaaagctataataagactgtgtggtactgacatgagtataaacatatagattaagggaatagaattgagaatccagaaataataatgaccccaaatacacttatggttagtgaatttttgacaagggtactaaacagctaagtggggaaagaatagaaagaggagtcttttcaacaaatggtgctgtgacaattggatatttgcatgcagaagaatgaagttagacaactaactcacaccacacacaaaagtaacttaaaatggatcaaatacctaaatgttagaaataaagctataaaactctcaggaggaaacataaatgtatatctttacgatcttagattaggcaatagtttcttagatatgacaccaaaaccaaaacaaccagagaaaatttagataaattggactcagtcaaaatgaaaaacttctgtgcttcaaaggacaccataaagaaaatgaaaagacaacttacaggatgggagaaaatatttgtagattatgtatttgcaaatccagaatatatatatggaactcttaaaatgcaataataaaaagacaatttgtaaatggatgatggatttgaatagacatttctccaaagaaaatatacaaatggccaataagcacatgaaaaaatgctcaacatcattagtcacagggaaatgcaaatcgaaatcacaacgagataccacttcacagcaacgaggatgggtataataaacaaccaaaaagacagtaacaggtcaggcatggtggctcatgcctgtaatcccagcactttgggaggccgaggccagcagattgcttgagctcaggagtttgagaccagcttgggcaacatggtgaaaccctgtctctaccaaaaaaaaaaaaaattacaaaaattagccagtcgtggtgtgtgcctgtagtcccagctactcgggaagctaaggtgggaggatcgcatgagcccgggagacggaggttggtgagcccaggatcatgccactgcactccagcctgggcagaagagtgagaccctgtctaaaaaaataaaaaaatacatatatatcaataacaagtgttggcaaggatgtgcagaaattggaaccctcatatgttgttggtaggaatataaaatagtatagctgtattgaaaatggtttagcagtccttcaaaaaattaaacctacggttaccatatgatccagcaattccactccactcctgacctgttactgtcttcttggttgtttattatacccatcctcatggctgtgaagtggtatctcattgcgattttgatttgcatttccctgtgactaatgatgttgagcattttttcatgtgcttgttggccatttgtatattttctttggagaaatatctattcaaatccatcatccatttacaaattgtctttctattattgcattttaagagttctggaattccactccacttcttgatcactctgtaaattaagttgttctgataaagcataatagcaaaaaatattgtcattaaggaacatatttatgtattttgtttttaaaaagaaacaaaacaagtttgataatcaatcttagagactgcctgaaatttcatcagtgcagagagttaagaagaccaacatttctcttgttatatcatgaagataaatatagtttatcacttctgatgaactgatatacatcctttttattaatctgattataggcctttttcactcagatttattatatgaaacagttattgttctgaaattgagggaagaatcctaagtatttccatacagacgtttcatgtttgttctcttggtttttttcccaggtactacctttcccaagccaggtggtgtacaacagggtaggcaagtgtgggagccgtactgtggtcttgcttctgagaatcttgtcggagaagcacggatttaatttggtcacatcagacattcacaacaaaaccaggcttactaaaaatgaacaagtaagttgactttgcacattgttaaattgtgttttgcttcagctcatttgtgtaactagtgggtgccttacaggtcatccttcagactcctgatgagtgaataccagagttttgatttcatgctgtatttttgccagagtgtggaaggaaatttaagttaagggttccataagaactctataaaccagggaatatccatgaagggatacttccattaggactgatgaaggactgtatgtacttgcccttgtctagttagctaaaattagcgatatatacatctcaaagagtcataccaccgagctataaataatgctgacatcttcaccatcaaaatgagaagattttattttaatattcttccctcttcattttctcaccaatgtccaggatctttatggttgtattggttgatgggggacatgagcttcctgctatgggaaactcagaggatcttaggctttgagagcagcatttggaatgttcagtggtaggaaaagaatgaccccacttcacaggaacaattttgccctagtgtagctgagctgtacaagtggacgtgctgatggtaggatgggagtgctgtcctctaccaagaagctatgaaggtttactttgcaaacctgtatagaggtaagggcaacagtctctgtgggggtgctttgctaatgtagaaaagtcagatagagtgttctcatggtcattttacagagttgggtttgtcatcctggtctcagaaactggcttctgtccccttacatacataggatgagcagccacccaatgagtggtacctgcatgttgggaagaaacaaggaacatggctcactatcaggttgagatcatcattataaaaatttcctcatgcctgtaatcccagcactttgggagcctgaggatcgagatcaaggccaggattgagactatcctggccaacatggtgaaactgcgtctctactaaaaatacaaaaaaattagctgggcatggtggcacgtgcctgtagtcccagctattcgggaggcggaggcaggagaatcacttgaacccagaaggcagaggttgcagtgagtcaagattgcaccactgcactccagcctggagacagagcgagactttgtctcaataaataaataataaataagtaaataaaaaaataaataaataaatttccatccatgtccattttctttggacataatctccagctttgaaacattcagaacctcacaaacagagggaatctcattcttaatttaccaattgcgtatttccattttatcttgggggaaagtagaactgttttaagacagtaacatagccaaccatacttgttctaaagccactatgttttgtgtcttttataatacagagatcaaattgcccactcctttgcaaacttccattaaaaaatcactcagtatcaagtttaaatagccattaccagcacgaatagttaaagaatcattaccaatcagcaaaaaatattttaaggttataccttgtaggttccatattagggtctccaaagaaaagaatgatctttggtggcatttaaggatattgcattttatgtataagattgtacatacagtaggggcaggttctctttgattaccttacttgattgaagagctaatgtgattaggctggtgatgcctttttaactgcctgaaagaaaggaattataaataaatacattattgcaattttattataattattaaatttggtgttcttttgaatctaactcttatggcctgcttatctatgggattacacttaaatataatatcatcatactcagttcccagatgcctcataaaacacagttgctagattttagttcccactgcaggagagacaacaaactacctgcagagagcaggacaaaagtaactcaaggattagacattgggatgttcaggaattgttagaagaaagaacacaaagtacagtatttaaatgtgccttgggattttatagagatcaacctagtttgtttcctatgaggagcaaacatgaaaaagtaaaatacacttgtaactatgaatggaataatttagaataaaaattaacagcaatttactaaccatgtatagattgttagatccagaaagggttaaagacaaagtcttccttctcttctaaaatataggctagctctcatctgtttggaatggttggcttgtctggaagccagagaagagactagacagtcttttaagattctttccagccctgtgattctgtgatatatttgtacaacttctagcataatctgtgtattgtgtagttgaaacatttctgattcctgtggtcaaagtgacctagaatatatttcataacttcattattccagatttctattaaattgtaaggcagttttaaaaacgcatggcaaaggtaaagataaggtagaaaaaacaaatatataattttaatgtgaaaacaaacataataacagtaactattacctctccgcagccatctggctctggcatgcagagagagaagccaggaaataaaaggacaagaaacccagtttgaagttcaacaacatttagagaaacactttttttgtccttgtattgcttttattaaagtttcaacgtgcataaacagaaaaaatattattttaatatatattcaagaaataatttgtggtatgaatagctccttttttggtaatttattagaggaatgaagggggaaatggtttagaagactagtggaaattgtagtcagttgttctcacctataaatggtagaattctgaaaatttgttcccatagaatcattgtcctctagagttaataacaattccacttcaggtgcagtatgacttaaacaggctcttgtgggctggcctgggactttatccaccgtgtagagaatttcttttatgagaaaatgtgctccaagtttcaaactactgacttacaaatgaactttggaatattatccatttctaagaccagattatctattccatttcattcatacaaaaaggcacctctctgggccacagtcaaattcacacatgcattgctctctggagggtagttgtgatcatacacacacacacacacacacacacacacacacacacacagagctaaattttttaaatctattaaatggaacaagacactgaagggattattaaaaaggaaagggagtgtgaagacaccaaatgttagaatgcctataaaaatcccactacatctgtccttataaaaatagaaatacctttgaagttcatattttgggaaatatcacctcaacagcagagcatgggcaatggctgctgggcaagtgttggactttcgcacagctcatcatgcaaacctgtgatgacatcattgcatttatgccctaaaactagatttcaggtcttaagctggcttaaattatctcttgaaaaatggagattatatacagctttgaaaaatagggaatttttttccccagaagacatggcatgtgattgccaaaaaaacacataaccatctttggttaagaggtgacaccatctttctgagcattgctctaaatacaagaaaggtcagagtgctgcaggtgtattacaactatgagaatccataattactttcattctctttaaagaaaagcaaaagttaccagcatattgagaaggcacataattttactatttctatttctgttgaaactgaggattacgtgttggatacagcacctacaacctgcattgtttttcttcattgtttcattgaactttttggacctaaaaatatactactgagtgggtatgattccctgttttatgggtgagacacctaagacaatcagattgtaactttccaaatacattgtaatgactatcagtggctcttggccttgaacctaggccttccttaatccaaaagccattctcatcatgcagtgtttatctcctctagctggatagcagaatctcagcagagccttttaaaacctagagttgcagtggcccttctcctggagattctggggtagagcccagaaaactttttctttaatgaagtgtcacaagagattttatgatgcagccagggttaagaagctctgtcgaaatcatcataccagcattgccctaggtatgttcctgagaatcctagtcctctaagacattgaaagaaaaaaaatattatggttcaataaatttggtaaatgttgcgtgccttgtcccgaatgaatcaattcacgatgattattcgcattttgaagacttcgaaaattaaaaacaaaactgcaaacaaactgtttgactggatttcacctagcgtttttgcagtcttcattgttcaggggagtcttaatgagtgtttgtgactcatttgcattctgcagaactccagttcattgtctgtgaaatactaggcaagtccacatcctcccaccagttgtaacagtaaaggctactatatcactataaacgtaacatctgttctgaccctccaacagctattcaaattattaaaaccttgaagagttatataaagggtggaggagagagagatcctatgcccatgtgccctagatagctttagcttccttatcaaaacactatttccttacaatattttaaatttccctctcctgttgctcttgccccctgcaagtttcaagtctgaatggtggctagaaagcagtgagacttagggggaaaaaacccaactcacctaaaaaaatcatgttaagtttgtaaaagtctacaggctacagggatccctaaggcatggttaatcgggcctctgtttaatcaagaaggtgggccaggcatggtggctcacgcctgtaatcccagcactctgggaggccgaggcggtggatcacctgaggtcaggagttcgagaccagcctggccaacatggtgaaaccctgtctctactaaaaacacaaaaattagatgggcgtggtggtgcacgcctgtaatcccagctactcaggaggctgagggaagagaatcacttgaacccaggaggcagaggttgcagtgagccgaagttgcacgactgcactccagcctgggcgacagagcaagactccatctcaaaaaaaaaaaaaaaaaaaggccgggtgcggtggctcatacctgtaatctcagcactttgggaggctgaggcgggcggatcacgaggtcaggagatcaagaccatcctggctaacatggtgaaaccctgtctctactaaacaaaatacaaaaaattagccgggcgtggtggcgggtgcctgtagtcccaactacttgggaggctgaggcaggataatggcctgaacctgggaggtggagcttgcagtgagccgagattgcgccactgcactctagcctgggcgacagagcgagactccatcccaaaaaaaaaaaaaaaaaaaaaaaaaaaaaggtgcactcattcatttttacagcagatttctctgttttttgttcattcactttgatgaatatttattgagaacctagtattaatgtgcgtattaaaccccagacagcccactagatattagtgcaccctatttctaatcctcgaggcaacattgttaggaaagcattattgccccatgttagaaggaggaataagtgtgtacaggaatctgattaaaatatagtgtaaattaagaataatgtgggagaataagacttgaaagcaaacgggggtcaaatcccgaactttaaatgctgggcttcggagttggaactttcttctgtagacagtgggaagctattccatttatgcctgaggtagcaatttttttaaatttttgcaatcagaccttggcaatgaccttgagcagtaggatgtaaataactcccacatgcttagcgttccaataatggaacactaggcatacatgggttaataaaaaattgttcttaatcacgataggcaccaaaatctgctggggagcgttctcacaatatgtgtattcaggtcccactgcaaaatacagagctaaacttgtaaaggcagagccaaagttatttgtattttgcaggggaaaaactcccgaagaggtcctcacgcacagccctagcaaggaatgatttcacaaaagcctctgattattagaaagttttccttttattgaagtgaatcctttactacgctaggaaaatcccgctgtcacctgagactctctcaaacccctgaagactccatgcgtccctgaagatttatgaagtgttgtctcctcatgagcctctctctttatcccaggaacctttctctggcttgacatgttttggaaaagcctcgcttagaatgaccgtcagaacttcccgactttataggagtggggacagtgtccacaggcatgagagtgctccaactggaccttagagtcaaaccaaagagaggagcctggtccctttccatgccacagggattagttcacacagccctgcagacgtctagtcttggagccctacacacagaaactgagtccgctaatagaaacttggtggaaaaaaaaaaaagaaaaacaaggaagaagcagcaaggcctgcaaaaataaaataagtttttcctttccttccagttgcagccatgagattttctctgtaattgagacccaggctctttgccttgatcatgtcattgctccccctggtggacttcttcttcattgcaggcgtgtgttgcgctgactgcttcccgcaggccatcctgcctcctgcttacaagggctaccccatactgtgggaagagggaagggtcaccggagcctccagccatcttcccaggctctgaggttcaagggccaaggctcttcctgtgagctactccttattttgctttgatatgttaaaaacatgtcctttctgtaaaatgctttgcaaaattgtaagacgtctaggtgttcatgagtgacacagaattcacttatgaaccacgtagggttagataccgcctctgctgacaaatatttgccaagaagtcaggagcaaagtctgactgtgttggtagaactgcaggtaaaggttttctgctgcaccatcccagccagtcaggttgaaagcaaaagattaggaattacttactgatatgctgtgatctgatttttttcttttaggtatctttcattacatagttatcttttttagtatttaaaattaattttctgttcttgttaggatatatactcagttttcccacctagaacttttaaaaagtattatctctggcattttaaagcttttatttttgtattatttcataatgcttttccatctgttagaactttctttcaaattttcagcacatcacaagaaaagaagaaaatttatattccataaaccttctttgttctccagacttttgtgctaaccaatctgttccttccattttgaaaggttatgtatagatcaaatctcggtgggaatggtgaatagattgcagccagtaaataaaaaacaggatttagggtttggaaagacttggatttcaatcctggctttacctcttgtgtggataaggctttaagcaaccaatgcagccttttgtgcctcagtttcttaacctctacagtagggataataatacttatccatggctgggcacggtggctcacacctgtaatcctagcactttggcaggccaaggcgggtggatcacctgaggtcaggagttcaagaccagcctgaccaacatggtgaaaccctgtctctactaaaaatacaaaaattagctgggcgtggtggcaggcgcctataatcccagctactggggaggctggggcaggagaatcgcttgaacctgggagggggaggttgcagtgagccaagattgcgccactgcactccagcctgggcagcagagtgagacttcgtctcaaaataataataataataataataataataataataataataatacttatccgtgggtttcttgtccactgcactccagcctgggcagcagagactttgtctcaaaataataataataataataataataataataataataatattacttattcatggggttcttgtgaggattaaatgacaccatatgtataaagagcaccttggtgcactcagaaaatgggagtctgtttgatggtgttatgtcctggatgttataatggtaagactgtttgccccatgtgacaccaggataatgaacatatgggtctgtctcagaaaggctaaattcatagcctgagtgctagataattctgtcttcagttaactatacatttcttgactccaaaaaggatttctaaagatgatagcttcatttcataaatatttgtggggtgtatgttctgtccaagtaccttgagtaggctttctaggggataaagcctgcccccaaccctcacagaatttacatttcagctcagactcgtgcacaaactcaactacaatgtaatgtagaaagtgcatgtcctgaagaattttcagatgcactgctatggaaggtcatgttcaaaaccaagcccatttccccccttatctgcagccaaatcttttcctcccccagcattgcccatctccatgaatggataccatcacgtatttggttgtcctagccaggaatctgggaaggaagctctcttggccacttgccctgcctcccttccattggcaggtagtcacctccttaaccctcccggaacctccccttctgtcttacttacattgacttatttcagtggttctcacacttttgtgccttagcatcccttggaaggcttggcaaaacacagactgctggcaccccttcccccagagttccttctaattcagaaggcctggggcggatcctgagaatttgcatttctaacaagtctcgggtgatgctgatgctgcaggtctggggaccacactgaaaaccacgacctcagttcatgccattgtcatttgctgttgggattattgcccagtcttcctggctgtgcttctgtatctaatccttacccttcttcacattctccaccctgtcctcagatctggaaaaaagaattttttctggctgttgatcacccacagaataaatgtcagaattcctgctgtgatctgcagtgccctccattacctgactcttacctgattctctagtctcacctgctactttgctgatcccatctcggatcactgaacacctctggcacactgaactcctgcagttccttggtgccgtatcattttatgttctgccttttgtatctgctcttcattatttgcaatgccatgaatccctttctttcctggctaactcctctaggcccttccagactactgagggaaacctccctggggaagcattacctctccatctgaatgtagagagaggtgcttcacttatctaccatctacctcatggtggttatcacatgattgtacctgcctcttagtccacctcacccacaagactctgacagcttcctaacagcaagaaccaaatccatcatctctatagccataaccctgagcaacattgcctgatacagaggggagatcaaaggatgttgaatgaaaagggctatccagaaaggctacttggaggggtagatattttagccagaggtgaagagtggttagtatttagacacacaaggagtagcagaagaacattctgaaagagggaacttaaactggagcttggacttggtcaggctttagtgtgaggaaggaacaaggagggctctcatttggctggccacagcatgtgtggtcctgagagccagttgagggaaatagcacaggtggaattcacatggctcaacacaccattgaattatgggagtccgggaaagagctggatcaaaggtgggaatatgccgagcaccagtaacctgaaccagactgtccagagatggatgaggctggataaagagtaaagatgggtgaggattaagtgtgtttgtggccatggtggagtttgagggcaccattaggacatattccactgtcttcttcatgtgtcttcccacccatcttattcgtgtttttatctccagtgcctaataagtactcaatgaatgatgagtgaatttatgccatggaatcagactaaaggccaggagtggtcccgcatgagccagggagaggagaggtggctcgttggtgattttaggtggtgccattgtcaccccctgatgcctctcctgcaaataagatttaggtgaaggaacaggcaggctgctggccatggggggaggaccaggcaagagacctcaagcaatggcagcaacgagttcagaatatgactgcttgtcgccaaaaacaaggaaagtcttagaatttgtgaagatcaaaccggctgagagctgaaatgtaccctctgccttcactgtgctaatacaataaacacgagcattagtaccttgattctatgtttaaagataacgtctagaaagagttatacattgtcactgctaatccatttttttcctcctgaaatagacagctttatgactattatgacactgttctcaaaatctaactactactattcttccattaaatttaacacattgacatgtgtttagagaatataatttaatgtggaatatgtgaaagaaacgtttttccttctgacctgttcttccagttttcttgtacagtactagggggctttcttgtatgactcttctgtgtgcagagaaatatctgaataaaataacctagagataaaagtgttaatggtctttacattaaacatacacacagtcaagagttatttttccaagcaggcaccctcagagataaattacctatggttatgtctccaaaccagtaattccattagtaaatgcatcaaaaatcaaaatgaacaacgtgaccacgcaggaagttttactaccaaaaacaagcacttgcaggtggtgtgtcgaggataaacagtagataaagaggcaggattcaatttccttttatactgaggtttgaggacagacagaccattattcactcatacctgccactgactaacagaagcacagggtttatgaactgcgagtcatttacctttaaaattcaatttcattccttcaatcgttgtgagcttgaatatctaattacaaggtttatacactgagatcctagtgtaataatctataaagcgtgtactagttggagttaattcattgaacaaatatttatcgagcacttatatatgtgtcagcccctgtgttagacatgaaggaacaaggcagacttgggctttctgtcatgtttgagacaaacctggagttccagactcttattttattgttcttgttgctactgcggttcacatgtgaatgactggttttgtttccagtttttcaacttgaactatttcataaaacatgaaatgttgcacttctgacattcatccaaagtagcaagctgcaatgtgcttttaaaaaattccacagtgtgttcgttttgatggggccaaccagaaaaactagggaaagagaagttcagaaagttagggagtcataagaatgcttggaatttctaacagattttactaaacattttctgtatcatgacatgttccagaaggccataaaagttagtttatacgaatataaactactttttgccttgctgataactgcaaataaataattcagatgaccacccaccaaaacaccaagacatttgggggtttatgtgtttcctacagaatattttccttataaatttcatggtcaaggagcacaagaatgaagtagtacctcattttattccatttttaaattctgcagcacctgtttcaatatttttgtatatcccaataatatcatttacagaataagataatgactaacctccttccttgatttgactttaaaggaagggatagaaggcattcttttatttacattttagtacagcaacacactgatttctccagtcaaaattacttaatctgtcacgttgctttcatggtaacaatcaactaaatgagacacaggactatcaatttggatagcactgttttattcgctaaggagccttatgtaaaacttgataaatgttgcacttataccgctggtccactgggaataagtgggaataaaaagagtcggatattggccaggcgcggaggctcacgcttgtaatcccagcactttgggaggccgaggcgggcggatcacgaggtcagaagttcgagaccacggtgaaaccctgtctctactaaaaaatacaaaaaattagccgggcgtggtggcgggcgcctgtagtcccagctactcagagaggctgaggcaggagaatggcgtgaacccgggaggcggagcttgcagtgaaccgagatcgagctactgcactccagcctgggtgacagagcgagactccatctcaaaaaaaaaaaaaaaaaaaagagtgggatacataacctttaacttaatatggcttggtaaattagatcctatatatgctaatttttactttttttaatagatggaactgattaaaaatataagtactgccgaacaaccctatttattcactcgacatgttcatttcctcaacttctcaaggtaagacattttccagtttaatggttctttcattttcttctaatgaacagttactttagaaatctacctttatttacaaggcagtgcaattgcccttgaaaagacatttttaatccgtttatttttgctacggagggatcaaaatttgaaatatttgaacagaaacttcatttcttcctagactactgtcttaaatcttataaaaacttggaattatttttaatgagaagccatttgacctaatagctcttttttaaaaaggaatcagattttgtattgaaacaaataagaaggcaggagatgggtattttagcataaatattttattgcacatttttgtacaatttgaacctgcacagaactctagaaataatttagtgctagagtaatgagtattttctaggatccaaagtaccagcctctgtctgtctttttaatacaatcgtgtgccacatcacgacattttggtcaatgacagacctcatatatacattaatccataagattataatatggtatttttaccatatcttttctatgtttagatacacaaatgattattattgtgtcacagttgcctccagtattcagtatagtcacatgctgtccaggtttgtagcccagaagcaacaggctgtactctacagcatagttacgcagtaggccgtgccatcgaggtttgtgtatgtactctatgatgcttgcacaaccacgaaatcacctaatgatgcatttctcagaatgtacccctgacattaagcaatgcgtgactgtaaaccatttgattttctaagcctcacgtgtttgatgctggggaggtatttaaaattctggtttttgtttccagcagctgtggtcttctgataacaatgcaaatcttcaaattcaggtttttagattccctatttgttaaattactagcttcaggttctgagtgttctcttccccagtctttcattagcataggttgattgtcactgtgcctcactcctttgctgatggccctcagtgttttgctctccctgtgctggctcaagtctgcatacacagctgctatctaatagctgacagatcactggatccagaggcagatctgctggagaccagcctgggaacctccgggcctcccttgtcagccctctgacgggcacttctgtcatcttaacatggggttgacagttccttgcaggtccacacgagagcaccaaaggacccagggcagcaggcaacatctgctagttagtgctgacccagtggctcctgcaggccaggcaccaagggagctgggtctggaggagctgctgctctggtccagggtgcctgacaacccacctggctggaagaagatttcagccatccaaggacttccctgctatgcagcaggtcctgtgcaagttaagtgcaaagaatgagattcagtaaagcaagttattaagcagagaaaaggagctgctgccttatctttaaaagcaagtgttccctgaagtttcctgggccttcctgataaccagagttcctgggatggtaacaggactcctgcaaattttccacagtaatccagggccaggtgctgggcagctaggactgtgttttcaaccacatttataaaatggcttgttactggattatccagggtgtgtgccctgcctcttaattccagaaggccacatgcatattattagacatgattagataacaaggcttattagctctttcaggcattgtattttatgacttgcaaagagaaaagcgctgcttccctgatccttgctgttctagcgcgtttccttctgagtcacccctgacatccttaaacctcattcatgaacacttcttgcttcataggtcaaatctttacaaccaaacagattgcaatgcaacaaattttaaatatttatgtctgaacagtgtaaaacacaaattagaagccatggccagtatcttaattgggttggcagatcacagtatggtggccatattctgtgatggcctctaccaacaaacacgtgtacaggagtttagtcttcatttaattctgaaaggaaaaaaaatgataaatgccttttagaagataccatgtctacagaaaacagtgctggcctggccgtcaggacctctggtgtcagaactggcctcccaactggtcatgattctcggcaagctgttcaacctcttgggggtctctgttttctatttttccatctgtaaaacaaggacagttctcagtcatccctaccatatagggatgctctgaacctgtgaaggaaaggccttctgagagaaggatgctgtattggtccgttttcatgctgctgatatccaagactgggaagaaaaataggtttaattggacttacagttccacgtggctggggaggcctcagaatcatggcaggagtcgaaaggcacttcttacatggtggcggcaagagaaatgaggaagatgcaaaagcggaaatccctgataaaaccatcatatcttgtgagacttattcgctaccacgagaacagtatgggggaaaccaccccatgattcaaattatctcccatcaggtccctcccacaatacatgggaattacagatgtacaattcaagataagatttgggtggggacacggagccaaaacatatcagatgctgtatacattcagagtggcagttaaaaaggcaattctgtagacgtctcaggctgagcccactgcccagctcctgactcggtttctatggaaacaccttgaggacagggctgggctctgcttctcctccctcagttctattttactcaattaaacacatgtctatggattaccttctctcttctatacactacatgagaactgggacttctgcagtcaacattaaatgttttccttgcctttgggagactctaagttcttcttccattaaagtgtaacagatgtaaggagagggtggtcacagggcttcccctagcggaggtgggaagcaggaacttccctgtgggatgaggactctgggaaggtgtttcttcggggaggtgagggatgggtcagctttagacaagtgaagggggagagcattcccagcacagcgaccagcagaagagcagggccaagaggaactgaaagggatgcagtgcaacccaggatggacatgactggactggaacagcagtcaagagttttaagcagaaataacaagagactgcctgaccagctttgctgctttcaataaaaagccagaactgactccccaggagcaacctcttcctctcttcacacccacataccagggcctgggcccttagctaccagccttccataaaaatgaagagaatgatcagttgaactttaatatatgacaagattatgattgttccactcatagaacatgggacattaaaaaatcagcttttcattgtttaagggagtagctttatctaaggaaaatttctctgtcaatatgcaattgacagagaaaaacaactaagctggaacttcttaagaggcctttgacattacttttttttgagatggagtcttactctgtcgcccaggctggagtgcagcggtgcaatctcagctcactgtaacctcagttcaagcgattctcctgcctcagcctcccgagtagctggaattacaggcatgcaccaccacacctggctaatttttctatttttagtggagacagggtttcaccatgttggccaggctggcctcaaaactcatggcctcaagtgatttgcccacctcagcctcccaagtgctgggattacaggcgtgagccaccatgcaaagccaaggacattaacatactttaaaaaataacttttagatgtattttgactgataagttataaagataatgaagctgatcttaagaaacctacccttatagctgctgacagacctattgcttgtttcaggataatgaggttcccatgagaagaactgacactgcaacctaatattattgttgatatttccaatcctccacacatcgttaacatgccgcacggtacttgctggcaagcagactgtaaggatgaaagtcaggcctccctccccacactttttttgcacacaaatggtcagaacttttgaagggtaaggcattataccatagctaattgccctttctttttttattccattaaagatggcatttttaccttgaaatttagacagtcttgagtcatgtacaatgcgatcccgtgagcacttggtgtttctctagctgacctacttcgttttttttcaccttctaggcttcttgtcctgtttcttctttttccttttttagagttagaaggaaccatatctagttttattaatccagagatgggaagtaattggttcagaccatcaggtgttttgcctcagggaaggtttcctgcccggggacttatgcacagcgagctctcagcagagatctcaggcttcagtggggattcctgacttgcacactgggttgctgttgcacacagttgtggaactccctagaaattcaagccaggcaaatgtttttcacctggactatctggagaattgagttaaaactaccttggcctaaaaggtgcttctctttgttaggatgtttaagtaggatttttaatatttgcatactatggtttcaggtatcttttttcagttttcagagttaactttaagaagcagtttctgaaaaagatcaactttccaacatcaacagcatccctccaaatctatcttagatccacacactagaaagccttgcaacagactacaattcaaatttgtctgtcccctgcccccaattttgtttgttttctaagcttgtattttttggggggcgtataaatatttttgcaatctacaatgcccctcacccttccaaatgtgcttttgcagggaaacccttaagaagctttgcctcagaacccgatgctgtcaaaatagtccaaatgcattatgagagacaccaatatgctaaataatttcaaaccaccacttcccttatccttttttcacatcattcttcctttctctgccatgaccccctcaccttcctttgcttccatttctgtcttctcctgtatctcagatggtggttccggtgccaatagtaacttgcaaaaacaaacaaacagtgtgaaaattagtcaatcaccagaaaagcagtggggtgtgatgtgcaagggggtgcattttggacaccttttctcttccctacaagtgaagtctcaattactgatgtgaacagtgtttcttctatcaacttttgtgaacaaactctgccctctgatggcattatttaacaaaacaaatcagacttcgctaattccacaagtcaatttggttttcacatcttatttgtaaatgttgacttttttattcttcttagccaagtgaccaattcaattctgtgcccttcaaatctcttatcttttgacagacactgcaaactctgaagaaagcaccaaagtaaaaatcggtattagcagttaacaccgtctctgcctccttaaatacagcgcagaagttccatttacaagtgcgagttttctctgggttttgcctttgtgaaccctggctggactcgtcttcctaaattggcactttcttcctcatgtttctgcttttccctctatggggagtggatctctgccgctgcatgggccaccagctgtgttggcccatcagggatgagtataatctggactttccctcatttcctgattattccttactgtttatttcatgccttgtcaattcatcttcctctgtgagtgggagccctgacccaaatacccacctccttccccatttgtctcagcttctcacagcaaatgtttccatctctcctgccttgggacagaccggagagcagagcacagctgtctcttctgcttgtgttttgtgatggatggtgggcggaggggagtctagtcctgggcagaggagatggaagtgcccactgcagggggtgtgaggacagaagccagacctccccaccatgctggcccccactggaccttcagggactcttgttactgtgacgggctccagcaaagggccctttaacagccagcttggctgggcgcagtgactgacacctgtaatcccagcactttgggaggccgaggcaggcggatcacttgaggtcaggagttcgagaccagcctggccaacacggcgaaaccccatctctactaaaaatacaaaaattagatgggcatggtgatgggcgcctgtaatcccaactacttgggagactgtggcaggagaatcgcttgaacccaggaggcagatgttgcagtaagccgagatcacgccattgcactccagcctgggcaacaagagcgaaactccgtctcaaaaataaacagccagctctacccctctccgcctcagccactcctcactctgcccccaaaaggtcctgttcttttccatgatggcctttctctcacttcaaactgtcttcctccctcactgatcaagggtcaaagccctgggcctctggcctatggtacttttcaccctttaatgtagatagtggcacaaagataacctctgcttccaggccagaggctaaaaaggaggtaggcttttggcagaatggtggttaccaggggtggggaaagcaggaaaagggatttttttgttgaatgggcagagtttccatttgtgaacgtgaaaacgttttggagacgggtgataatgatgacttcacaacaatgtgaatgttttgataccactgaattgtacacttgaaaatgatgaaaagggcaaatatatacattttactagaatttcttagaagaacaggatatactttcaaaaactgattccaatcacagtaatctctactataattggagtacaaaacagtcttaattctccgggataattctggtcttaagtattgatttaatatgtgcaataattattacctcaggaagaatgcctttcaaattttgatgaaaatatacctaagatttttaccctagtgctttgtgtagctgtggaagaggtgactaatattatcgatgggttgattaattgattgaggtagcagtgtgggaccaatgctgatgaaaatgctcagaatgaggtgttcggaaatgcctctcagagtgagaaacatgcagttatgctttctagaaaattattccctgctgcagagcttcatcttctcatcaaaaaaaatgagtaaaaatttaaaaaatacgacacagtggcagagtccaaaggaagcccagaggagtgcttacagagtcggggaataggatctgtcaacaaatgtcgaagaaattggtaatgcctgctattttaggatgacttaaaagagagcttcaaagatgcaggagtaattgtggtgactgaaggacaaaagggtatgttgttgaacaaaaaacaaaatatggcctgactcttctactctctagtgtatgcactacttagaacctgtgatcagccgtagtcaccacaattttttagcgctccataaagatcaaattagagctttagattataaaatgaagggaaataagtcttaagataaaagccaaaggaatgtttgaaagaaacaacaaaaagttaaaagaattaaaattgaagttgaaaaggctaagcattgtaaaagcataggagatgcaaatcctttgtgtcaaatggttcaaacaaaaggaaatgtgcataaaaggaaaatgttaaatattggctgagtataagaaagacttttcaactgatacagtggacttcacagggaggttgtggaatcttctctcaaggcttttaaaaatcactgtatgggatggtagggtacaaaccattctcagccccaaaatgaaatcatgagtgagcaaaaggttcaggtgacccagggactttataaatagtagccagaaattctgaccagagttttaaattacttagaggagaaactgatgctgaaagaagatggaatgagggtagggaaattgcttccctactcaggcactaggacatgtgctatgctctggtccctgatggtagcatggtggtattctggcctcttctgtataacggacgtgtcaccccagattttcccaatttggcggaagctgtgtgtacagagggttggcagccggcaaccattattgccttctgcaaaggggaagatatatacaagacacctgtttgtcatagttagaaacttctagagagagcctactatattatctgatacttgacaatacattcttaagccatctaaaacttccattttggaaaattattctggaagtcttgcattggattgcaacgtgcaaacaagagcaagtcatccatgctcatcaagacttcccagtccttacttctctcgccattgatcaaagatggcagtggtgaggctgagagccatctcctgatgggatgctgtgcatggattcacatgattgggcatttctgctaactagcactagcagtcattcttcacatgaacataaaagaacagttgaggtttttaaaagcatgaagcaattttgagggtctaattaggtgcatatttggtatgcaagccttgtcttcctagtccctagctttattactttagttgctgtttatcatagatatgaaacccaatttaattttaaaagggggataaatctggggtgtgtacagtagttagctggtggttggcacagctaactcctgggactccagttagttgttcatccagttacatgaatgtgtatttctgagaactaacaagattcgcattgcaaggctaatctcacccatgagcagtgtgtgttccaatgtggtagtatttaagggctccagggtgtcattcatatgtcctggtgcctgaaattccactatctcagagttgttcctttggattcttctctctgaagattctttttaaaaatgcagataaaccaggaacaacattatatgaattcatacacagaaaaggatgggggcttgttattactttcctctgacaacagagccccatgatatgggaagaaacgttaacaactgagaggcacacactcagatgttcatttcttcatttggtcatcatttgttgagcacctactgtgtgccacacactgagctagagcgtgtcgttcctggctgcaggaggcccacagtctgatgggagaggcacacatttccacacagtgcaagagagagggcccagggcacagaggagggaggcatggaccctgggttgggcattaattgctgagggatgtgatgtgactccaggctgggttttgaaaggtgaatggagtctgccagctggggagaggcaggagcggggtcctgtcagtttgttttctcttagttctttctgacccctgacagaatgtccaggcacattcctcagaaggtcacgaggccatagggctagagaaccctgcaggcccctcaggaggtcaccagagcatgccctctgcccagagactggggcactctccccgaactcctcaaggctactgctttcaagcagttcaaagagaaaaagaaggaatcattaagagaaatccagccaatctcatcactctgcttcgggaagaccttgttcttgggccaagatttagtggattcatctaatcctttcatggaaggaattaaaatggaacacctggctatttgctttatttttatctgaagccacttgccatcacttgaggataattatgttgaattttgtttcattcttgatatcccacacaaaatttcctcaactccagaaatcacttttccataattaagagcatagattctagagccagattgcctggacccatatcctagttcagctacaagttatgaaccttattcctgcctcagtttccccaagtgtaaatgaggataattattttttctactccattgacgtgttatggggcttcagcaagctggttacatgaggtatttagaacaaggtgaatagcgagtgctcagtgaagactggctgttattcactcccttactgcagagcacctgacccggaactgtttgaattacaatatagaggaagtgccgtctcacccagcaaggcagtcagaacctaccaatcaactgaaacattcaccgagggccaattgtgtccctgtgggttctgttctagccattggaaatactaaatccaatacagagtggcccccatcctcaagaaacctacagcctggtgagaaaactagacaccatctcttccttaacatgcacaatggtgtggtttgtaccgtgctatactatgaaatgtcctcacagcccctcaacaggtacctggaacaggtatcatcctccccacttcctgcatgataataaaatgcttatcaggaaacaccgtttgcttattacgtgtcattggcaccttagcataggaggtcatctttcaataagttaacctagagggaaggggagatgttgtctaagtaggccctgttttcgtcctgcagtgatgggttgtaacgaactcaatgtttgtgttaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggtaagtcctgtcgcatgcaaaaggcggtctccccactgcctgaggagtgggccctccaccagggaaggttcactcttcccttcccaggccttctccttggcgcctccatggagcgtggcgcagagagggtgcttccgcaggaaggaggtcttggcgagagaaactggttccgggtgacccagatcctaatgaacatttcctcaaattattttctgattttgctttgctcagttgtctttagtgctaggttttgggacccagagcgttaacagtctttcctaaggagtcctgactagcactgtagtgcttaagaagaacaaaggtgttgggggggtgtctgttagagggcggcagagccccttctcatccctcagcccattcagttcccatgaccactctgggagggggaggtgttttcagatgaggaccctgagattctaaaggttgtgggatttgccacagtcacctctcaggtaagggcgcaactgcgaccgactgtttcgggtttcctgccttcacagtctgggttctttccaccacagcgcgatagaaccctgtcattgcaccagtaattgtttgctttctctggacttgttttgggaccctcagctccataagggatgttagtctcgagcccagtaattatttccgcagcacagaggttggtaacaaaaacggagggcggagttgcgcgtctttctttcagcactagaacgaaaggtacatttcccatccctgtgttgagaaacatgtactgaggagctgacagcctggtgcccaggaggctgaaatcctggtctctgtgtctgagagagcccttggggttcacccggacccatcctgggctgttgtcgggcacaagcaggaaagtaggaagtgttgaggatcagtcagaggtgttgttcccaaagctggaagatcgcccagagctgaggccactgctgatgtgccgtcagcagcagccttgccgctggagaaaagcaccgaatctcagggccacggccaggacggctgcttcctcatctcattttaaaaacataatggaagtggatgttcagaggctgggagcatttggggatgatgtcccctcagtgtcacgttcatgttttcaaatccatgattagagtagagaaaactgagatacagagaagttagtgtctcagccagggccagacgactacaccagacccacggctttccactcaccttcggtatttgatcaactacctaaggcttcagtgaaatattttgatgattttatttttatttttattttcttcctttgatgatatattttaaaagtggcttttccctttttttttttttttttttttagtttttatggcgaaaccctaatctatttctttataggttatgaggccgggcgcagtggctcacgcctgtaatcccagcactttgggaggccgaggcaggtgcatcacttgaggccaggagatcgagaccagcctggccaacatggtgaaaacctgtctttattaaaaatacaaaaattagccgagcatggtggcgcatgcctgtgatcccagcgaattgggaggctgaggcaggagaatcctttgaatccgggaggcagaggttgcagtgagccaagatcgtgctactgcactccagcctaggtgccagaccgagactccatctcaaaaaataataataataataattaaataaaataaaaaactataggttatgaatatgactatatgttttttatttggtgagacgtgtattcagagtatagaaacactacaagaataatgtcttctctaattatctttattatttgttttggatcttgattaatatatctatatgctctttaaaaacagcatacattccatttaatccagacaattttttcatagttctgattcaatcctcatgctaagaaagttagaaccaaaggacagcagaaaatgccaaaaaaccaacaatacagaaacacgtcttatgaacactactcttcaaatattaatgtaagagttaagaggaatgctctagcttcttccgttctgtcaagcttctgttgccatcctgtaaatcatttcatataatgcagttttcacacactcacacaaataataagctgcaatcattagagagaaaggtggcaaatgtgaggggaaaaaattatggtttggagtttccatttgttcgtttttgtttttgttttgagacacagtcttgctctgttgcccaggctggagcgcagtggcaagatctctgctcactgcaacctccacctccggggttcaagcgattctcctgcttcagcctccccagcagctaggactacaggtgcttcccaccacgcctggttaatttttgtatttttagtagaggcgggggtttcaccatgttggccaggctggtctcgaactcctgacctaaaatgatccacccacctcagcctcccaaagtgctgagattacaggtgtgagccaccgtgcccagcctggtttggagtttttttaaaaaggtcataaaatattgaaagttggtagttggggcaagtgttatatttttgaagagctggtaactgcctttgttatgtgacttgagagattgtagagagatttccctgcctggaattctgcccttagaaatttgtaggggctcctttccaaatgtaagcactgtgttcgggaagggtctatgtcagatgaggtcatcagatcgatccttggcaaggccccagcaggaaagcactgggctccccaaagcagcacagcagaaactcgggggggctcagattcaagagaggagagcctggtggtgggggggaggggtgtccccttcatgatctggttccagcctgacctggttagaaggctgtcttcttgttcaaaggatagtttgtttatttggaagaagatggtctattgcctttttttaatagctgaaacttttaattccatctccttggtcccattagacccttgaaataaaattgccccctttcagaagagtctgtcctcattttggcaaaggctgggtagtcagttgtttgactcaaaagagggtgttgtttgtgtctcagcggggcgcaggcagctgtgaggagcccactgtcccctccttgccggccacccctcccctcggaggcccttccctgcacaccgcatgcccacagggtcttggttgctggcctgaaatgagtctgctgatttaccacgtcattccagatctcagtgctctaaagccccttgctttatcccattgccaaaattcgggcagttctgcccctggccctgagcctcacagagctgcttagcatacagctgggagtggccagtgcctgcctccaagcctgctctgaggatgaaataatatcatcttgtgaggcagggtggtttggaagaaaatggaaagggtaaaggaatcctaggatttgcaggaaccccaaagaggatgaggactctctcattttacaggtgtgggaacgggcctgggattcggggtggggtaaagtccctgccaggaggagaatccagacctcctgattccacttcggtgctgtttgcccactcagaccttatgttcctgaagggtaaagggagaagaggactgggccgagtcccacgcttttgaagcagaatcatttgatgtaacatcgtctctccatctttacaaagacatcgctgttacagcaatttgttttcaaatattcaagcatcttatagctataccttattttctgggaacaactagcttttctcaaactttctatttctttccaaactcttcttcctttgcatttcctggaaaatcatttttaaataaattagtgctcgcatagatgcaagttcaacttctagcagccatactgtgaaaaggcagttgtcttaggctcatttctttttgtccagagctggaagctccccagtgtggaggtggctgcctcctttttgggggtgggagtcctctgaacccaggcacacttggacacatcccagcacctgagactctaatccagctcatgtccagcctcctttatttccagggtagggaaatacctggcacacagaccatatttaatgaatggtggaaagctttttctaatgaagagcaactgttgtcatctccagatgagggagagcatcttattcctgctgaagccactcccttttccagtcttggagcttccatgaaagtggatttcttatgctgtcattttcaccctgctggttacacatcaagttctcaaaaatgtcaaattgggctgctgccctaaccattattgccacttcactaggccatcctccatttgaagaataggaagaaaagggagaaaatcttcccagagagaacactgcctctgtgacactgtttattcggcttggctgtaaaatgtggaaagtaatgcatgtttaaaagaaaagatgtgtaatttacagcttcttaattcataaagaattcagtgaatcatgttggccctgttggattctggagaagtctgaaaattggccagagtcagcaaaggtttttagaaagctatgcattttaatctacttgaaagttttggactctgaatgtcctttaactttgaaagtatacatatgaaataccagcatgtggaaatttccactctgtcccaaccagctgagactgtcctttgagcaaaagaaacctcaggcattgcctctatttctaaggcattgtttttcttaaataaataaaatgaagaagggctttggattgtctgctttttaagtgtttcagtaaatatctatgttttccaaatacgtgacggtaagaaagttacgctcttggtcttcaactagttcaaatttagcttccaattgtaggctgagccaggggcccaagataaggtgtatttatattcccttctcagctgccttagctgggtgacttggatttagcctctgtgaaccttgcttgtctcatctgtacaatgggaccatattacctactttgcctgcattacagggttgttgggagagtctattgagcattctacacagaagtgctttggaagctaaaactctccaaaacacatttcagtattgatgctcccacccccttggctccgttactggctccacatgacctaaaggggccatttttcctccagacctggagctcctctgctcagggagtccatagaggctgctgttttcctggggctcaggacatactgggtcctgaaccctcaggtctgcttctgctgtggtctcaaattgcctcactagattccttcccccgggaacctgtttctaaggaaactacttctctttgtgttcccaacagctggagatgtgttttgatcccagcccgctggcatacatttgtcttgtgtttatttacttggaaacctaagctcctgtaggccctgggttggaaagtcatatacacgcgcactctccctctccgaggagtaacgagaaaggcacgccagagccgaatgctccgccaggctgatgcaagccatccaggagcatggaggaccaggaagccccagcttcagagatacgctgcgaaatacatttgtcctgggtgtatctaaagcaggagtcacaggtgattttaggaccaaaggccacttctgggggttagcaagacctgagggtatccctgggagtttcaggcaaacagaaaacaagatgggtgaaggagggggcaagggaggagaggagggaccaacaaagggattttggagctagaatagaatgctaccccctgccacctgtgctaccaccaaacggcagccatgtgtgtagtgtgtagcaggttagcatgctttgcctcatgttagggtgtccgccctcacagcctctcctggcgtaggtatgagcactcctcattcccctcttatgaaccaggatggcgatcccagagaggctgagtggtggtgaagatcaaaccacaaataaggggaacttgcatgaggctaccttagttacaaggggcttacgagtcacccaggttacctctgtatcaggagccacggggcaggagaactgtgggaatgaagacaaaaggattgcaggccagtgaaggctaggaaacgaatgccaggcagagccaggccccatgggaagcacatgaaccacagcacagctaagccacacggaaaccagaagttgttgagacctagagccacttccagcacccaagtgtcagtgcccaggctgcccaggggttctcagttctcttcagccatcttcaaagacaccaacggtgggttgagcccctcttatgcttcacacctctccttctaccatctcatttctctagcccagctggaaagggctctccacttttaaggacttatgtcattagattgggctcaccccgataatccggcatagtgtcccctctcaaggtctgtaaccgtactcacatttgcagagtcctttttgccatacaaggtaacatattcacaggtcccagggattaggatagggacaccttcgacgtccattattttgcctaccacagtgtcatcaaggataacttagcaggggggagaggggactgtggaggggacatgggtgtgacaggcattctgacacttggctatgccacttataagtgctcaccactgtgcattctactatgcagtggcaccaaaccatggctttcctggccctagtctgcaaaactaagtggccagtcatacatttttttttttcttctactagtgactcatccaccaatccatccgtcattcgttcattcactcaataaacattgatttagtactttctgtgtagtaggagctattgtaggaactggaaataaaatgttgagctaaaatggacactgtcagtcctcatggagctcacagactgccagggagacaggcattcatcccaaaaccatacagatgtatgtgaaatagtggctgcatcacatcctacatgtaggatgtaggctgcatcctacaatgcagagacatggcgctgtccaggcattgaatggggcagttggcaagtctggaagtcagagaagtgttggttgagctatatctgaagggaaagaggagaaggaagaacacccaggcatagggcacatacaaagccctgtggcagaagggaacacagcacggaggaagaaccagggaagctgcagcagggcgagctgaggaagaaaggaaagagctgggtgcagtgatgtgggcaggcaggtggtgggccccacagagcctcccagaccatcttaaagatccctggggaggcactaaaggacttaaagcaaaagaggcatgtttacaggacatcctgaatcttttacattttgtgggaggaatcactttggctacaacatacagagtacagaagggcttcaagtcgatgtggatagaccagctagatagatcagaggctactgcagtgatccaagtgcaagataaaccaaggaggaagtttttatgggacatcaaccatgtgcaaagagcagctccaggtggggtcaggggcagcaatgagggagcaattacaaagacattgaagactcattgctgtgcttccagttgcttgccgcctagttagcaacagaagacccaaacttgaaaagcttaataccaagaaggagatattaataatagctcagtgcagccatataggacttgtcattggctgggatgtgttaaattagcaatctgaaaattgcggggaggaacgaaatcagcaagagttggggttgttgggagcggcttcccagaaaaggagaggcggacagaggagaggtgggtgctgtctttaggggtagaagaagatgcagcagaagtaaggctctggggacagcaggaggggactgttccaagtgaagtgacactttagaaagtgtgtaaaagcctgagagcaagaggctcactctggtgaaccgcctatttggcaggagcggagggcttagggaggtgaggagcttgggtacagtaaagtgtttctccagatgtcccagttgtgggggaagcaacgctgctctgatggctgccaaggcaggtttgcctgacctgctgtctccatgcaaggtcccatcaggagcacgcaccgcaagggccgccagagcacagccaggtgcatccgccggccacctgtcagctgagctcatctgctgtgagccccgcccctcgctgtgagtcagcggagctgctgcagctgtgtcccgccgctggcgctcagcgctgcacccctactggggcaggtggctaacatttattaaggcggtggttctcagccttggccacttgtggaggctttaaaaactactgattcctgggtcccacacccgaaagttctggtttaataggtctagggtgcagcctgggctttgggattttttttttttttaagcttcagaagtgaggccaatgtgtagctgaggttgagaactactgaggaattaacaacgtatccgttcctgactgtattagcaggagctgttttcactgagagaagcaccccctgaatgccttatggaagcttaccttcttatcctctgcccatttggaaaaacctgcatttgccttcttccccttagacatttttatttgttaggcttttcattggcatatgcaaataaatgtcattaaagaggtttgatgatatagtgcaatattatgtgttgtatttatgaatattctataaatgtcttaagtcagactttcttctaaagttgaagtaaataatatttcttatccagaaaccaaggtgtgcattatagtatacatttcagatctcactttaggaagccatgctttaaacagtaaaacagaatgagcactttgatgaataaaatattttagcatctggacatctttttatttaggttgacgaggcacttggagtccattgccatctcttcaaagagacatgtgacattctttaaatgcaggccaattcatacaaagacatgtaaatgctaaattaaaagatgtgggtgagtagaactacattttaaatgcagtcaggaaatgttctctgaatgcagtcagaggtcttgctattgaaagaagcgatgggatgaagttttatataaagtaaaaaactaatggctccatttaactttgttaacattttgaattttataccccacacttatttttgcagaagttggcatgcctctatagttgtcctcaattgctttgccatttgtaatatttttttccctacccagctgttttacatacacagtataaattccccaaaggctgaatgatctccaaacgtgttcttcaaaatattttgcaaagtctgaagacaggaaaagtaagtgtaaaacatctaagagatttgttggaatctcagcttgaattctaattgcgagtacttatgaaaatgtcaatattaacatgaaatagctggcagtttttctaataaatgtaaattgaattagatagtgtgtaattggaaaaatacttgcttcactcaggcttctcaaaacaagactcaggatttgttagctgcggcagccttgccctctaatggctggaagttgaaggacaggactaaaatacttttgactataaggaggatggaaactaagaagagggaatgtctgaccatttgtcaccatattgagggcttcttcccaaagcatggggcatgatgtcgatgttagcatgagcttattattaaaaggaggtgggtaggtggggagccaaggccatgctaagtatcttggagcttcagaataagcttggatagaaacaggtattatagatgcctaatctcctgaaatgcagttgaaagttcaaacttgccttataatattaaaaaaaaaaatacccgaacaagttatacaataaataatctagcctggacattgtgatggtctggtttatagtcattgagatttgctaagcacatgtaacaaacaacgtttgttcccttttctgattgaccaatgagtgtttcagacagagtagaaatgataccagtagaagtggtttggcagaaatttcataagaagtttgatttcatcccatgttctttctgggaaagcagccaggaataaatggaacaggtggggtcttaactggctacaaaatcacacagcctctagaacaaaccgctttttctctgatcctaaacccatgcagatattcacagttgaatgaaagaattttaaccaaagcttactcaatttcatgacaagcaaagcttttaaaacaccgatctgcaagaagccccagccgcctaatgggtaaggcattggctcctaaaaaatggctctgcatttcatattacaaagtaaaaacacaatggaattgtatcaacattcagctaaaagtttgcatatgcatctccctttgcattagaggtgaaataacactggtttgacttttatagtaagactgctgtcccgttaccctctgcagagcattattcactcacttccgggttttgtaattaaccacttggataagacttgtagaaagagtcagcagatgtataagacaaagttatcaagttcaacaactaaaaaggaaactttgatgataaatgtcaggtataatcgatggcattctatgtcttatcactattaataaaaaccctgtgagattaagacaagggtcctaaaccaaggcaataaaattagccgagaccagtcttgatgaccgctcatctttatttctcttggtaactattactcaggtatttcttttttacattctcatacattgctttttaaacccttcaaattatttcatgtctgtaagtcttatgttttgaactaaaatgtaacttgataatagaatatcatcttgtctctcagtacctgtcacagctccctgttaaacacccaataacagatgcgaggatgtgtggagctccaacgatgtttgcctcttttccctacttgcacgtgcaatttcaacatattctgaacacctgtaatgtgccagatactgtcaacctgtctccagttcatcttcttccaatccatgatcaaagtgtccagtgtgtatctgactttgtcattgtcttgcttaaaacactcctatgtctttctgatctttaaatgtaatattagctatcatcattataataataatattattatttgatcaaagagcctcacaactgcatgtgaatttacagttatctcaataaaatttcagttagaaaaaaagcatcatgcaccaatagagaaaagataggtttatgaataaatagtgtaggaaaaattagaccgttaaggaacccaacatacatcaaataaattcagatggattaaaaaggtaaaatgtgagaaatcagaaggatgtgtatctgagccacggaggctgtgagttgtctatcctgtggaaggagacatgactgagctagaggatggcaaagcatataggcaatggaagaaatcacaaaagaaatgaattttagatttgtctttagataatttaacagtttatttcacaaaaaggcattataggcaacattaacaggcaaatcgaatggagacaatatttacaaatatgacaaagaatttattcttaaagatattaagatataagaagtcttataaatcagtaaaaaaaagactaattccccattgaaaaattacaagtaaaattccggataatctaaaaaatgctcagcctcatctataatttttgaactgcaaattaaagcaatatgtcacttttaaggtattaaactggcagagacttcagaaattataagtagtggtatgctcataaatgtttaataaccacctctggcgggggtggggggttgttttgtaactttgccaatttctgtggtgtcaatacttctcaccatggtgatttcaaactacgaacatgacatcactgaatacagcagagttaagagatgggcatttgcctcttataagctgttactatctggctccagcacatttccaattcatactctgctgtcaagggtacatcagaatggacatgtccatgtatttctggtatcaggattccgggagcgtggtccatcttgtgcatcattcaattcctccgcccttcacctgcacaccatgtcatcatacgtttttatctttgccaggctgagagatgagaaattatgtgtcagtaggataagttgcatttctctcgttatgagtgaagttgagcatcttctcacatgtttaagaggcatttgtattttcctttctcatcttatcattgcccattttgctaacattctgatctctagaaacttttcagaaaattacagaaatttgcccactatttttgatataaattgcaagtattgttttcctagttagtaatctcttttaactttctttgtgatgttttttacatgcagaattttatttctttgtggtcaaatttatcaacctttttctttttatggcttctgagttttgtgttatactcagaaggatcttattaactctgaaactataaaaaatattctccatggtgtcttctagagttttgttgttattcatgttaaattaaaatctttaatacttctgaaatttattctggtgtcaggtataacatatcaatgtagtttcttttttttccagatggctaacaaactatcccatttatacaataatttgtgttttcctcattaaagtatcacctttattatatgagaaattcttggttttagagggatctgttttttcttttggcttttattttgttccattaatgtgtatctttatatacagaacactattctatatatttatatatatacacactgttgtaacctattgtataattacataatacatagttttattatgtaatatgcaatagtataattatataatatagagtgactatttatatatacattttattatctggcagggtccagtctttcctctttactcagctttttccccaattgtcctaggtctttgtctttgttcatttttccttaggaactttaaaatcagcttgttcagggtcgggcgtggtggctcacgcctgtaatcccggcactttgggaggccagggcgggcggatcatgaggtcaggagatcgagcccatcctggctaacatggtgaaaccccgtctctactaaagatacaaaaaaattagccggacgaggtggcgggtgccagtagtcccagctactcgggaggctgaggcaggagaatggtgtgaactcgggaggtggagcttgcagtgagccaagatcgcgccactgtactccagcctggatgacagagtgagaatctgtctcaaaaaaaaaaaaaaaaaaaagaaaagaaaatcagcttgttcagccgtccgctacccccaccccacattcatacccagaataccctgtgtgttgggtttactttgagctttagattaaggtagggaggattgacgtctgtatgtggagtcttattatttgagaatgtattttgcctttccatttgctcagaacttctgttatatctctccagagttttaaagttttcttcatttagatcttgcacatttcttaagttgatttctagatatttggtttgttgttgttgtaattttacatattattactgttactaatttctatatattacctttaactcagtcaccttagtaagtgaattctatgtttgtcaagaaattttcacagattattttcagtttaccagataaaattatatccccaggtgataattttatctttcttttttctagtttttataactcttatccatttgtttttgttgtatctctagaacagtgttaaatataatgttgataaaaatgacccagcaatcccattactgggtatatacccaaaggattatacatcacatacattttatagtatatagtctttacataggctgtaaagacacatgcacatgtgtgtttattgcagcattgtttataatagcaaagacttggaactaacccaaatgcccatcagtgacagactagataaagaaaatgtggcacatatataccgtggaatactatgcagccataaaaaagaatgagttcatgtcctttgcagggacatggatgaagctggaaaccatcatcctcagcaaactaacacaagaacagaaaaccaaacaccgcatgttctcactcataagtgggagttgaacaatgagaacacatggacacagggaggggaacatcacacaccggggcctgtcaggggttggggggaaaggggagggagagcattaggacaaatacctaatacatgcggggcttaaaacctagatgacaggttgatagttgcagcaaaccaccatgggacgtgtatacctgtgtaacaaacctgcacgttcagcatatgtattccagaacttaaggtaaaaatttttttaaaaaaaaattggtttctcatagaagtcagataattgaagtaaaagttaaattgctaattgccaaatttcgctcatttctacttttattctactagagtatgatgtctaggatccagatcctttgggatttcatctcagggagaatataagcagcatcagtctcaacaactagtaatagaaaaacctaaggaaaaagacaaagattatcatattaacacccctcggccccgcatgcacctgtaacctacgtgtcctttttgataacccaccacttccagagtggcttcattgtcaaccacctgtgtcaccagagtaaattcaagtgtgtcctttcttgaggtttctggactggatgttgtcttgtgtcctttcccatgggtgtggtttccctggcagtcagttcctcagtgaccacatttaacaaattgtaataaatgcagactagaaccataattcacagttttgcaatacaaaggaaagatgaaaaacaactggaggcttaaagtcctgtgagatacccattttaccttgctttaattacggcagcagatgtaaatttgatttgccccaagcctaggtggtctttggctagggctcattcacctctgacacagagaccccacatctccctgacttctgttgaagaagtactgggaaggtctttgaatggaccctgagcacacttgacattggaaaagggagaaatctttgactaagaccctgtactttgagcagttttcagtccatccattcagctacaaatgtggaagcaaatatgccaaggtccttgaaaagaatgttgatgcttgattgcacgatgtttccctttaaagttttggccttgagaacttcaaagtgatgacactgttcttcctgccatgcccgctcttagctctgtgtggtcagtaagcagcgactcttatttttcttttatttttggaaactaagttggagtgagggcataaaccccctcacttgaattgttttggcttaagatgtatctgagattttaactttgttatttccagctgcttccctcattaaatttaggtcattaatttcataaatcagcatatgccttttacttttatgtgcaaagcccaggtgttaaagctcgagtaactctttgtttggaatggtgggtttcgtatctggcccatcccaaatgggcttattgtgcctcacaatatttctttccttccctaagtcctttggtccttcatctttatcaaggactcacagtctctcttgggtatccgataagagtttgtacggtcagtttcgtacatcttgcctaatctatttttgtccaatatgattgcttgttacttaaaactttggaataacctacatatatcacctatataccatgctcctgattttttaaaaagagttatttccttaatctagtcagtccaatcagcagtgaaattctttttatttttttcttagaatgtctctcagatgtccccatcttctctccacggctgctgccaacaccacagtctttaacttttttcaactctcccatacctcctaactgctctcctcaaattccagacattctccctctctttcagcttttgcatagtgctgccagattagcctcccaaagcagcacttcacatcatatcgtttaatttcttgcttaagaagcttggtgacttttgcccactgtggtgaattctacaggcctttctctgtctttcaaggctcttaacaatctggacctatcctgccagccctgacatattgctttcccaaataaacgctaatccaaccaagcttctgacatcatctttcagaaaaagctcatcctcatctctattcttgtccttatgctgataacctaagttgaaaggccttttttgtctttttcttctttttttgagacaggatcttcctctgttgcctaggttggagtgcagtggttgggatctcagctcgctgcagcctctacctcccaggttcaaaccatcctcctccctcagtctcccaagtagctgggactacaggcacaagccaccacgcctgactaatttttgtaattttttttttgtagaaatgaggtctcactgtgttacccaggctggtctcaaactcctaagctcaagtgatcctcccacctaggcctcccaaagtgctgggattaaaggcatgagtcaccacacctggccggaaagaccacctttgtcttttttctctccacctcctatccatcgttcaaattctcatctgcagtctctcatgatcccagcctttgagatgttctcccttttctagaattccagttgcccatgtgctttacaccatttctttttcctgaagtcacactatattccaggtactgtttagcactagaatcctcaacttaatcctcacaatgatcttatgaaaaggtgtgactgtgatcttattttagagttgagaatcctgatgctcagagaggttaagtaacttgcctacagtgaagccgcctccattaagtgataaaaccaggatgctcacccaggcagacaggcttcagaaaccttgttcttaaccactatgccaaactgcttctttttgtcctatgtgacactgtcattgattccttagtccttcccagcctgactgtcagctcctgaagggcaggtgccatcttcactgctttatttacatcccattgcctccgtggagcttattgcataggaaggtcttagaatttgctgcatgtgggtagggaactttcctgtctttttcacctgtacttcttcagcacctaaacacacacacagggtctgacacataataagagctcaaaaattattagctcagtaaatgactaagtgcatacatatttgatttattcacagtttgaaaaatatatgatcacatcagtgcatcctttgcatatttttcattcatataaatgtgcatatctgtatttcctgtgcaagcatctccggtgcctctgggtcactgctgttgattaagctggacacgtctttctaggccataaaatggatgtgtctttatctgtttgtgctgctgtaacaaaatacctgacactgggtaatttataaagaaaagaaatttctttctcacagttctggagactgctaagtccaagatcaaagtgccagcaggttcagttgtctggtgagggcttctgtctgcttctaagatggttcttctggaggagaagcatgctatgtcttcacactgaaaaaggcagaagggcaagcgagtgaactccctccatcaagccttttttgttttttttttttgagatggagtcttacactgtcacccaggctagaatgccatggtgcaattttggctcactgcaacctctgcatcctgggttcaagtgattctcctgcctcagccctccaagtaggtggggctacaggcgtgcaccaccacacctggctaatttttttatttttagtagagtcggggttgctccatgttggccaggctggtctcgaacacttgacctcaaatgatccgcccaactcggcctcccaaagtgctgggattactggcatgaaccactgcacccaacctgtcaagcccttttgtaaggccacctagtcccattcacaagggaagagatcccatggcccttcacctcttaaaggcccacctcctaatactatgacattggcaacacctgagttctggagtgaccacattgaaaccatagtaggatgctttgtatcctcagcaaagttaattgttgcttgttcaatcttacagtttctacccagggcacagagggtctcagagtacatcactccattatagctgatgaaattaagctacaccagtttactcaaactaatacgttattatcaaaaagaagcacttctgttatgcttagcagccttaacagtgcttttaaacttgaggtttatgagcacttgcttttagatactaatcattacaggtaagtaaaatgttgtcattagtccaacaaatcttcagaatttaattttcaaaaaggtttccttttcctgggaaagctcttctaaactggggcaagatattatttgtttcattccctgtacctaaaactacttgggcctccctttttaatccagtattgatttaaatgtttttgataaaagacacctcatttaattctctctaaatgtgattagagaaagtcaggtttctgcagagcacagtctgtatttaatttatttgcaaagccatattgagcactgagaattttaagattcagtcaaaataaataattttacattacggcatcagttaacaccaagttttcaaagggcttttcgctttaaaaaactcaaaacacctcattaagtcaaccgtcttccaagaatgtgctattcaccaagatagccttattagtccctttttgcaagtgacaaagctgtggcaagaaacaattaaacatcttaccagcggctcttggaatggagtcttactgggtaggcccttgacctgtgagcctaccgtcattggcacagtagaataggaggctaggaacaaggcaggaatgaaaacaatcagaagcaagaagccaaatggaagaacaggattcgtcatcaaggtcttttaacatgggatcccatggagttgataaaaggaaaaaaaaatcatacctcaattagtcataatatttcaaggcagaaaagaaacatagaggttatctcatctcagccagtcatttgagttgttacggctggagcaggagggttggaaatgtcacacagagttaactcctgctatcatgctgccagcaaaggctgagccctatggggtgtttaccaggaaaagcgaatgtaggaaataaaatgtcaagaagaaatttgtgaagtacaagaatgtctgaaaagagcgtatgttaagttctgaaacaaaatgataaaactcagaagtgacagctgttacctaaacttttccaatgtgttgttcaccaatctacttctgaagacagcctagtgcaacctcattccttgtccagaaaaggaggacgtagtcttcaaggtgaccaaatcaccataggagaccctatcaccaccacccccacatcacacagtgtacacatgcatgtgtacaaacacacgataacatcgatgccagtggctgaaatttgacttgttctttttttaaaaaattaaactgttcttcctgggttttttcctttaactataaataaacccggtgggtctggcattttgttaccaacatcttttcaggaacctacccatctgcaactgattattatatacatcatgtgcataaatgtttagactacttatattcagatatggtcaattccttcattcttcctttcaacaaatgcacagcacctactctgtagccagccctttagcagatgttgagaatgcactaatgaaaaacacagatgtggttctagccctcccagagtatataatctatcagggaaaacagacattaaacaagtattgggagagatgatcaggctgtgggaacaatacgtgcataggtcaagggtcccaagtactgcaagaatctcatatggatgagaacaggggtgtgatatgaaagctggagaggtgggcaatagatcaatcatcaaagcccttaaaaagatattctaaatatttgaagctttatgctaaagacaataaaaagtcctagacatcatgacatgataggatttgcatttatttatttatttttaattaatttgttttttagagacgggatctcactctgtcttgcaggctggagtgcagtggcacaatcatagctcactgcagcctcaaacccctgggctcaagcaatcctcccacctcagcctgccaagtagctcgggctataggtgtgcactaccctagcgaatggggccttgctgtgtttcccaggctggtcctgactcctggccttgagccatctttctgccttggcctcccagagtgctgggattacaggcatgagccactgcactcagccaagattttcatttagaaaatcttgcaaggggaggatgtttggagtagagcaaaataaactattttggtttgaaataggattgtcatggtacatgagaccaagaggaatggataaagacatgtctatgtaataagatcaacaattgtttcatgagtaattggctatggagctaaaggatgaagaggcgttcaggatgattctaggtttctagttggagtaagctgatgcaaggtactgctgagggtagggaataacgggacggatgtgcaggaaaaataaattctgctttggatatgctgagtttcaggtgcttgcagtacatatgaatggagacacccagcaggcagaaaagtgggctgtgctgaatatgtggaattggaagttatcagtatccaaagagagggtaatcaatctactaaaatattctgtgaaggttgagatcatgtctggaacaatgttggtgctcagtaattatctgctgaagttgttgaattagagccatggggtgcgtatcagggatgaggataaaagagcccagagtcacccattttttagcaccaactgaggactttgaagcaaaacaacaacaacaacaacaacaaaaactgaacaagagtcccaggaagagtacaatatagaggtgtggtggtgtcagagaatcagaggaaaaaagttctgagaggttcatgactgtcagaagcttcaaggaagaatatctaaaatgagaatagaaaacgtaaccattagatttctactaatcttggcaagagcagtttccatttagtgacaagggtagaagcaagatggatatgcagatggggcaagaaagatgtggaaaaaatgaagatagtggtggggaagtctggtctgcattggcctggtgaggcatgcagaggtatgcgtgggattgtcacgttctctttcaggatcacttaccaaaggaagaggtaggtcctcagaacctaaagcgcaaggagattccacattactcttctcttaaaaaacaaatactattgagcacataccatatacacaacctaaagggcttcttcaagatgcagataccaagatgagattggatgtgcaagagatttattgggggaaatgcctgtgaagggaaaaggaggcaggaagagccatcaaacccatagtagatctgattcctataaagaacaggggaaggactattgggtaaggagagcctcagaacacagtgtagttttaagaaagtttcagtcaggccaaggggaagttgtcagccaaagtcattcatcagaggagtcctgtgtgttgcaggaatgggcctgccttagacaacttgtcacactagtcactgcctgatattagcctacgggaagcatgcccttggcacaaatgaggtgataaaatcgaacaaagcagctgggaccattggttacttactcttccagcaatgggagagattcatggctgccacatatgtaatatctcatttaattcttacagcatccccctaagattggtattattatacctgttttgcagatgagatgccaaggattacagaggttaagtaacttgcctcagttcataccactagtaagtaatagagcctggatttcagctagtggtatgttagagctggctcagactaatcgagtcaattttttatttttaggaattgcgctagtcagttgacacaaagacagtagcttgaaaatttggccatataggagtatttacagcatggaaatctgcatatgctacacatcagtcctttgtttgtttgcttgtttctgaaaagatggttgttaggcatttgccggtacaccactgatttgaagccaggtcatctgatgctacagctgactctccaacctctatgctacagacaattggcttcatgattccctgacacatttctgatgcaaaaaattcctgaaaccaccctcctcctcggaatccctgtggagagcttgccatgccctgtattttgcttttccctgaattgccgtcatcatcatttttatgtctccctacctggatagaaagttcctcaaggacagagagtgcaatcactttatgctccctgtctttgcagtgtcctgcacaccacactgctcagtaactattcactgttgaaggtgatgctgattgatatacatcatcaccctactggtgattaaggattggtaacatctacaaaataatacaaaagattgtgcttcatacagatgtatctttctgaatcttacattttataatggcagacactattggaaaaatgtgttttaacctcaagatgaccatttaagagaactgtgacatccattacagcccagggatctggttgatgtgcttcctgcccactcccacccacaaaccaggagatacattaattacttgcctccctggccactctcagtttattgggaaattgtttatcctcccagcttgtctagaaaataaaatatgcatgctgcttggaagcagggaggtatgcagaagcttccagatctccagactcttctctcactgcgtcttggggcctgagagcttagctctgcaaagaacaacccaggaagggtcaggatggacagggcactgcagtctctgcaccaagtggtgtgccctacatggccctgagacttcagaagactcgggtcttaggctcactgcagactgtgtaacgtgaataacaaaaaaaaaatttctactgcacatgagtaagctgcagaagactttgtgccttgaagcttccttccagatgaaaaagcgggtctctcatgaaaagaacgcttgccttcaagaaaagctctttaaaatcttttgacatggcaaaagaatctgtaacttgccacttgtacatcacttccaaaaatgtttcttccttcttaatttattttaaaaattttgtttcaggacccaccgtgtgacaggcacattttccaccatttgggaaacatcattgaatagaatgagaattcctactgccatgacactaacactgcagtgacatccgtagcgccaaaactcttgatcttcttcatcatgtgctttcattcatcagacgtgtattcgttcagccaaacagacatgagcatctactttatgccaagctcagtggtgagggctacagcttcaaaaacagaatatggactatgctctcgaggaattgtctaaggagagaggcacacacagctagggttctaacatcagagctttatctaggagcaccaccagaggtgtggggagctcgtgtctgtgaggcttcctggaggaggtgttacctcagttgagtcttgcaggatgagtacaaggtccaagcagagagggtgtaatttgaaatagcttgatacagaggaggaactaaaggcagtgaagggtgctggggtataaagtttgaggcaggaggtagcaagaactgaaacttgacattgaacagttaggcagagcctgcatcatgcatcaattacctggtttactccctttattcaaaaaacaggctgggtgcggtggctcatgcctgtaagtccagcactttgggaggtcaaagcgggtgaatcacttgaggccaggagtttgagaccagcctggctaacatgacgaaaccctgactctactaaaaatacaaaaggtagcccagcatggtggcgtgtgcctgtagtcccagctactcaggaggctgaggcacaagaattgcttgaacttgggaggtggaggttgcagttagccaagatcacattactggactccagcctgggtgacagagaaagaccctgtctcaaaaaaaaaaaaaaaaaaaagcaaaaaacaacaatagcaacacctataaccacaattaactttctttcttgtgttctccgaaagattggcaggaaggcagatgaggatgtttccctggtctctaatctgaagctgtagattcctacaacatgtaatactgtcccaccctccccacctcttcccaaccaaatgccaatccactccgcttcatcatttccaagtccacccttcaaagtagacttcgcctattcccaaggatgcagttccatctctccttctcctccttgtcctctgctcctgttaattcactgatccactgggcagaaactccaagtctgtcactctctcccacccttattccaatgctcctgtgccaacaaggagtgacccaagcagtgagctttacagccagcacctgctccttctggaatggcccttctcagaaatgcaggaacctcagcagtccttcctcagccaataagaatgagataatagaggttcaaaggctttgaaaacacaagaggcacataattcagtgtttttgttattatcatttgaggcctctagacttctgaagaagctacttctggtctgtgagaacttcatgaaggtggaattacttgacttcagtaaaggcccccccccaccccccgcaaatgaaaaccttgattaaaaagtttaaaaattcaaaaggaatggtgaagatagggaaggactgagaatgaattattaagaggttggaaatttcagagccttcctttttgaagaagctggctgagttccaaaagaaatccaagtcctgaatttctattacttctaacaaactgcattagcatgttaccaacacttataaactgacttaaaagaagactagggcattaaattaaaaagtaagccatgagactattaccaaaataaaaggaaagcaagagggatttgcctttgtccttgttcagagaaactgaaaacaaacttggattgcattaacagaagtatctgttctaccaactgcaaaagtgccaaaggagatcatataggtccccaactctgtcatgagtccttccaggtgaacagagaccttgttaaattaaggcaatcacattcagcctcccaagaagggagcctataaaactgagaagccaaagctaatccagtcctttcccattctaattaaagaggctgaagggcttgtctcacctaacactgtctcatcttcatgccacttcctcaaataaaggagtcagtgagaagttaccaattcacatggtaaataacaaactctcctgagttttttggataatcaaatgagttttcctttgttcattccatccctccccatttggaatttagatggaagaatgtctaagtcgatgaaaatccaactaaagaaacattggcctctttgtggaggaatctcacatttaagtacaaaaaaaattaagcgtttaggggaagaaagttcaaagacttttgcttcctttgttcttttaaatattttatttggagttcggcattacagtcaggacaacctacagtaagaaaaccaggctttcgtataaaagttactgaaaggtgctatacaccaacatacttttatatctaccatatttttatattctttatatctttcattttaaaatatttatttggtgtggcaggtttatggtagctttttatcgtcctctttttgcttggccatattttatataataaacaggaactggttttataatagaagtatttgaagacaaagaataagatttgatgccatgagatctttctttcttttaaatccaaatagttaagcagatcaacctatgaagagcgagaagccaaaggagatgtttcatgataaggtaactagatggtatttttccattagctgcttgacctctttaacgtgacaccagtgtgttttcctggataaaattacaatcccagatattcagacgttcagattcatattttccatcttagcccacgaaagctttactttggggattttgcagaaaattctggcttgtgtttcagtcatttgccttttctctgtggaagccagcaggaaacagtagcagatcctgacaatccccagacgtcccagggaaagtgcaaagaggctcggcattaattgattaagaggttctttcaaagcgcaacttctctctaaaactactcactttaaatcatgagactagctgcaaactgcaatatttataagagacataaatattgaagaacacagtgacactctcctaggagcaggaactagaagtggaaagagcagtgttccacgtagactcagtaagacttggaagctgatcgtatctattcattcactcaagaaaatattggctaagcgtctcctgtgggctggcactctcctaagccctggaacaggagtgaacaagggagacaaagccccacctgtcatggagctgacatcctagtgaggtgaggcaggtagtaaacagacagataattaatatatatcaggtggtgaccgaaagctaagaaaaataagaggacaatgagtaactgcggatgctatttatgtcaagaatcaaaagtttgttctgaggcaggtgttctctatatggggtccacagatccccacaaaaagttcatgggtaaattacagaggatctctgaatgatagtggcaaaaaatacatcatagttttaccaacttaaagtttgcaaatgttcgtttttgaatgtaggcaacaaacagtggcaatattaacagtacctgtcatgccaccaatagaactcataaattttttttaatttttatttttattattatactttaagttctagggtacatgtgcacaatgtgcaggtttgttacatatgtatacatgtgccatgttggtgtgctgcacccgttaactcatcatttacattaggtatatctcctaatgctatccctcccccctccccccaccccacgacaggccccggtgtgtgatgttccccaccctgtgtccaagtgttctcattgttcaattcccacctatagaattcatagatattttatatcaactgttactggagatgtctcaatcattcatactaacataattcttggatcaatgtcatggtagatattagacccattgagaaatcttgtcattcaatacattgaacaagcatatatgttacttatcacaactttgtagtattttgataaataattcaatggattaggtctcctttataatcctgtttattatatacatttaagcatattgccctgaaaagtgaatccttagactacatcaaactgctaggaggtcagtagcagaagtgctttatgcaaacttcccatacttcttcacacaatattaaaaatatgagtactcaggggttgacgtttagaacaataaataatttttactgctccatcaagaacatccttaagataaactggtgtttttattgtcgtaagtatggtggtgaagaataccatgacctgtggaacagtttggtccaccgtctgcattcttgtgaatgagccacctgtttatgatcatagccttgctccatccacacaaatgtcaacaccatcaacaggcaaagaacaccttaggattcttatgaaaaccagttggttcttgtggaccccttaaagagttttagagtcccgaggccgatcgcggtggctcacgcctgtaatcccagcactttgagaggccgaggcgggcagatcacgaggtcaggagatcgagaccatcctggccaacacggtgaaaccccgtctctactaaaaatacaaaaaaaattagccgggcgttgaggcaggagaatggggtgaacccgaggggcggagcttgcagtgagccgagatcgcgccactgcactccagcctgggcgagagagtgagattacgtctcaaaacaaaaaacaaaaaacaaaaacagttttagagtcctgccgggggtctgtggacctcactttgagaaccactgtgctagattaaatggcaaatacagattcctttaagcatttggaccacccagaggactctatttgcatgaaaacttggttgtggttgtagttttgctgtccaactctctgaaattgaagttttaaccaagcgtttaaggtagaattttaaaaatctcagtagaaaataatcttctgttgacttttcttcatggccccagagacctagcatgagaatacaggtcaggaaatacattttacagcaggagcatatggatggcccctgctcaaggaaagaaataaccaatacttgagggaatcttaacctcttttgtgtcatgaacctctttagcagtctagtgaagtctacagacctcttctcagaatgtttttaaatgcatatcataaaatacttaggattacaaagaaaacaaattatactgaaatacatttctatccacagacccctttgggcggctcagcattcaaggctaataaccacttgcttccttcaatcccaactggcaaggaggagcaccaaaggaggtgacatttgtttcttagtgcatttgtttctaggtcagttaacatcttaaatgcccaaattctgaatgtcagtaagttcgatttctacatctaaacaaggccagggcaagaaagtggaataagaagaatgagtttctcctgagccttccatcagacctagtggcacaggtcatcagctaaatacacaatcttcctaaaggagggtgaccctgggctgggggccaggaagatcttgggcaccatctgcataatagtctagtaccgttgagaattctccagtgggagtttccaaaagtttggttactctttttgaaaaaaaaaaattgttttatattgaaactttatttttctctgttttttaaaccaaactagcatccttagacttattatacttggagaaactgtctagaacttagtgctaaaagttaaggataaaagaatttagagacttgtgtgacttactaaaggataaaaccaataacaagctgatactgtttgtatatttgtccccacccaaatctcattttgaattgtaatccccagtattggaggtggggcctggtgggaagtgatcagatcattgacgcaaatttttcatgaatggtttagcagcgactccttggtgctgacctcatgatagtgagtgagttctcaggagatctggccatttaaaagtgtgtggcccctcctcccctgagcctcacttgctcctgcttttgccatgtgatgtggctgctcccacttcaccttctgccatgattggaagcttgctgaggcctccctagaagctgagcagatgccagcaccatgcttcctgcacagcctgcagatcactgggtcagttaaacctcttttccttataaattacccagtcttgaatatttctttccttttttttttttttttttttttttttttgttgagacagaatctcactctgtcacccaggctggaatgcagtggcatgatcttggctcactgcaacctctgcctcccaagttcaagcgattcttgtgcctcagcctcccaacaacctgggactacaggcatgcaccagcacgctggctaattttttttgtatttttggtagagacaaggttttgccatgttggccaagctgatctcgaacttctggcctcaagtgatccacttgcctcagcctcccaaaatgctgggattacaggtgtgagccactgtgcctggcctcagatatttatagcaatgcaagagtgggctagtaaacaaccccatagtaaaagtttctacattcttggtggaatggttataaattaatgaaaaacaatttattcactttaataggagaaaatgttggttctgatagtggaaaactgctgataatccaaagagcctctctgtttaatcttagaattaatgaaagtattctagcatcatggtctcctctgattgtgttttttgggggactaatattgaagtgagttcttattctctgattcaagggtaaggaggtcagttggtcacttgaaactattccaagactgggaagacaacctgtgattttaaatttgccacaaataatccaccaggcggatattcacctcttcgctagtcaagagtttcactgtggtctttacagtcctactttgtttcctcataaaggaaagcacactctctaagaccccacagcttttctttctgtcccccccaccaggctcttttcctttttcccgttttccttgccctgctcactgcagtttctctttcagggccaagatgaatcctcaagtccttgcatttccaggaccacttcatccaatgttgctgaacccttcatagcccttaatctatagattcaaaactcaaagtgcctgttcaccccttacctctgcagaatgctatcttgtagtctgtaaagcattttcacatattttttctttaatccccatagccatcctgtaaaagaatttgtcctatccttatcttgtgtgtgtgtgtgtgagacagagtctcactctgtcgcacaagctggagtgcagtggggcgatctcggctcactgcaacctccgcctcccgggttcaagctattctcgtacctcagcttcccaagtagctggaattataggcacgcaccaccacacttggctaatttttgtatttttagcagagttggggttttgccattggccaggctggtctcgaactcctggcctcaagtgatccgcccgcctcggcctcccaaagtgctgggattccaggcatgagccgctgcgcccagcctcggtcctgttcttattttagaggtaagaaacctgatgctcaaaaagatggagtgcttcacccattgtgactcagcagctagcacagaagcaagacccaaacccagatcatctgatggctaagccagggttttcttctctatttcacagatatcttctgtgttctagtcgcattacaaactctacttgttccttatctactagcattattcttgccagaaacatagtacagcaggttataaaatcttattttgaagtggctatgactaaagacagtggggcataaaccagttacctgtgggtcacatgtgacttgccgacgtgttttgtttcatatatgggttttgttgttgtttgtagtaccaacatttaagaattgagagatctcacacaaagatccaaattcaaatttctagcttctcttgacaggtgagaatattgggcaaccctgggacaaattttgtgtggcagagactggctggagctgaacagcatctgccccctggagacagggcgtgtgcattcctagtttgccctgcgtttctccacccctcagtatctgcaggcacagggccctattcatgcattcacatgacctggcaggcacctgtgggcattggtaattgctgtcccagctctggagcctgtattcagcagggggtgggggcagagtggggacagactgcacacaacacggtgcccagcagatgttgggaacccagtaagagcagcgttgaaggatgctacattcactgagtgttataccttgagtgttgaaagtgctgagatcgccatagagaattgattcttccactctctggctttgaaaactgttcatgataagaaagaggaagagaaagagcccctcctaaatattatatgtttaatcaggtttgttatggttatcgttgtttctgagacaggatctcactctgtcaccaggctggagtgcagtggcatgatcttggctcactgcagcctctgcctcccaggttcaagtgattctcctccctcagcctcccaagtagctgggactacaggcacttgccaccatgcccagctaatttttgtatttttagtaaagatggggttttgccatgttggccaagctggtcttgaactcctgacctcaggtgatctgcctgccccggcttcccaaagtgctgggattacaggcacaagccaccacacctgccctgtttaatcagtttttcaccaggaagactgcttttcctcctacagactctttctcttgtgtgtctaaatgataaatatagttctacatttaccctgtggaattgatctcttcatcatcagagtaattaacatattttaacttgagtgtatatttgcttttctttggctttggttctcaacttgaggaaagatagatctgggaaattctgttttagtagttcttcatttcagtacttatgtgtgtagaagttattctagtgacttgaattttttgtgtgtttatacagccttggtctgattcatgggtagttaacctaaaaaggggagggaatatcaataagagaaaggaaagagtaataagagaaaaaaatgctattataacacagcctttattttttatgtttttaattagaatttttattttagattcaggttgtatatgtggaggtttgttgcaagggtgtattgcatgtgtttgagcttctgttgatcttggcaccagataatgaacatagtacccagtaggaaggcttgcagcctttgctgtctccctccctgcttttggagtccccgtgtctgttctcatcttcagaggatatgaactggggtttatgttggttcactaaatgtatatatcctaagatgtacctgcatataataaaaatagggaacattctataagaaagctgtgagagaaatctcaaataccagcataataaaggggcttgatttcgtagctttttttcttggattccatgtagtcatgttttattttagaagagaaagaatccaggaagcaggaccaatgaaagggtcagaaatgagatctctaagcaaacttaggatggaaaattataaaggtctgaggattcataaagaacctgacccactgaaaacacagtccaagaagctttagagtgagacagatggaaaatgaatgagtgaatgaatggatgaatgaaaaaatgaattagaaaaagggaaaatgaaggcaggaaaaaattgagcttccttacagaatgttctctaatatttttattatatgcaggtacatcttaggatatatacatttagtgaaccaacataaaccccagttcatatcctctgaagatgagaacagacactggggaacacactatactaatagtcatttattttttctgggatttttttgtttgctttttataacattatggaaaattttaaatactcacaaaagagaatagtccagtgaagctccatttcacagacaattcttagtcactcatgatactaggatcttgagaaaccgaagttccctgttaatttaaaataattattttatttaggttcagcatctctttattgaacttattacgagtccttaatgaccttctaagtcaggatcatggagcacagaaaggagaagctgtgggctggcctaaaaaataatccacaaacatgctgtttataccctggataaccagaggttgaaagtgtgacttttgtggtttgttttgcgttcttaagccaaaactattagactattgcatgtgaaagaaaacgaaattctgaacctcttcagctaagaaggcaaaatcatcaaaattctgaggctaagacagtttctgtggcttttcaaaacttgtgtggcccaaaggggccataaataacttttatggtataaatcccttaaagaacattcttggtttctcaggaattcctgccattcttacagtcacaaagcttcattttggctgggaagatgtttgagcttgagttttctgttcagtactgcctccaggaagtactaaactgtggagacgtggactatgctgtgggcttcttataacaggtgaaatgaacagatttgaggtgaatgattcttttgtctccacctcataattcaacttttcaccaaaatctgccgtattccttctgatctctggcctacgttttataaacaccttttccttctggtattacatgcagagcacaaaaaagttaaaatatatttccatgattattttaagcttgagaatagcaaaattgtagcccccataggatgcactggcagtgcattcatataatatcacactgcccctcctagagaaaactcacaatggtgatctctccattttctgtgtggctaagtagcgggtagggatgcgggcccatccataaacccgacctcctgcttattttaagagtttcatcagcatctcaagatgagtcaatattagaaggatagatagtcccattgactgtatgcttcagaatataatcagcgcagccccttataggccgaggctgctgccatgtatgtgctggtctgaatgcagcaagcagcatagcactgcagcccaggtggctggtgcatgcctggttaaccaaggcagcacttgcagcactcacagcagtcagccagtggcagagatccagccatgtggctccttctgggctgtagagatgagaatcacagacaaccaagatgcaaaatcccgaagtcattattcctctgagtggagcccgcatctggaatgcaccttttccagcagggagtagtttataggtcatataatgtcatttcagtcatgcagatatctagcaagaaaaagtatcaacaatgatatatctttatctatatgaacacttaagtactttttgttcaaaatttaatggtacttgtattctggactttactggtgaaatttttatgatgttgtttattgaaaaacagtagtatcatctgaaatctttcattagacacccagacttccatggtgatttgctaggcatagcataattcaaataaaaatttcattatcttcaaagaccacttttagaaactataatagaacacctatctggcactgggtggataccgtaatacagagaagcaaatcttctaggttagaatataattctgatacagaatatgtagaacaaagattataactttttatattcatggcatacttcaaatattggaacttttggcaacatgcaacactaataatagactcaaagcaacaccattaagacaaactcactgctatgatgtaacagtgtctcacagggtctgtaagaagaaccctcaggaataatgctgtttgatgtctgacttaaactgtgcattgtcctttaccctctgacatatagagcaaaaatgattacgtttctctaaacatgtgaccttgctttggcacagacttgacatcttactcaacttctttcctctaactttgcaagtttcactccttacatcccaggttatccatgcctctacactcagcatttcctctgatagaccttcctgtagcaaagaagcatgaatagcccatacagggctcccaatcaagatggtatactgagttcacactctcttgaccccaaatatattgtaatgattgatagaatataaaaagaggaaatccaaaggatttaccagctttattataaaataagaacatcctcatgcatggaggaattcctgagtggtgagcaatgatgaatccacaggccagctgggctctggtccagaatccagtagtggcagccagaaataggacaaggtcaaggagactagaagtgtcctggccaacaagagggccagaccaggctcagtgctttaaaccaaggcatggggtgagaagccacacttcccctcactttccaagtaaaggaagttaaacgtagcaactgctcatcttctgcctggaactatgcccttataagaggctagagatatacagaggtggaaaaacaaaaccacaaactcacaagtaagaagtgaaccaaactatttgctcctttgtaagcaaatgtgtaatattctcattgctctcataagatgggaagtaaaactaagacctgattctggactcaggacccgggagtccggatggtagaagccacaaaaccactagaataagacagagggtgagaaggaggaagaaagagagacagggagaggagagaggcagcagagagaggaagaagacggagacagattatgaatctcctacccaaaatgagcctacagaccatacattctaaggaacatggaaaaaaaatccaataccaagaaaggcaggcagcaaaatctagtactggaatatgaatacactccagatggctttaaggaacaacctgacaaagtctttaaaataagtgtgcctaggatgtttgaaaagacaaaagaatgaatagcttccatttaaaaagagcagaaaattgtaagagagacatgaaacaaggacatgaggatatctttaaaataattaagtaaaatgaaaaatatggttattgaagtaaaaatttaatagataagttctaagctaaataaagttaaagagaatattaattgatttagaaaatagtcaagaggaattcaccaagaatggaattcagaaacagatagacagatagagcagttaagagacatggaaaaaatattgtaaagtttcaacaggcatctgataggagatccagaaaaaagagaatagaaaaatgttagggaagaaatatttgaagcaattaaaggacaaaatattccaaaattggagatgattctttttttttttttttttgagacagagtcttgctctgtcacccaggctggggtgcagtggcatgatctcgactcactgcaagctctacctcccaggttcatgccattctcctgcgtcagcctcctgagtagctgggactgcaggcacctaccaccacgcctggctaatttttttgtatttttagtagagtcagggttttaccatgttagccaggatggtcctgatctcctgacctcggatctgcccaccttggcctcccaaagtgctgggattataggcataagccaccgcgcctggcctggagatgtgatccttcatactaaaagtacactgggagtactgaacagattaaacaaatttaaatattcacacaagtattttagagtgaaactgaagatatcaaggaaaaggaagcaaagcagatgaccaatgaaggaatcatagttaggctcatagcagacttcttgtcagcaacaatagatatcagatgacagtacagtaatatcttcaaagtgttgagataaaaaaattgtgaacctggaattttatacccagctaaacaatcattccactggcctttttcagacacagagagtttcctacttactgagttcattaaaagcattattaaaagatgaattatgggggaaattaaggtacaagggcataaaaagcaacagtgaacagagctgttgagtaaaacaatgttagtaaaatgagttgaatattaagtgttaaaagttgtttgtatgttaaaaaaagattacaattaggcaactttaaaaaggtgagtggtgtttaatggataaagttgctaaaattcatctccgatttggaggaatataagaaaaccaaattacttcatgctttattagaaaaaatttaatcaagtttgaatgttaaaaaaaatttaatgacttttccatttacttatctttctcatcatctatttacaaatgaatttttaaaattctttgcccttcctcagactctctcagtaatgaaagtatcttaagctcctttgttatttttattttcttaaattgtaagagtcatccatgtgtttgaaaaaaaatcttacaatgttaaaaaaaaaatgtaagggtaaaatgtaatccttagattctaaagcagtagaggacagggaagggatattattaaaaactctattaaaccaacagaagacatgaaaagaaaaaagatgcaggaaaaaaagaatagcaaattttaaaaaacgcaatgtaaggtgcagaaattaagtattttaatctcactaaaagtaaatgattaaattaatttattaaaaatagaaaggttcatttactaaaagtagaggctgaaaataatgagactggagagagttaccagttaaaaactaaataaatttagtgtaggaataataacatgatacatttttatttttactttttatgtatttatttatttattttttgagatggtgtctcactctgtcacccaggctggagtgcagtggcgcaatctcagctcactgcaacctccgcctcccgggttcaagcaattctcctgtctcagcctctcgagtagctgggactacaggcacagaccaccacgcccagctaatttttgtatttttactagaggtggggtttcaccatattagtcaggctggtctcgaactcctgacctcaggtaatccacctgcctcagcatcccaaagtgctgggattacaggcgtgagccactgcgcctggccgtatgacacattttaatataaggcaaaggcattaattttaaaaaatcataaaaataatgagaactaccaagaagatattctatataagtattagcatagttacatattataaactacaaataaaggaaaatcaatccagttattcattggtcgcttaaagccagagtgcttactgtgatgccttatgtacagtagatgccttaattcataatgtaattaaagaatcttggcattcattggttggagattccagtttgaattgttgaaacacaatgagtgaatcattttgaactaccctaaattaagaatctctgaaataaaattgcagtagaccatatcgtggcatgatagaactatggccaatggaactatgcctttatacaaggcctttaaactgtattagaatagtatggttgaaaacttaaagttagaatcccaaatgaagtttaccttgcatttcatttctaatcaatggcattaaagataataatagctctctcccacccctttttcctcagtattcaactaaccactggattcagtccttataatttatgattatgtaaaatttatgccccaaaatttttgccaaaatattttaacgtcattttgatgtccaatttggtaaaaaacaaaacaaaaaaaaaaaacattaaggcacctagtagttttataaataattcccaatggggctaacctctgctgaaagacattctttgtgctaaggtttctgacatcatagacagaaggaaaatgattgttagccaaaaacactataatggtgagaattagtgactgataatgtattccacttttaccttcgaaaatgtttgtacaaaactgggttgggcccagtggttttgcactaaaatctgtagacttttattcgcctaataaaatgaccacataacctggcaaaattctgcgtatttggcagctcttcctgccccggaggctggaagagcattgaatctgcaggtgtggcttttagaaggttcagagagtggaattagggaagccagcccagcaccccacctgtgtgccttcctgagggccaggctggcgtccccagcatttaatagacgtgcagggcctctattcattcccaatagataatgacaaccaaaataatcaaggaattgacacgctttgctggaaatgcctgataatgacattatagaccgaattacagcaacttaaatttctttctagcaaatgatgccatgttttttaaaagatacttttggcacttagaaaatagatcatagtatttaatgctattgaatatagtatttaatgtatttaatataatattgaatatagtatttaatagaacatagtatttaatgctattgtacacacgaaaaacctactcttccccttgttaacttggatgaggtagctccctcttttctttgaaggtaaagtgggcagaggaatagaattgtcaacagctggactgcagaagggagaggaagaagaaaaaggttttctcacatttttgttttttccacaaggtgctctttaatcttgggagccagcagtcatgacccagttattgagatcagacttcctggacctgcttatatagagaagtggggagcagtgtaagagccggatgtccacactgaggcagacagaacagagagtggtagtgggcaagttgaagcagcaatgacatgatgaagggcccatggtgccccaggaaggggccccaaatccaggagtaggtaacataaaagttcacgctaataaccggacctggtgactggcttgatattcacaagcaagactctattccactggaggtagtacctagtgaaagcaaatcagaccacactcttatagaatctagatgaaccaggagtactgagcaagcttgtaagacagaggctcagatacaggcagcaaaacatggcttcagttaagaaatggagaaccaggtgggcccgaatctcagaaacaaggaagaagtacaatgggcagaactagggcacaggaatagggtcatgctagctgatcacgtgccttttgtgtgtgtgagagagacagagtgtcactctgttgcccaggccggaatgcagtggtgcgatcacagctcactgcagccttgacctccagggtcaagtgatcctcccatttcaacctcctgagtagctgggactacagtaggcatgaaccactatacctccagctgattttttttttttaacttttttgtagagacaactttttgttgcccaggctggtgatcagatgtcttgagtctcagcatgctggcctagagcaatgattctcagatctagaacctttgtatcaaatgaagccttacagagaacccaatatgtaaacccaggcgaagcagagctcttctggcttgggtagggcaggaggtcttggagccctgcccatccagcacctccccaacagaccctctgtgtatgttgacgtttccttttactgggaactccttacatccctctcttctgggtccaggatcagccatagaattggagagggttgagcggccctggctgtagaggaaagaagactccagaagctggagaagaattcgggatctgacaggaagttcaaggtgacctctgggagccttctgagaagaaaaagggcatgcaacctcagcagtgtctctctgcctctcaccaaattgacagtgggcccgaactttgctcatttaatgagatagaattagtaaagtctccagtgtacttttcattccttccacaagcttttaccgaataaaatgattggtactcagtaaaggttagtcccttccttcttctctccctccctctctccaccaccattagacctcatttcttaaaggactgatttccactaaaatgcaagtatttcttggaagcacattgagcttgataacttatttatttattcttctgtgtgcattaatttatgaactcatttccaccagacacctagctgagagccatgtttgatggatgggaatcagagaagaaagccagagagagccccagatgactgagggatgaaaggccctcaagagactggggaaaggcagtaatgacaaggttcacactaacacaatcacacccaggacagcggcagatttgaagagggagcagtgcagacctgagggtggctgaagagggttgcctcaaggagggtccccactgtggccaaagaggtccttgtaactaactgaaaacaattggacaggaccaccacctgcagtccactcacagtgggcgtttcttgcactcatcctataccatattttatgaattttattttaagttccaggatacctgtgcaggacatgcagttttgttacatagggaaacatgtgccatggtggtttgctgcacccatcaacccatcacctaggtattaagcccaacatgcattagctatttatcttgatgctctccctcccccaaccccactgacacgccccagtatgtgttcccctccctatgtccatgtgttctcattgttcagctcccacttataagtgagaacatgtagtgtttggttttctgttcctgtgttaatttgttagtttgctgttaggatagtggcttccagctttatccatgtccctgcaaaggacatgatcttgttcctttttatggctgtatagtattccatggtatatatgtaccatattttctttatccagtctatcaccaatgggcatttgggctgattctgtgtccttgctattatgaatagtgctgcagtgaacatttgcatgcatatatctttatagtaaaatgatttatcttcctttgagtatatacccagtaatgggattgctgggtcaaatggtatttctggttgtagatctttgaggaatcaccacactgtcttccacaatggttgaactaatttacattcccaccaacagtgcaaaatgttcctatttctccacagcctcgccagcaactgttgtttcttgactttttaataatcgccattctgactggtgtgagatggtatatcattgtggtttttatttctatgccataaatattgaactgatcttccattttgcatttttcccactttccataaccacagagtcaacatcgtctctgtcttggtatgttatgctcatttattatcttctgtctgtagttgacaggtttttctgaatgattttaggaacttcaagttccagtagagagaatgaatgaatgacttctcttaactggacttctatcacaaaatcatggctaacttcatgcattcaactactgttttttaaacattccaaaaagtgatcaagacgtcattccaggcaagcttttttttttttttttttttttgagatggagtctcactctgttgcccaggctggagtgcagtggtgtggtcttggctcactgtaacctccacctcccaggttcaagcgattctcctgcctcagcctcctgagtagctgggattacaggtgcacaccaccacacccgaccaatttttttttttttttttttgagatggagtctcattcttttgcccaggctggagtgcagtggtgcaatctcggctcactgcaagctctgccttctgggttcacaccattctcctgcctcagcctcctgagtagctgggactacaggcgcccgctaccacacccagctaattttttgtattttttttttttttttttagtagagacggggtttcaccatggtctcgatctcctgacctcatgatccgcccgtctcggcctcccaaagtgctgggattacaggcgtgagccaccgcgcctggccttttttttgtatttttagtagagacggggtttcaccatgttggccagactagtcttgaactcctgacctcaggtgatccacctgcctcggcctcccaaaatgctgggattacaggcgtgagccaccgcgcccgacctccaggcaaacatttaagacagggggtttttttttggctgtaagaaagagatgccaatctgtccctactcctaaggagcaaaggagcctgaaaaaccaagaggccagttgcttcctcttgctgtcttacatttttgtatttcatttttctttctaaggtgcagtgagagcccagatctatttgtttagtctgtttcttcccatgttgctcatactcacaaatttctatttaaacttgcctcctggcttctttaagagataaactgttgctgcagtacggttagggtaaggaaattaccttacttaacagctggtaagtcaccagctgttgctgctggttatggtgccttgctgtgcagtccgtgagctaacttatttagtgagagattttcctgccaatttgctataaccttgagggagaaaaactgaaatctcccacagaggcaggaatttattttgcaaaaaatgaggcatttttaatatttgtagacattttaacatgtgaaaatgttgcattaatgtttgagtcaaaagataagattccattttgaagttacagggatttgcaatcagtatttctaaggtcttagatgtttgccattaagttttcctttgcattgattttatttccgtttctccatctgtacatgattcatggtgtatgtgcttgaggtgggtggaactcgcccttgttggacaattttcagcataagaaggcaagtgggcagcacttaattctctcctaacccttaagatgataataaggacatgttaaagggtgagacacgcaacagtgagcagaaaaacaaggttgaaacccttgtacctgggagaaggcatacaatgttggtaactgataaagttgggccaggaagccacagtctagagtgcatttggaggagaaaatacagcggaataagactccaggtttatttggaaatgccagggacgatggataaagcaagaggctgacagcagaaggatgaactggagatgtctatatggaagagaagccctttatttcatccctacctgggaaagcccagcacccagcagccgtctattgggtgaaaaattgattcattcccaaagtatttgaatgtttcctgagaaaagacctcccaacctggccattaaataatcaccagcaggatggtgcagcccactggttataaacgctaccaatgtcagcacagctctccatcagtttttcctgactcatcattaaatatgaatggacaagaaaacatccatagctatttgaagaaagactgcaccttaaaagacaggggctaaaataagcaaatggaaacaataatcctaagggagacaaatttcaggaaaaagaataaagctttaagagggagctttacttagtttcctcagagagattggagaaaatgttgcatccatacatagagcaggatgctgtaagaagaaaatcagcatgcatcaagaaagaacgcttagacattaaaatatgattgtcatgatcaaaaattcagtggaaggacatggaagatcaaaaaatctcttagaagagcaaaaagacagagtaagaaaagatgaaagagtaacgattataaaagatcattcaagtttcaaaagccaattggaaaactagaattaaagaatgcagaaaatgaaggagagaagattatttaaacacatacacacacacacagaaaccaatatcttaagcctgaaagacatgagtccccagattaaaagggcctgctaagtgttcagcacaatgctaggtctaccatgtgagatttcagaaaatcagggttagagagagaaatgttaaagagcacacaatcttctctgatgttaaaacacacacacacacacacacacatagacagacacacatcacctgcaagttattgagaacattattagcaacaaattccttgtaagctagaaaacagcaaagcaaaaagttacttgaggaattacttcagcaaaacgagggagtaaaacaagcaagtcagacatagaatccagctaaatgggattcttaacctctgagggacacaactgagaggcagagaggcatagaacaagagacagttgctttcattataccttttgtcttttttttttttgacatgtacatattactttgacaaacatttttgaatttttttcaatagcacatatacatcaaataagattttaagaccaaaatagaaaaaggggaaaatcctttattctaccatcttagatccaatcatttaaatttttttaaatttattttcttcccatctatctttaaaatataagtttttttaaaaaaaaaactagggttgtagtcatattatatatatataattttatcccgactttctcagataagcatttttcctatagttacatattctttgtaaacattttaaatgactgcagttatttacaatgacatgtactacaagttccctaatctctataactgaattggaatgtaactatgataaatattttgttatagaaatagaagcaaccagtttgtctgttagccagtttgactccatcaggatgtgttatttttatttggttaggctccacgtgttttccagactctctgtgagaccattgtagttgtgggctccacatctctgaaaagcatcaaaaccccttgaacctcaaagaccgcggttccttgtttgagtgacactgtgttaaccagaagaagtgcagggatatttctgggggagaggcactacagcttccacagggtcctgcccacaggcatctcaaatgcttagtaaactttgctgtagttcattgaaaagagcctaccaaaaatctaatgaaaactgagctggatactagattggtcttcatcttataatggaacatttcagcataaaactgtgactatttcggccgggtccagtggctcatgcctgtagtctcagcactttgggaggctgaggcgggcagatcacgaggtcaggagttcaagaccagcctgaccaacatggtgaaaacctatctctactaaaaatacaaaaattagccgggtgtggtgacacgtgcctgtaatcccaactactcaggaggctgaggcaggagaatcgcttaatctgggaggcagaggttgcagtgagccgagatcgcgcctctgcactgcagcctgggagacagagcaagactccgtctcaaccaaaaaaaaaaaaaaaaaaaaaaaactgtgactatttatttgtctttagttcaatgcaatagaaactggaaactcacactcttggaatccaaatgaatgacttcaaaaaatgtttggtctcttgtgtccgtaagtgtttcagtttcagaatttaagagctccactggactagcgctcccaatgagttaaggatattcgctaaaataaatgtagatatgccgccataaaaatgaatgagatcctgtcatttgcaatgacgtggaggtcatgttgaatggaactggaggtcattatgttaaatgaaataagtcaggtacagaaagacaaattttgcaagttctcatttatttgtgggagctaaaaattaagataattgaactcatggagatagagtagaagattggttgccagagactggaaagggtaatggcagtggcggggagaagtggggaggattaaggggtacaaaaacatagttggacagaattaataagacctagtatttgctagcacaacagtgtgactctggtcaaaaataatttaattgtccattttaaaataattaaaagtatataattggattgtttgtaatacaaagaataaatgtttgaggtgatagataacccccaaaaaagcatgtatgctgacaattccaaagacatttctatttttgggggaggccaaggagggtggatcccctgaggtcaggagttcgagaccagcctggctaacatggcaaaacgctgtctctactaaaaatacaaaaactagccgggtgtgggtggcatgtgcctgtagttccagctactcaggaggctgaggcaggagaattgcttgaacctgggaggcagaggttacagcgagccgagatcgtgccactgcactccagcctgggcgacagagcgagacttcatctcaaaaaacaaacaaacaaaaaggcatttccacttttattttcccaataattttaaagccagtttgtttattaaggatttacttaactcatatgaaaaagaaacgaaataattaaagtaaagttggcattatgtctcacttatccagaaattctttatctgccatcctgccatcagacacatagccataaactcagaagtagtgtaaaggaccagaaagccactacggtagatgccacagatattaaatatccaacatcgcaagctgtgcttacaacagggagagcaacgtgcttctctgcctgatgctgatgcttcctggatggctgtattgagaattccgaaggacacttcccatctcaactagagtgtgtcatcagtgattcatgctagacatgagcatggaatgggagaatgatggtatctggccatctgccactttccaatccattaagcctcactaaaaagtcttgtttgactcctctggttctggctcagatttttttacaaggttggaaaaaagccttttacaaggaagagtgtatgaggcaataaaagttaacttagaccacatccattccatttaacccattaaacttgtactctgattaccgtggtccacttatgggtcaaggatttgggtactgcctcaatggtgaatgacagtcatttttctctctcccacttctaacacagccagcgtaagaaaccgtccttttccataatatccatatttttagcgtgtgaagactggctccaaaaatcaattttaagtccacattgaaaaagagctttttatatcatcgtgttacattgcgtcatgtgcagagtaagatgagctataagaagtccaaagttccacagtggtatattttgcataataccgtttgtgtttccattaaattgtattgttgttttgactgacatagcacattacatgtttctgtatttttcttcctctctgttttctctgtgagttagccagagtcactatttaaaaaaaaaaaaaaaaaaactatcagaatcaccaggaatggtgtttttgaatataagattaagtaaaaaggaatgaaatgctgaaggtataataaagatggcataatcttaacaggtgagtggcaggtaaagtaactggtataaatgatttctaatcttagcaaagggtctatgaggcaagtattattgtcctcattttaccagatgaagaagttgagcttttgagaagtgaacatttgccaaagactccacaactcacaagaggtacagccaagatttgaactgaggtttgtctgataccaaccttggtggttttctctctctgccgttcatgaaaggtgaaaaagtttaaatgataaatgcagagtaaaagccttgtattaactcgtaagttttggtatctaagaaattacagccttttctagatcttgagattataaaactattcttaaaagttggttattgtcaggcgcagtggctcacgcctgtaatcccagcactttgggaggtcaaggaaggtggatcacctgaggtcaggagttcgagtttgccgctactaaaaatacaaaaaattagccgggcatggtggtggctgcctgtaatcccaactactcgggaggctgaggcagaaaaatcatttgaacccaggaggcagaggctgcagtgagccaaaattgcgtcattgcactccagcctgggcaacaagagcgaaactctgtctcaaaaaaaaaagagaaaaaaaaagttggtaccaggtacgtccatctgcagtttcatcgactgagattatgtagctgagagaaactgaggctcagagatggcacgatttagctgaggacacccagctaattaatcttggagctaattaatcttggagctgagaccagcacccaaatctccttttcctcattcagggaactttgcatatggcctcttaaggattctgctattgaaagcagccagaaatcctgtctttgaaagccatgggccatatggacaaaactgatccatgtttcaagcatggagctgtgtaaaaacaccaataagtcttttttcagttcagtggctttcagacaaggtgctgtcttataaaaggataagtaaaatatgaatcgtctctaaattcaccttttgtgataaaattaactccacctgggaatttcttccttccaccctttctaaaattaaaactgaaatccaagagaggaagcagttgtctagttcttgatgtacagagaaataaaagagcagttttatgtctcaggcagaagcagacgagaggcctgtgggcctggcagtgcagagtgaggagaaggaggcagggctgtgaaaattcgctgacagggagggagtaggaggtgtccaggcctccagcgcagtgtctcatctctagagcaagccctcatgtgggtgaagcaagtgccgatacacagaggagcccctgcaaggtgggtgggaaggttatttcaggatgccaggagcactcaggccagcttggaagtcctttcatgggcaccatgaggaagtctgtccacttctaaaagaattctggccactcccaatgttgggagcagatctagcctaagaactagaactaggttagagtgccaggtcccagctgatggatgaggttccagacagaccccactcctggagacatttgggttccagccaacagggaagagagtatgcgatgtggcacctgagccctgtcccagggaccccatctgccagatgtggctggcagtgaatggccagcatggaaggaagcccatggtcctatctgtctccttttcctggacccaagtgagcgctagcccaggtggactggagtatgttaactctccccgccagaaacctgggcctgctattgagactaggtgaggagggaggtggcaagggagaggaagagcaaaggcatgagatgaattacctaatacacagacagctcatgaagagtgaccatcctctcagagtcaccagagtttctttcaaatgcagattcctggccctgcatatcaaatgccctggaagtctggccagggaaatcacagtttgtatcaggtgccccattgttatccctgttgcactgtcaataggagtcctccaaggagagcaaggaagtgcagactggggcacctctggaggctgcacacagggaggagaggtggaaggaagagctgctggctgagaagctgctgtcatcatcctgtgggggtgaagagggggtgtgggagtaagggtgagagaggcctcaggaaggactctctggaactggaggcagtgactggagtttcctctgagaccagccggccctttagactcaaaagatgagagtcacccatcaccatccatctggtggaaacattacaggagcaagtggataaaagacgattttgctgtaagatcagaacggaaaaagacgagcccacaaagaaaatctagagggaggaaagcatatggtttttaaaatagtacagtttagaatacattgcaacacaaatggattaatttttgtacagtgttggcaatgaaaaggattctcatagttatctggaatgcttactcagagagatgatctcatttccctaataatgcaaaatcttgagcagcgtggggtcttatgttaagacccaatgataaaaagggctagacttggcagggaagggcactgcaggggtgcccatggtgtgtgccaagactcaggaaccagaggagcaagtcgtagatcaggtgctggcaagcaggctggcttggctaaagtcatcaatgcagtgacaatcttaaacaaaagtttgaaatccatattaaatgtttttttttcttttttaaaaaagcaatcttaccctagaagcactacatggaaggaaaaaatgaagttgcgtaatcatttagaaaatatatgtgctgagagaactttagtattaaaaggtgattgtaaaacaatgcaggataataaatcttagaccaaagataaatcatgaacaccagggcaaccaaatggtcctaggagactgaaaggcatccgtcagaacaggccactgtaagtgcagctcattggtctcatttagtttcccaggaggctgaaatgttgctcactgaaggtctcggttctgctaagagtggactgggtaggaggtgccaggagcagtttcctgcaggcccctggtcctcaggctgccaggcagcagcatccccatttattgtggttgtggccaagcagttggcagctccatgcctggggcttctcagctcatttctgcttcctctggatcttccggtccagtcatctttatttatatcctcctatagcatcaccatagatgggttgtgatgaatgccgttcatcaacctaatgggctcaaatggaactctttgaaatcccccaggatgcgtcttggtctaagaaaagaattgttaactgcacttttaaaactaggaatttatgtcttcctataaattgacctcgtgaggttatttgtggattccaatagggaagtggccttcttaggccccagtgcctcctccgccctcccctcaccagccagctgatgccctctgtctactcctatgagcccggggttgctgaggacaaaaccctggcagggtcagcaaatggaagaggtgtctgcttcctttcttgctctggagcagtgtgccttgtctctctccttctgccatttattcactcactcattcagtatctattgcactcctgctttagtccaggcagggtgctgagcactggagatgcagtgaacagtctgtgctctgagggacctacaacctaaacaaataagcacacaagtacttgctcaagggcagctctggagaagcagcaggtgccatgagagcctctgtaggaggctctggcggtctctgatgccctgctcctcctgttaatgcaggactctggggggctgactgcgtatgtgacagttctttggatgttccccatcactttactccgtccttctttgtgaaatctcgacctcagcagatgaacactgtcctggccagaatcaccctaggctctgcttctcacccagctcctggccccctccctgttgccactgctgcagagggaggccaccagggttattgggtccctcggactaaaggctcaggttccaaggggaggccaactaccagaggacaccctcaaatgtgagcagggcagggggctcagagcatcctcaaggcaaagcacaggcacccgcccgcacaagctttggtttgtttcacagtgtgtaaatctctgtacagttttctcacaataaatgtaagatgcagccgggcacagtggctcacgcctgtaatcccagctctttgggaggccgaggcgggcggatcatgaggtcaggagatggagactatcgtggctaacacggtgaaaccccatctctactaaaaatacaaaaaattagccgggtgtggtggcgggcacctgtagtcccagctactcgggaggctgaggcaggagaatggcgtgaacccgggaggtggagcttccagtgagccgagatcacgccactgcagtccagcctgggggacagcaagactctgtctcaaaaaaaaaaacaaaaaaagtaagatgcgtacattgtaataaaagctaacacttcaaaaaaggaataaggaaaaattcagtatattctcatcttcctttatgccaaccaccagaaaaaactgctttcaatcgtgtgctgtgtctccttccagatccttttgtgtttatgtaaacatgttgatttttatattgtcctacatgtttatattgtcctgtagtctatactttcattcacttgaaaatttatccaagacttttcaggatagcacacacagatccttctcattttttccaggtatccagtatttcagtgtgtgaatgtaccataatttctcttaaaaccaatcccccgttcgtgaacatgtaaattctgccatattttgttgtaataaataaactcattgcagcaatgaatatccatatatacacacacacacacacacacacacacacacacacacacatctgtcagtgtcaaactcttcttagaaaggtatttcaggtctagtgtcttgcattttaatgggttttcatacacaatgagatgctcttaatcaccctcaccacatggctggacagacatatgcacccccctattcacttctcatatgttcctccctggaaactgcacctccgcctctcatggtaaactcaagtgcttgagtactctcaattgtgttttttgcagattctgtttatttccgttgaatttgttattgtaattgtgtaatttacttaattggcatataaactgaagaagtatgaggggattattgtttttaagaaaaagcataaattatatttctctcattcccaatttgaactaaaaaaattgttactagctaaacacccacacctaaacacctacacccacacatgtatatcagatacagtagcttctaccgactcataatttcatcaaccatatttgggagttgtgtccagtcttaatctgccttgccagtatagtctctggaaaaacatcctacagctgtttggtttatttgtagattgagttatcttttctccttagaaatacctgagaatgaggcatgtcttatttagaatctctaatatgatctaccttgataaaagttggttttgagcccttctgcttacccccaccaagccatttcaagctctggtaacgccctcagaaacaccatgtccaacctcatataagagaaatggaaaacctggacgtcacaactgttgcctttgaaagtgagagggtgtctgtatataaacatcctgctactttttaagctaatatagtgttagaagtgattttacagctcctctaaaatttgcaaactcttatgagactattgtaggtacttagttgttggatgcatggatacacagagaagccctaaattcatgcaacaaacatttattaattgccaactgtatacctactaattggctggcaactggtggcgccaccacgaagcacagtgggtaccactgttctcccaaggcctgtgaccaaacttaagactcggagccaccaggaagtgcagagatgcagtttactcaacagagcatgcactctctaaaatggcccagccctgtgtgtgcctggccagtggagcaggatgctgggaggcaaaaaataagttttctcatgaaatctgtgaattctcttcatcttctcaaggcgtgcctgtgtaattcaatcatgaattttacttaaactgtgtggcatttgatagagccttgcagagactacaagacatctgactgctgtattttctcttctaggatatcaatgagtgtattcttgaaaactatcccgagtgctccaaccccaggttattttacatcattccgtacttttgtggacagcatcccagatgcaggtaagggctaaagcagggtcatggcatgcacgtacgcacaacaagggcaagaaccccaccagcctggtactcggtgggaatcttttgtatccctagtctctcaaccttctggaattcagttcctgtttactattaatctttcaagataatatttgagactccaaatgtcctataaataatgaaatttaaaaatcagggtctgtagaggcctcaggagaccaccatataaagctttgtaactggaaccaaacccttgtttatacctaaaacatacttgtcactactcatcccatgttgtttgtctttctctttggataaaatgacaaaatgtcacataaaatgtgatcgtgaagaccaggagcgaacacccagcctgctcctgtacagtgactgacttaaccaacaacctgccctcgtagcatgtgtcactgggtctgagacactggaagcccacacctcaatcccatagtggatatacttagtaggcagagaagaaagtgttttataatgatcacctgtcaaccttacttgaaggcacaaccttctttagagagtgacttactcagatagtcaggacccccagggtgtgatctgcccaggtcctgcatcagcacccctgtatacttgttaagaacccccacccaatcatagtctcgtgtgtagcagcctccccagatgcttctggcgtagctatagttgaaatctactgtgctagacaaatgtcatagcctggagaagaaatggcagcaacaatgaagcattatatttgcttggtaggaaatcaacccctgctatcagaagtgacattattccccaaaggaaacattaactagagggtccttgtgtttctgaaaaggccaaaggagaactgctacttctacaccggcaacgcattcattgtacctttttgcttatgctatgatttctgcttcgtttttaggcgtattgttgttattcctgtcttgtttcatttgccataacaaaagagtttgcttatagtccaaattatagaactaggagtgttggtttttgacttcaccataagccccctgagtccaggtggcctctcccctgcccccgacccttgcctcaataacaaatacctcctggttaacatttagtgcttcaggtattgggaagatttggggctggatgactcacttgctgatcacagtgaatatctttataacaggaaacatgatttgaactccctaaagtattttttaaatcgtgtagtatttttcagatttttgaattttctaatcttggagaggtgactcatgacaccacaccttgatacacacacaatgatttttataactctttcatcatatcaccttgcacagtctttacaacaatgctttgaactaggtaagggtgatttttaccatttttcaaaagagaaccctggcttgcccaattcccccaaatgataaatgacagccaggcctggagccccactcccgggcttttctcactcgccttagtgtcagttcagagagctggcctacaaatcagctctctgatttttacaaattaggctgttttccttctgcaatctagacaaacaaaataaaacaaaacaaaaatccaaagattcctctttaactcttccaaagaataagatgattaataggcatgacctgacagctcttttgagttctacataaatactatgtcggtaagtttcatatttcaaaactcctaaattcatttaattggttcagtttggtcctcctattaaaaaaccattctactcaccccttgattagtatttgttagaacctaactgcttgtgcctgcattcattcgtccacaatacttaggcagggcctctgaattcaaggccctgggcttggcatgaagcatggatgaaagtgacagagaaggaatggtgagcagggcaggacaccagttggaaggactgggaaggccctggatggggctacatctgggctggtccttgagggaaacaggatttggacttatgcaagtgaaggtgggaggtagagggggtaaactctcagcatcttgctgcatttcaaatatgaatgtctgattttaaataaatttttatatccataaagggagcctggtgaatgggcccttgagagagcaaagctgaacgtgaatgaaaacttcctgctcgtggggattcttgaagagttggaagatgtgctgctgttactggaaagatttttacctcattacttcaagggcgtgctcagtatctacaaagacccaggtaacttcatttgtaagcaagctcttctccatgagaggtctgtgtccagggctactcaccttgaaaaggcctcaggaaataaaggagtgaaatgatctcttctgatgacaaagggcagttagttccctgggcttgcaaaggaaagttagaaccaggagctgcagatgccaaaatcttgagcttcatgttcagacataaaagcaccatgttccaaaggcttaatggctccatttctccctatggaaactgaaattggcaacattctccatcagccttgtcttgagcatgttgctggaaactgaaactggcaacattttccatcagccttgtcttgagcatgttgttggggtgggtacaaatgaatccgtgtgtgtgcacctggactccattgatggaaacatgcgtgagtatgaaagagccatccttgtgatgaattctctctggcccaacttccatttgataaaagcactctagtgtatcaaatcctgacagtggaatagatagagcagcaaattgaaaatacaattatgattttatcctaacaaaccgagtggtccccaaatagcagcaagaaatagaatgtggcaaagcaattacaagggctgcctgtggtatcatcgtaagtataattactttcagaaatccatcatttattttttcattgtcattttatccaaagagaaagacaaacaacgttgtttgttttttcctattctccttaatctactgctgtgacaacaagccttgaatacacattcagtgatctgtttattgttctgttttgttgtcctgagatggaagaaggcattctgccctgtagaaataagcagcagataggcccggtgcggtggctcatgcctataatcccagcattttgggaggccgaggcaggtggatcacctgacgtcaggagttcgagaccagcctggccaacacggagaaaccctgtctctactaaaaatacaacaattagccaggtgtgttggtgggagcctgtaattccagctactcgggaggctgaggcaggagaatcgcttgaacctgggaggtggaggttgcagtgagccaagatcgcgccactgcactccagcctaggcgacaagagcgaaacttcatctcaaaaaaaagaaagaaagaaagaaggaagcagcagatgaaagctccccaaatgcagtctgctgcctcacattccacagggttcccgaaccccacctgcatcactggtaggtcccaaggcccagggaaactggtctttgcccagagagccctggatcccgttgcacaaggtcaaggtggccctaccaccatcagggacttgctgaaggaaggtggatagttggtggaggctgccttagcctcccagctctcattagagttcaaatcccatttacctgagtggggttgtgaaactaggatttcctttgtcttttcaacaacaagccatttaaagagtttatagaattttaatgtaaagagtttgatgtgactgatttttatttctagaagacaacataaactccgttctttgtgcaaggagaggtcttatcctaaattagactcctttgaagaagaaaggtttatgttaatcattttctccttttggctttatcttgttctatggtgtgtgtgtgtgtgtgtgtgtgtgtgtgtgtgtgtgtgtgtgtgtgtggtgtggtgtggtgtgtggtgtgtgtgtgtctaatacacagtctgagataaagggcaaactaaatcctggtgacacataagatgaacactctccataaaagatattatggcttccaactttgttactgtctgctcagtcatttgctctgagagagatcagctgctatggatgaagagaggttcacatagtgaggaactgagacctcagaccaagagccacgtgtgtgagccatcttgggagcagctactatgaccccagtcaagccttcagataactgcagccccaaccaacatgttaatggctgtctcatgagagatcccaagccaggaccacccaactaagctacccctgaatttctgaccctcagagccagtgtacgaaataaatgtatgtgtttttattttattaatattgtttattttaatgagcactctcttgtcccagcatttgggaggaggagccaacgtgagagtcctcttccagttacatcaccatccatcctgaggtctggaacacacaccattcacaggatgcaaaacccagcacaggggttgtggacctgagaacctagatgagggtatttttatcttcatgcttttgaatacagataaaccacctataaaaagcttagcccagaggacccacttagtggctcttgtcgtggtatatcatattgacttcctattttctccatttaaatatgtgtcttctcagaaattatgggcctttattccgtgatctgaaagttcgttaattcaaggagaaaagatttctgaaaaccaagttactattaactcttttaccttcagccatgatctttccacctataaattaaagattatttttccctcagagtttggcatagtaaatatctcaaagagaataaaggacatctggttttcctgtgtagtgggatgaaaggtttccataagccaggccacttggccagtccacgtggtccagctggactagcggttaaaacagtgaaacacttctatacggccttcagggtgcacctgccagcctggctgcccgtccttgttacccccgccttttccaacagtgatgtaacggaaggactaattcatggcacaagagggatcttcaggaccccgggccagtgtcacactcagtgactgttctgagttcagttcttgagtggagctggttgtcaaatactttaaatatcaccctagcataactctctcagctgccacacattatatgcccaataaaatgaacctttgagttgttgcttcagtaacttctactgtgttttgtgttctcttgggcatcttcttgtgatatgtttctatggtaacattgaagaccaagctagtccacagttcctctatcccaacaagtttccgtgtcccctgaggcagaggacaagagatcaacacacactcctggccagtttctcaatatattttagcctcagggaagacttagcacccatattgttttctcatcaccacaactgagttggtgtcaagtaggttaaagaaagaatagctgcaagtttctagttacttcaccatctcatctttgtatttttagtctaagttcatgtcttagggcatactaaaatcattactctttccctttattgaagagtttgataactgagtagattagagaacagagagaagaaaagctaaaatctaagatactgatttaagggatctagtgacccttaactcattgtagattaactaaccatctgaagagctgaattaagatgcaaaaacaccactggccatttttctttggtgtttgtcctgttattgaaaaacaaaaacaaaaaaaaaaataggagtttgctgacttctggtaactcctctctagcaatactaaaaatatgtataccagtctcattacagaagaaaaaacactaatagcaatgactctttggagagctagtaaaaatcgtaatgtctgttagtcatatgggttgtcacttatttcagattgaaatgatattcattgattctttcaaatcaatactacctgtcccaataactcaccatttagacaggttaataacctttctcaataacagcgtaactgtcttttcttctgttcctttcttgtagaaatatatgctgacatcaagtaaatttgtctcctaccaaaaatattggagaaacttagcctttagaactttttttaaacagtcattttatgttaatatttgcattttatggagacagaatagagtatctcagaagcttaggatagtaagtacttgagatgaaataaaaattagagttttagcaagatggataaccaagagaatatgcttggtatttcttccagccggtgcgcagctgctgatattaggacaagtactgtggagtgggcattcagaaaacactgctcaatcctgaccatgagtttgaattagggagcaccaaggccccagcaggtttactcggtagaagcaacctcactggttgaacatatacataattattacatatgatcacatatgtcatcttatacataattattttttattgattaatccttattatgtttgtttattacttatcaccttttaaaaatgagaaactgaggccaggtatagtgacttgcacctgtaatcctaccattttgggaagccaaggcagacagatcacttgaggctaggagtttgagactagcctgagcaacatagcaaaagctcgtctctactaaaaatacaaaaaaaaaagtccaggcgtggtggctcacacctgtaatcccagcactttgggaggccaaggtgggtggatcacgaggtcaggagttcaagaccagcctggccaacatagtgaaaccccatctctactaaaaatacaaaaaatcaactgggcatggtggcaggtgcctgtaatcccagctactctggaggctgagacaggagaattgcttgaacctgggaggcagaggttgcagtgagcagagattgcaccactgcactccagcctaggtgacagtgtgagactccatctaaaaaaaaaaaaaaaaaaaacaggcctgatggcatgtgcctgtggtcccagctactgggcaggctgaagtgggaggatcacctgagccttggggaggtcgaggctgcagtgagctatgatgatcgcacccattgcactctagcctaggtgacagagcaagaccttgtttcaaaaataaaataaaagtaaaaatgagaaactgaagccagcccagagaagttgagagaatgatccatagtcatccacaaaaatgtgtaagtaaggggcaagactcacatatttctgagcagtgaatattaatgtatttctgaacactttttctccttaactcttaaagacatgctgtgagccatcagtatttttctagtcataatttttaggagctaaaatctcagtggtggtaagggccaaaataaataagcacatgaaagacaaggaacatgtgaatatgtgtaataggaacagtcatatgagcatccctctataaacccttgacttggcaaataaccgagctgttctggttcaatagcgccacctagcatccagacatagaactctatgacctaatattaacccattaccttctcccttcctagcgacttgaaaactcatgtgtccaatccttttactttgtgttttaaatactttccatgactagcactacattagtattcattttcaacacgtttccattacaaatgtaaacactggagccacagtagggaatttactagacttttgtgggctgccttaagaatatggtcaccaactattacaaaggaaaaatatgtaacaaattccaaacgagtgacttaaatcctaactttgaggatttaagttcatttataagctaagtgctttgtttggaatatttatacttaaatagttttataaacaatcacagagtacacatttaaatattatgctttttttttttactatgcatgaatgataaattagacctcccattagaaggatggtagtgtgctcactgatttcattgacgttgcagttttcaattttgaggatatttgctagaaaatgataacaaatatgtagaagaaaacttttaaatactatgctacagaaataattcaaattttaatccatcaataaaaatatcagcctgagttctatactaaataataaaagcttggcctatttataataaagaacagttattctttaaggaaaggacattgagttgggagttaggaggaacttctagttctttgtctgccatgggtctgcccatatgaccaggggcaaatccagttttcaagtggatggtctttaagatcttattattctaataccagtgtatcatgtagaatgttttaaggctgcttgttctgtcttttgttacttagcacaattatggggtgcttttaccccctcaaaaatattcctaggcagtccccattgccttagtaatcctcaagtttagttgtgggggtggtctccacctcttcgtgtcctctaggacaggatgaaatcctagctggagagttcctccttcagaatgtgttcttccctggagctgctgatgctcaagtgatcaagacaggggtcccaactccaactctctggtcacaatttccatccctctctcttcataacacacacacacacacctgtggagaagacagtatgtcataatgcagtcaaatgctctaccactgagttatccccccatctttttttttttttttttgagacagagtttcacttttgttgtccaggctggaatgcaatggcacgatctcggctcactgcaacctctgcctcctgggttcaggccattctcctgcctcagcttcccaagcagctgggattacaggctcccactaccatgcccagctaatttttgtatttttggtagagacgggatttcaccatgttcatcaggctggtcttgaactcctgacctcaggtgagccacctgcctcggcctccgaaagtgctgggattactggcgtgatccaccgcgcccggcctagtatgtcataatgattagagcacaggctctgagatagatagcccgcatgctagaccccctcctccacttaactgcataaccagaggcaaggtatagcccctctaagcctcagtttccccatctggataagatgcataaataatcttatgtacttcataggttcttgtgagtcttgcatgatcaatccatgtagagtccttagcccagccttactatatggtgagtgttcagtaattagcctgcccaccaagcccatcacaggagagacagggctgtccctgagagaaactggactggaggttctctttgtaacttctaggtgaaagaaagaggaaaaaattggaaggaacaaatgaaggaaatgattatccttgacctgtttcaccagttacagctgatacattacaaggaaatctcatgcctttaagaaacaatatttctgtattactgacttgggcagagaggaacgaacaattatattccagtcaatagcctgttccagaaacaattgcaaggaataagttaagtggaaatattactacagtgacatgctaaggggctggaagacacacataatccaagttaatgaggtttttatgcctgaactcttaccagaaatattagggagctaagacttttcactaaatgaaacccactgttgagacgttattggggccaactacccttaacttatgctgaatattgaattttgctgactgttatattccatgttatttaatagacatagaatgataatagagtttttttaagtaagattcctaagattcagctcttgaaaaactgttttccatgtgcagaattacgtacttcagaacactaaattaatgaattaataacctttgtccagcaggtggcgatgtctctccattttctcaagaaagtgcactaggttccctaatagactttgctctgcagacgggagtttacataacgcttgaacacagatgtacaattatgtccaatttgaggcctaaaaatgagatttttggatatgaaaaggattccaagtccaattgattgcagtagttcaaactgcactttatgaaagccagtggagactaggggaagagggtggagttttgcaatcaaataagtttatgtgagttaaaagtatatacatgtatatctaaattatatataaagtatatgtaatatataatgtatatattgtacgttatatattatatataaattatatgtaatatataatgtatatattgtatgttatatattatatataaaatatatacattatattgtatacattatattatattatattatatatacattatatattatatatataatgtatatataatatataatgtatatattatatagatacaccactaactctggctttagttttaaaaactaacattttagaaagcctgaattaaacaaattctctctttcatttttaatttccatttttattttccacttctattgcttctgtgctgcagcaaaactcaaaaatattctggaaactcccaagtatacaatgatggttaggaggaattcagattagctatttttagaaggcaattaagttgtttttaaaaactcagttttcattgatgaaaacaggactccaatttgctattggttcatttaccatcgatattctctataaagatttttttttcaccagccatgtcccaggctcagatcctaataatgtcagcactggatcttgtgtgtgtgtgtgtgtgtgtgtgtgtgtgtgtgtgtgtgtgtggtgtgtgcacctacccatgttcaaacaactagactccttattatatagcactcatacatgatgcaatcatcttaagatcacaaaatcagtaagtttctaagtcataattacttgtataacaatatgcagttataaaacactttcatatagatgatctcatttgattcttacacaaatcccctgaagttgaggaagacaatttttttttctcattttctaaacaaggaaaccaaggctcaaagaggctgaacaacttgctcacagtctcgccaagtcctaagggacagcactgacattcacgcttctgtccccaggcccatcacaaaacataaatctgtgattcctctaaaactcttctttatatttaatcattaattcagaagttagtgagtactaagcattcatagtatgtattgccattaaaggcaagagcttaaaaataaaatctaggctgggcactgtggcttatacctgtaaccccagcaccttgggaggccaaggcaggaggatcacttgagcctaggaattcaagaccagcctgagcaacagcaagatcctgtttctaccaaaaaaaaaaaattaaaattaaatatatagtttatctctgtccaacgtatctgtctgttcactaagaaacatgagtttaggaatcatcatagatgattgtttttaaaaactcaattatcattgatgaaaacaggacttcaatttgctattggttcatttaccatcgatattctctataaagattttttttttcagcagccatgtcccaggctcagatcctaataatgtcagcactggatcttgtgtgtgtgttaccttaacacacacacaagatgtgttatcttaagccagtgtgttatcttaagccagtacgaggcaatacacacagaaaaaaataattttgagaatagatctgtttgacaacacctgacgtctttccagtgggggttgcggggacgtagggaatagcagtgcaaggtctttaagatagtgtctaaaaatctaagctgggctgggcatgctggctcatgcctgtaatctcaacattttgttaagccaaggcaggtggatcacaaggtcaggagttcgagaccagcctggccaacatggtgaaaccccatctctactaaaaatacaaaaattagccaggcatggcaacacatgcctgtaatcccagctactcaggaggctgaggcaggagaattgcctgaacccggaaggtggaggttgcagtgagctgagatcgagccattgcactctagcctgggccacagagcaagactcatctcaaaaaaaaaaaaaaaaaagtctaagctgaaggcatataactggttcagctgtagctactgggcaaatagttcattaaaaatgaacacataatgtaaacccctttaacttctaaacacttgtgattttttttagtgaacatttttctgaggggaactgtataaccacaggctgataacatcattcagtttacagaaacatcaccaattcacaagaattcagcctctaggcttgtttaatttactttatgaaagcttaaattgcagcataatatatgtgcgtttggcctatttcaactattactctttgttttattggaaaacatgttttactcttgcttactgatttgttcttgcgttgggatcatctctcctccaggagaaagcatttccaattttattatgaaagattaacaggaaaatagaacttccttcacagacattgatgttctaggaataactttacaaaaatatttctcttctctgaaaactaatatttaaataggtgtaatctgaaactaccagaaaaattcaacaaacacctccagcaaataaatagctgagtgtctgtgatgtccctttcctggggaagggcagtataaagatgaaaatcttgtctagctggaaggccgtcactaacagggctggggcgcataaccctgtggagacatttgtgcccggccttaaagggtgcgtaggagtttgccaagtggacgtggaaggaggcattttaataagaggaaaataacatgattggaagcgtggaggtgagaaagcatagaagcactcagagtgaggagagctggggcttgggccagcccacgtcagcccctgcctgcggacccagcctcttggagccaggctcactcaccctgcctttaagacggccctaccagaggcaggagaaggatccgcagcctcagctttctgtggcgcaacctggcactgagtcactcataccaatctcagcgccagtggccaagccgctgctgccggagggcctgtgtcaccctccccccgtttccctgccctcttcccatcctaccaccacccaagctccctggcttcctaacagtgtggcagggatcctcccaggcccccatcctcctccagcctgagttcttcctccctgctgtcttcccagtcttccccactaagatcccaccacccttcagacccgggctcacaccagctcctgctggccccatgtgcctcgcaccgaatacaggaggtcgcacactgcatccccagacaccaagtactgccctgcttgaccacctatgttcccctgggcccaccagcatggactctccttctgttaccagtcactgcctgatccaggcatgagctgcctgtgtcccccgacatcatcctcctggcaccatcctctgctcttcctggccttcttcactgggagccttcgggatcatccctccagatcaagttcttccagccccacctccctcccaccctgtgcacccagggaaattcatctcttctgggtcccaaccttggcctcgggagagccccagatgcccccctctgtgtctaccccagttactcagtgtggtcagacttgggggttgtacagttttctgtctcatgattcatttccccaggcaaaaagctggctaataatatctgggtgtgcgggggaggtaccagtgtgtttctgtgtttggaggtgaatttttttctactttagaatttaatcacttctactttgagcagtttttagctgagctgacagtaatatgctctgcattgagtatttgtagggggtggaattagtcaccacaaatttcaatttttggactttcctgataacgccacaaagctgaaaggcttctaaagcttgagcaaagattggaaacttgaccccaggggttgatggttgatctttataaaaacgaccttgtggtcagtttgttcttttatgcttaaattgtcaaggtccctgtccaccccaggaattaatgtggtgatgtggaaagagcactagacaaaggatttcaaaactgtctttgggcccttggctcgtggccttagctctctgacattctttgcttataaaatgtaccccctgccggggcgaagtacaatccttacccattttgcatgactcaacattttataatggaagcttctatttttgtctggctaaatctttttcaaataaaaatatttcttggtctgtatatttttcatgtctcagacatttttatcaatacataatgtcctagcttttcacatcttgcaaatggcacagaattgtgaaagaatacagcaaaaagctagaaatatacctgtgtatataacattgctggggatttttatgtgtggtttcttgtgggttctagtaagcacgttcatttcattacctacaaacgcatagaaaaatccaacataatcccacactgatgagaagaagagagggttgtttgtcaggtggggtagtttcacttgacttgaaggtctcaccccgcccctcgtctttaccatagcatacgcttctagatgcttctgctgcattgtcaaccagactctaccagaactgtttttcaaaacatgtgttcctaggattttacctccctgcattttttgctatatctattaagtaatgcatgtatataattaaaaatcaaatagtcctataagatgtataatgaaaaccagcagtttcctattccaaccctcccaaagatgaagtctgatgttgcagagccaatcactttcagcgcagctagatgtttcttcggataatcaccgcgctatctgtaactagtatgcacaggctgctgtttcttgatttactggggtcatgatctcattctcttattccattacctttacttctacttccttgctcctctccatcttcctaagatggtcatacccacatttgagatgcatggtcctgctgacgttgctgtgactatatacattttgttggctgctgatcagagtagtacatcatgattttgtttcatttcttgcacaacttaattgtttttcctggaattatttattgccttcatttatttgcctagatttatttgtacctatcaaaaatttcgtatgtgccaaaattttcgtatgtgccattagatctgccgcattcagtattacttttggtattatttaaatattaattaccagataagtatgtcagttccatcccaacctgccctcccttcccgcagaggccctctcctctttccacccagagctctttaagctccatcgcagcctgccctcccttcccccagaggccctctcctctttccacccagagctctttaagctctatcccagcctgccctcccttcccccagaggccctctcctctttccaccaagaaagctcctgctcctagtatatctgggttcattactctaaacacagctttactgcagcttccctttactatgtttctcagttgggtccagttttcttaatctcggggatgctatttcttgatttaataactcattttacttcaagatgttcctaagttgcctcctcatgaaaggtgcatgggagggaaattttttttgagtcattgaaggtctgaaaagctcagtattctactctaacttgatggctagtttggttctcatattcatgctcattctctctctctctctctctctctctctctctctctctctctctctctctctctctctctctccttggattgtctctttattccttttatgaaattttacaatatgactcggtatgtgtgctaaatatttagtggatactttcaggcttaaaactcctgtcttctatttctgggaattcttaacattttgtttctttgatgattttaccaccatgttctgcttcttttctggaatgcttttagtggtcagatacttgaacctctagattcatcctttctatgcgcttcgctgttttttcctccctcaattgccatcttttgaacattttttctctggaagagttcctcaatttgtattccagccactctgttgaatcttctctttttcagcctttctttcttctttttatataacatcttgttcttgttagtgaatggatgcaatattaccttaaaagtctaaaaattatagacattggtttaagcgttttcatttattccccgctttatctctatttgctccagattcctttgtactgttttggttggtttgggctctctttttcagtctgaaggctttcctctggtgacacttgtctgtctttcgttttaagagtgaggcactaaagagctaattgcagccggacatggtggctcacacctggaatcccagcactttgggaagccaaggtgggtggatctcttgagctcaggagttcaagaccagcctggacaacatggtgaaacctgtctctacaaaaaaaaaatacaaaaattagctgggtgtgggggtgtacagtcatagtcccagctatttgagaggctgaggtgggaggatcgcttgagccccagaggcagaggttgcagggttgctgtgagccaagattgtgccactgcgcttcagcctgggtgacagagtaagaccccatctttaaaaaaaaaaagcgaagaaaagctaattgtaagtgctgtgcaatgaaggaggctcattgaccagtggacctcgcttgaggataatcaaatagcaatagaggttttgctggaaaaatatttgttagtgattgtagtttttttctctctggagtttgtccagttttcccacggaaaaattatccaaacatctgctttggggatgggagatgaagtgtggtaggagagtggagcatgcatgcaactggttgctggtgtgggaacaggcgctgaaggttctcactgaatgcaccagtttccccagtgctgggattttagcccatacctctccttcccactcctctgggttagcaaatcggtatggagcctctgcccaaactatctggagactgatcctaagattgcctgcccctggctgtggagggaactggggtcccagctgcttcatacctagactgccagcctcagacccagctctcccgtcggggacacccagtggtactccatctctgactctcagctgggtgagctgacactcccgagccatgtcccttttcgtcagcacttcagactctcttcgtctgctttgcctaatcggatgcgtgcctccaaccgcatttcatcttccagaaattggtggaggcctgccttccactgataatccttctccagcattttatccatcttttaataaaatgccatctttaataaaattatcattccttcactgtcattttagagaagtttttcaaaggacaggcattgaaggcatgtaatcagcccactacatttaactgggaatgttctaactacctgaactttaagattctgctgccagctttgtgtttaccgttcttagctagatctgtcacacacatatcttttatgcagtatctgtgtagccatgatgtgaatcaaactaccgtagcactgccttcagcatctgtatcttgggattatagtactggtaaaatttcaaaagcaaaactaacaaaaacaagatcctttaacggtaattgattaattaatcccttttgggtttttactggatgacattaccatgatgaagctccacacttaatactatgattttaaaattacctagaagacaaatcagggctgtactggaggtttcttgtgggaggaaatgtaaattataagaactgataaaaacagactcctgtgatcagaggcagagcgtatgaccatttaaaggtatcattccacataacctggtggaaaaggacatcttcgtttcctgtgctgttaggtgtcagtttgggggaaacgtgttccccaggttatgcacagatggcggcacaggcatggagtgggggagtgaaggcctcggggggtgagcacagccagtctgctcatagacagaaggaaaagcagccatcgtgaaggctcgtctgccgcagctgctccggtagcaggagcagcagctcatataacaaatgtttcatgacgaatgcaaacaaaagccagctccgaaattccagccatgttatgtccaagccagttcaaaatcgtataaccactccatttgagttttttcccctctctaaatacattccatatgagccgtggtgtcagggttgctgggatcgcctgcgttcactcagaaaactgttgttaaagcccagactgaagggaaagtcaatcagtgggaaaacaaactcaaagaaaacacggaggcccaggtgtgggggagggggttttccccagccaggcaggacccctggaatgaggctggaggctggcgaacactcttccagcacagaaggaagagtgttcttgcctgggagcaggaatgtgttcagtggggcccctgtgcctgcggcggcctggccacagccaagcaccgcgactcaaagtgtggtccacggaccggtgccagtccgcaagctgcttgctaccagcccgtgacgagataagggcagaaattaagaagcagcatttggaagctttgatgggaattttacgtggctgtggtcatttttctgacaatttatttttatcgtcatttacaaaagtgtcaatctgaaatggattaggtagggaaaacaatccgaggttattggagaagcactgccgtagattttcctcccagcgtgggctgcctgggtcagcaaggtagaaggccagccagtgggcaagaccactcctaaggcatctggggcctccgaggcgccatgattcttccatagggtttggccttcttggcttcaaagctcaaacatgtgctgccccatagcaatggccagacgcccaaacctaaagagagagaaactctgtcttcctaaaactggttcctttttgacccaaaacctttaaaagtggcaatttgcatttggatagcgcttttacagttagcaaagtaccttagacttacattggttcacttgttcacatctctgttaggtagtgttgtgaatcccctaacgttacccaagaattgagaccccttcccctgcaaaatatgttgaagtcctaatcccctatatctgtgaatgagaccttatttggaagtagagactttgcagatgtaatcaagttaagatgaggtcatactagattagggtggaccctaaatccaatgacttgtgcccttaaaaggagagagagactgaggctcaaggatgaaggccagtgaagatggaggcagagactggagtgatgctgtcacaagccagggagcaccaagaatttgcagccacccctggaaactagaagaggaggaaggattctcccctcgagggaaacacaactcttccaacccatcaattctagttttcaaaactatgagagaataaacttctgttgtcttaagctacctggtttgtggcaacttgttatcataggaaactaatgcagttagaagtcctcttcctccccatttccaggggaagacctggagggtccgttcgcattcaaaatctgcccacgttcaaagcagctgtgaggagcaaaccttggattaggacaaagagccttcaaagatgaacactgtcctctggattgcctttctttgttgtagaaaggaattggggggaaaaagatgtctaatatttggggaaagctttataagtgattttacagtgatgcaatgaaatatagtgaggcggttggagttttagtttgaagaatgttaatatattggaaaacagaaaaacaatgaaaaatctgacacaatatttatatttatattatacaatatttttatgtatttgttgtatacacacacacacaatatgcttagcagaacaaactagaagggaaaataccaagagaactgcagttgttagttgtggtggtttctgcatggttttagtttctcctgtagactttcctgtgttctctgcctttcctgtaacacacgtgcattacagagagccacatgtattagggaccatccctgtccagacactatgcgctgtgatgtatatacatatttctttttcttttcatttgttttttgagatggagtttcactcttgttgcccagggtggagtacagtgacacgatcttgactcaccgcaaccttcgcctctcaggttcaagagattctcctgcctcagcctcctgagtagctgggtttacaggcatgcaccaccacgcccagctaattttgtgtttttaggagagacggggtttctccatgttggtcaggctggtctcaaactcccgaccttaggtgatccacccgcctcagcctcccaaagtgctgggattatacatgtgtatttctaatagtcacagcggcacggcaagttagatattagcattgctattctacaaaggacaaaacacagccagacagtctaaggaccatactcagggtctcatagctggtgcaaggcagagtctgtctggctccaaaccctgtgggcttcccaccacgctttgtagctttttctatttttgtgatcaaacaaaaaaaaggacgacagtgagaagggccacaactgagcagcgaggaaactgtcgctgtggccccttaagggagggcttgcttgtgctctgtcctctgtcatttgcacgaagtggaggagtcctcttttttttggcagttaactctacaggggcttcttgaagacaggggccatgacccgtcacttccatcaaaagtcgtgactggctctccttctcccatccttctctcctttctgacctcctgcctggcagagttttcagaacagcatgtaaagcatggttactcaccgagcgtgtctgggacaaatacctggacatgcctacctgggtcactgggtggcctgttcctccaccacccccagatctgaaggctggttaggcataaagataaaaattgccactgttctctttttcatacagtcctgagctcttccaactcaaacaactcaaaccttggcggtaacaaagttaagtatttaatagctttttaaataaagtactgaaactagtttgattccatttgtatatcacagtgtcaccctagcattttaattttcacttgtctcattctttctttctagtattttgatctgatttttacctgtattatttgtattttttcctgcaaaatgcctgtagatactagcaggtaagcattgtaaaaataaaattgtaggccgggcgcagtgactcacccctgtaatctcaacagtttgggaggccgggcgggcggatcacgagggcaggagttcaagaccagcctggccaacatggtaaaacaccgtctctactaaaaatacaaaaatgagccaggcatggtggtgcatgcctgtaatcccagctactcgggaggctgaggcaggattatcacttgaacccaggaggcggaggttgcagtgagtcgagaccatgccattgtactccagcctgggcaacaaaagtgaaactccttctcaattaattagttaattaattaaaataaaattgtattttgtatgtagtcagtcagtgaaagacctgcgattcagtgcattctccagcatgtggtccccctaagcacaggtgccaacaaactgaactccacggcgtggctttgtaagggctcagaaacatccaggtaaagactcccaaggcctctccttactggtttctgtttccatgatctgaatgcattttctcagccatcttactaagttgtcatagtagagacaggcactctttgccccagtgaatggattgcgtgacatcctcctccttgctgtgagatacagcctgtgcatccccgtaagaccctgggtggacctctgttatacagaaacattgcccttttaaataaaacctaaagaaagtccatgtttcccaggtcggccttgaaaaagaaatttcctgagggagaggcagctgggccatttatttaacaaacactagtgatggtgcacttactgtgggccagacagcatcatgagggctttatggatattgatgcatttaatagtcctgatctctgtgctgacttcctccttgcctgggacctcttgctagccactgctggctgcctgtgatccactccaggaggagttggaacctgctggctcactagtgggcaaagaacacctcctcttggacctccagcccagcgagctatcgctgcaacatcctgcaggagagcagagggcaaaggcatgagataggagcacaaatgcagtgaggccagtaagtgtgactggcctgttgaggttcatagccaaggaagagacctggagctgggatgttctaccttttgtccccttgtccatgccccttgctcttctggagggaacccctctcctccagggtagcccctgcacaccaggccttcagtttagtcatggagatcctttccacagtgacacagagtgttggtgacaatctctggtcatggtgaaatgcgccgctgttcagatgcctcttcatcgcttgttctctcccacaactggagaccatgaccagaacaaagagagtttctcttctgcatcctgctactccatcttcctggacagattcccccgctacatgcctgcctccaggcctccattcccacaccctagaccaccctctccatgctgaccacccttggcaccagaaccgtcctctcctaaaactcgactgtcctgtggcccactccccgaggaccctaatagatcattctagaacaaagatctagaatgatctagaatacaatatattgacagctgacaataacacaatttgtccttcccaggggaatttctaataatgagaatagtgatcacagaaatactagaacagtactttccacgtagtgggtgtacagtaaaaatgtattgaattaatactgaatgcatgtactgtgataaacattttatgtgggctacctaatgtaattatcagaataatccagtgacttaggcacttttattattcccattttacagatgaggaaactgaagtttgtatatgacgtcactattttatggggaggctccttagaaaaaaaaatcattttaggcactttttactatacatgtactgataattattttaaagagctttttttgtaggaagtatgttcttttattcatctaaatttggtgcactaaaaatacaggtgatgtgatgtgaactgttggccatttaagcaggttcattatctcacatctttggcccttcctgccattcctctcattagcagtgtgggcagagggttaaatcttggctgccgtgggatatggtgagaaaccctatttgtgggtagcttgccctggtccacactgcaccaggacctggacccaggcatagcactgcgccaccctgccacccgtggtccagcagggccctgaggcaggtcactccacttcaaaggaaggagtcattcatggtggatgtccaggcgtggcctgtgctactaagagtgagggctttttgcaaaagagcagattttcagtagtacttttcctcctccccacaaactatgccgttcctacaacactaagtgtggcccacagcagaagttcttaacctgaagtccaccacatggttttcagggaatttttatttgatttgatatatattttttcctaaatgtgagatggggtctcattgtgttgcccaggcttgtctcaaactcctggactcacgtgctcctctttccttggtctcccaaagtgctaggattatagacatgagccaccacacctggcctttcagggaatctttcagctgctccatcaccatccttttctttctttctttctttctttctttctttctttctttctttctttctttctttctttctttctttttctttctttctttctttctttccttctttccttctttccttctttctttctttctttctttttctttctcttgtttcttttcattctttctttcttttttctggagacagggtctcactctgttacccaggctagagtgtggtggcatgatctcggctcactgcagcctcaacctcttgggaccaaattctgtcctcctgcctcagcctcccaagtagctaggaccacaggtttgtgccgccatacccacttattttgtttattttttatagaggtgaggtctcactgtgctgcccaggctgatctcaaactcttgggttcaagcattccacccaccttgacctcccaaagtgttagcataacaggtgtgaaccacgacacctggctgccatccagtttatcagaaaaaaatttcatattcctgctttttttctgggaagcaaagaattttcagattttcacaggcatccgcatcccctagaacagtgagcattccagtctgtgtggaaggccagtgctgtggcctccttttctgagggctggccctaccacgggagaggaagcactctggtgggagccttgatgtggacaggcgtcatctgacggagagccaccaggaggagccactggctgctgtcagtcgggagaactggcccgaggccctgaggccggccatcttgttcagagccaggatgtggcgctggcactccaaatggtgaccaagccttttgtttatgcgggttgacttctggctctgccatgcttctatatttccacattataacataggatattgtttgcctaagtataatagggcatgtgcgttggttcctggcatcagccatggaagattagcttactttcaccaactcagaatcagtcccagtggccatcacaaaagaccacacaactcccagagtgtctataagtagatacaaaaccacatgtgttattagtcttgatcttagaccatattattattagctttgctttggttgaaagtgggccccatcatattgttaaaatagagtttcacagcctttaagtgactagggtacatcacttttaagatgtttttccaaaagaaaatgttaaatcccaaatacatttttggctgaatagttggttttaatggttcagagtcaaaaactgtaacttaattcctagtaaaacttgaatcaatttcatgagggttttgctaaacatttccctctgttcagcctgagacttctaccagttcttaaatctcaagcaatattagcatattcttttaaaatgtcaatgttttttcatttcaaaaaaaaactcttgtcagtgtctgacttctgttgacatacagtagcttatttgtggcctccattatggtattgtggttaaagtctcccatttcccctcactctctttttccctagtatcagtgaggaaacacaatgtcaaatgacagtctgaacaactggatctgtactgctggcttcaacctcaaatgtagttcgctgcctttctacattttgcttttgagggggatgacggtcggtgggaatgttattcagatatcagcatccgtaggctgaacttaatatgaagtgtgagtggtgcccgctctgcctcattcggccatggggtttattggggaaatggcgtctgctgcatgcctgtggctccagcttaataccaccagagacaagaatgctgggcgcagctgaaaggcagtaacccatctggagagctcctaaaaaggatccaagtttgcttaataatgtgctcagtagtctaatgttttgggcacaaatagcaaaaagctcttccaataacacgtgctttggatatcagattaatctggggcaggaaacacttgcaaagtggaatccacccaagagaaaaaggccaatatgccagcatcaaaggcttagtgttttgttttgctttacaaagtgagcacatagtgagcacacattgctgaaacaatcaatgtctcaactgtatgccaaattctgtaagttgataagtaccattttttttattaggggtgtaactaatagagcactgcttttataatctagtcctactttcagattcagagagatttaggcattctgaagttaagtcccagggcagggtctttactcaaagtgtggatgtgtggacaggctttctggctataagcagtagcattagctatttggggctcagaaacccgtgcatttgaaatttgtcattttttgtgaaactgggtttttattttgagagttgctcctgtgttccttatttttccatgagttcaccttcatggtatactaaacttcatttttacttaagatgcaatgctacatagaaataaggaaaagggatttatttggtccacaaactcaatttattgtattaggttggtgcaaaagtaattgtggtttttgtcatgaaaagtaagggcaaacatatttttgagcccagatgatgtgcccaaccctgctagtcacacaaagaacagagaggacatggatggcgctcaccaggaagtgtgtgtgggtaccctgcggatctctaggcacaggcttagtaacaattctcttgtccaccacagggaggtgactggaaggtgccaggaagccccaaatgattctagttcactattgccctctcatatacagaacatctctctcctgcagttgaaagactgagcttaaagccagcaaaaatctctgagaaggagaggtggggttttaagagcaaggcaacccccttctagttctccattttctttaatcatctatgtaggattttgtgttttatttatttaaagggatgcagattactccacagtgccacaattttgccagtcacccaagtctggaagcttgaagtcctttcaattataccttaaaaaaagccatctcccagaatatctgcttagaaatgttctagatattttcccagctcaccatagagctgggaaaccatcacagaagccagattgctgaatgccaggcatgtgactgtcaacaactattgttttctggaggccacagtcaagaagtattcaatagaaaattggaaagagattttcccttcaaatccatacacagctttaatgcacttagaacatacctgtgcctggagtatatcgtgcatccctgtttatggagcctagagtcttatttggtgaacaaaatgtaagcaagaatggcttcagtcctatcctggaagtttaacaaaagcaagctcagaggcttctttctgttgggaatatgcaggtcacacacaattagtgttataagttggtcccaaaaccagtctactggccaggggtagggccaccactgcctgttagcaggccaaggagttggctgatctttgggttcctgtttcacttcagcttgttctggatcatctgctaggaagctaaaagctgctctttaacaagaaggcatcttctatctgtgaagttttcttctcctttcctgagatgtgaaaatggtatagtacataggtcaatcatggtctttgcagtcagtagacatgggtttgaatcccagctctaattcttaccagctgtttaactgtcggcaatctccttaacctctctgaatgtctgtttcttcatccgaaagcagagaatggtgacctcacaaagctgttttgaggattaatggagataatgtgcccgtgcaccgatgtacagtttccaaggcacttttctaatcatctcatttgattcttccgtttccgtctgcaatagggcagggttttcaagtgctcaacttagtcaagtttttgagtttgaaaggagagaccaacacaattgttccaaagtctctcatgatgcagattccagcattccctggtgtgatcccttgtgaagtgtggcatgaggactctactggcttcagcttttctggtggcagtagaattgcccatctagtgcctactgatctgagtggacttgacttcttggccgtgtctctgtttggagttaaagaggaacgattttccttgtgcattattttgaaaatcacctttgaagtcactagttagagttgttttcaaatgcaaatgtcgaggtcacatgaagttgagtgaccacatcctgtggcacattcccacttgctcttctagtttatttttaatacagaccaagagtaaaaatatatacacaccccatttcagatgcaaattgaagccagactttgtttctacatatctgtgaaatggagtaagctaactaatgggaaaaaagattatgcctaatacttagacatagtttgctagtagttgctaatgtcaaaataacattgagtttttaggaaaaattaaggaatgtgtacagaatgatgctgcaattatagtctttatgtctttaatgaaatagatttaggatttcattagaaatccaatagaagtaggattttccacactaaggctcattagtcagagtcaaggaaacacattttcataatcatttatggagcatttcaaaatttaaaagtccttttggctctctgaaatctaatcttatgtgttctcccaccccttggccattttgggatacttaaatgaggtcagagtttttcattaacagttcaagcccttgtgagaaattctagcccagaatttctacttgaaatgtgagcaccaaactttactttgggaacaacaacaaccaaagaaatgcaaaccaagaggacagaccatgttcatgcatgaaaatatggaatatcacaaaaatgccattttcctcacatgagcatataatttaaagtatttttttttagcttaaagtgattctcaagctcatctggaaaaaataaacaagtgacatggccagtgatctttttttaaagtaatgagaggagatttgcccaacaagattcaaaaatactagaaagctcttgggtttaaaataatggtgtaaaagcacaagctcagatagacaagtcagtgaaacagtaacagaaacagttgctaatgcaaaaggtaatgtgctctctggtaaagatcattaaaaagaaagaataaataaaggtgtaaattagttagctaaatgtttagggaaaaaatagtctccttatatcatgggccttaataaattccagatggtctaaagagttcattttttttttaatgaaaatatgaaaggaatagaggaaaatatagttgactgttttttggggggatggggttttgctaaggatttactaagcataaaagcagtaaaacacatatttatacaaggagaaagtaaagggctggcatggtggctcatgcatgtaatcctagcactttaggaggccgaggcaagtggatcacttgaggtcaggagttcgagaccagcctgaccaaaaccccatctatactaaaaaatacaaaaatcagctgggtgtggtggcggatgcctgtaatcccagctactcaggacgctgaggcaggagaatcgcttgaacctggggggcagaggttgtagtgagccgagatggggccactgcattccagcctgggcaatagagtgagactgtctccaaaaaaaaaaaaaagagagagagagacacagtaaagaataaatatgtttaattgaaactttaagcatgtttaaaacatacttaagttggcaaaatatttgcaacaatgatatcatatgattatattttaccaaaacatgaagcattttttacaaatccataagaaaatcactaacagaaaacaatggagaaagagaaatacaagttaccaacaaatacactaagaaataagcccaaccacattcataatctaagaagtgcatattaaaatgagaccatattttctatgaaattattattgtctgttatgtgaacaaacactgagcagtcgtggagtccccgatgatgaggatgaagagaaatggcgcctcaggagactcctagagggagagcacattgttaacccctggggtaaagagcaagttagtgatacatcttaaaagccttcaaaatgcccatagctgcagaactgatagaaaaatcctgtaccttgattgtggtagtaggggcataggtatatatagctgtcaaaactcatcaaattgtatattaaaattgatgtgttaattaaatgtaagtgattctttgatttcttggtgaggaaataatgtttacaatctttgacccatttcaatgctagaaaaaaaaatcatacaggtacataaaaactattataaggatgttcctcacaggatagtttaccattgcacaataaaaagacaactgtaaaaatagaagaatagctaaatacattttgatataccaaaaacagttaaatgacatagctgattgcttgaaatatgatgtgacatgaagtaaaggagaaaagaatagtaaatcgtatttacaatatgataccagttttactagaaaaactacgtgagcacaggaaatgattaaattgaaatgctcagaatgttgatgttgttagtcatatctttgggtggtgggattattagtaatttattttcttcatttcccaactgttagatagtaagcatgtagcattttaaattatgggaaaagcatgaattttaggaaaataattgaatgttcagataaaaattatatggaagcagaaggagagcccactggcttactgtggaattgctgggagcacacagaatttttatccctctctcttccgtgttcttttcctgcacccgcagcaacactgatgaaaatggggcaagtaaagaacatcattctcgagggggcagcacagttgtgtgcacacaaaatcctgggttccactttttgtccctttaccagcccctctctctaagatatctaacctctttttggcaactgtcctttggatttcatcagttcacctggcaaattctagccagtagttttttaaaaactcaccttgtctctctctctctctctctctctcacacacacacacacacacacacacacacacacacgtggccctttcttgtatacagaagctataaaatgtgtgtagatttctagccctgaaatactaaagttctataattctgtacttaactctttaataatcttgacattttatctaccatatgaactacggtacaaacaccattaagggcaggacttggctttccaggcctgaatgcaggtatttaaaataattgaattacaagaaggtagctcatagatcttttccattgcagcataactgtcttgaatctgaaaacacattgtctgtcttaactctgcagtagctgacacaccctcctcctcacaagtcactgtagtagtaagattaaatattataatgatggtttagcaaatcggatggggactcatcagctattttcatatcaagaactgaggttgaaatatgcatcctttatttgtttttcattgagtgattacagatggcacctaataaagtcttcatgctgtgatatcttgaagccattgatttatgtttggtaagtgtggacacaccaactctagtcaacctccctcccattacataccacaaggaatgttaaaatgacatttgcctatttgctttttctagtgactgatgaggatcctttctgagaggtaaacaccagcattattgaggagtgaagtttaggcttgatatttttcaataaagtatattcctcattatactttatcctccaaaataaaatgacaaaaataaaactttggacttttctttggatacatattagccaaaaccatcatgcccctggtaaatataaattgattctgagtttttagaaaataaatcacgaattgtacaaaaacattgagagtcagaagatgttagaatactggatgtggaggtgaattggtgtgccttttcttccatttgatttggactatggtgtgactgactattttagcatctcttcctaattctttcctttgttgaaagtgttgtaaaggcccacatgccaaggctaattgtggggccagagccagggagactgctgggcaggtggttatctaggcagggatggcagttgggcagaaggcacaagcaatacaagctctgggaacatcaggtggcttcagtctagagacacagatcaggtaacccagggaaagatggtggagttgaggaataatgctaagagtgagggccacagaccagcatcgaccagaagcctccacggtgaaatatggattccatgagcttggactcagcagccaagaaaagtctcatttaatagtcattgcgatctcaatttcacagccatatcgatggagaaacatctgtgctcaagaggagagaattccacaacagcttacagccacacactggtcatccctgtgaaagatgcagctgaccagacatgatgtagaaagtcaggcaggccctctgaaccccatgggcgcctctgccaagtggtggcgagcattctggaaaaagtggaaaggccaatacagagaagtgacgggcctgcaaatggtcctgatttttctaacaccaattcaggggcatcattgggtcttttgacccaagatcttaagtggatcctctgtgcatttcattacttagttaaatagcatgtcattccgtaagaaagcaaacctgaattggttttgcctaaactacatagcccaggaaattgagcagaggattgaatggcacagttcctgatctcagcaggctatggtttcccctttgtatctccactttgtatctgactgcattttctctttgccctaaaccatccagctattgcagtggcgatgggggggtgtctgacaaaactttacttttcttccttttttattaaagtgtttcagatgctgcagtcatgaatgatttttgaatgtttattatttacctaatacaggcaagaagatatagtagaagataaaaaatgaatagaaaagagatagtactacccaaatggaactctattagggaggggaaaatatgtgaaacatccaaaatatatttttgacatttttacagaattaaataattatagattatacggtattcatgatcaagaagtgctttggaattttatgcacctaatgaatgtataggtggggaaagttgatctataaatgcacatgtatactgtaagggatatgaatctttactttcactgaaccaccagaccttaaaattttataggagcagagcatctcaaagtcttgatgtctgtaatttcataaagtatcattaacacattaagtttcaactaaattgaaattaattgtttcatttggggagattagcatttttctatttcagtggcagaatactgatgtttcaagggaatatattttgaggataacagtcataatattaatagttgttgttattatatttaacactcattgggagcttcttgtgtctcaggaatcttgttaagtcctttagatgtactatttcatttaatcctaagaacaaccctgtgaggaagatactattattatgtccattgtacagataaggaaaccaccaacttagagatgattcataacgcttctatgttactgagctggtcgctagcagcactcaagtgattgaacattcaacccaggcccaggtgacttgcaaccccgtgctcgtaagctcttaactggtctctctctctctctctctctctgaaaagggcaaaatctaaaacatgattatctgagggagatggggtagctagaaaagtaggattctatgaaatgttattctgctgaattctcaagaacacagtgtttctggaaagcttagtggttctgttgaggtgatgttcattgatattctaaatgtgttactttgttttatttttttgttggtgggggaagactttactagttggaattactaaaatcgctttaataaagtgcttgcaaagactcaatctggttaacagtaaagccatttgtttcagtcatgtcagcaactttggttttcataagggttttaatgaatcggagagtggaatttaagaaagcaaacaatccaaggaatactccttatttttctaaaatagcaaagcaaaaatgggaaccctttccagtttagttacagcaagtatctattggagttttagaaattcttagagtacatcatttatcatatagaacaaaacttgattaatgaacactttttaaaagtctttttagggtcctattattattttagttgtttagatataaaaatattttatgacatattcactgttaaatttatagtgaattgacattcagtgacatttgtttttaaagttgtttattgaaatatgtagtctaccagaaataagtacggttaccaactactgaaatcaatttaatagtaatttggtcttgttagtctgttaaaaagaattattggccttcagatatttccacaaagccctttgttactcatgaatcccatcaagatgctatgaataaagactgtgaatatcaataagtttgaaaacattccatgctcatgttcagggtcatatttttccctgtcttctatgttcctctttgtggctataaacccaaacttatgtgttgtgtgttttttctatgacaattatggatatgacttatttactatatgctctatgaggtataacctaatgtcaactgacttcaactatgtttgccatacttccaaaaaaatagccactcatgtatctgtctgatcaggaggtgaaccgatggtgctgtatgaaattgagaactaattatctcataaacattctaagtggatataaggaattatgtgctcagttgcaaccactaatttatcgaagcaccgggtctaaatacctcagggaatgcacagaagcctgatggttgaaaagccttcaaagcattctctcagctaaaaagtacaagaattggggctcatatctagtgcctttttggacagttggtcacagaagcttagaaacattggcacaagtattgtcaggtggagcctggccgtgacctctgtgaaatggctgtcatgagcttggcagggtgggaataatggctctcctgccaccatctgtcacccctgtccaagacaccagcacaatttgagagcagctgtggttccctaccctattctcaccccatccccccatgcccagcagctccctccctgggactttggacctcgtgggaaaaaaatggagaaggagggaaagaaaagtacttgagggttttgtaaatgttcagaaagggaggggggtgcggtagaattaaatctacccaaagaagagccaaagagctttcacttgctttcccttctagccaaccagtaaccagtaggccttcattttattgtcacatgtaaaactcaagaagtgatgagtaagtagcattcaattagaatttaatcttttttggtagaaatggtgtaaaagttttcaatgaggatatgctgattcctggttgcatgttccacagcctttgatgttcaaccacatcatcttgcacttatagctaaaaggtgtcagacacctaacattgtcttagcaatcttctgtggttccagatactgtgtgcatcttacaggctggagttgggggacaccgatgcttaatgggaaaactaatgactttatacagatcttataaaactctgctattgtcggggggcaggcatttagtagattaagtttgtaatctaagagaggaaactgggcaggaaagacaagagtgaggtgaagcaccaccgtggaccagaaaaaggcttgaaattagaagcctttggcaaaagtgtgaaactttgccactttacattgttcagtgggtcagaaattgtcaaagattttcttttttctccaaagagaaatgacgaggaaggagagacattttttatttgttctgggtgtttgtttattgtttgttttggacaaggtctcactctgttgcccagactggagtacagtggtgcagtcacagctcactgcagcctagacctccccggctcaagcaatctgaaagagagacatttcaaaattgaacctaagactcatggtttatcgcatgagaacccacagctctcacagaaactcaagaaatgtcttagtgaggggactcaatcctttacacttcgagctgaaaggacggcagtcagcccagccaggaggttacctcagcatagaccaagtaaataaatcatttggtagaagccatttgagagtaaaggttactagaaagtcataaatcaaccagcaagtcgatgtatggttttgctagaatgtaggagcaattagaaatttttagaaatatttctttaactgtgcgtgacttgaggaagaggactatgacctaactaaccagttactattattatatcaaaatgagattttaaaaaatacagtatggatttaatgccggttcacttattcagttttatgcagttaagttgttgtttttagaacattatgaaatttcatttcatgccccaataaaactaaactaaaatggaatgggttacagcttttccatttgttgacttttctctttcaaacatctttgattttccattcattgaacacactttttaagaatgctttgaatgtcattcaagttacccgtttctcctgtcccctcccccacctgtctctaatgcagtttccaaagtgaaccaatcctaacggaacctaatgatacctttgagcacgtttcttagtaacactagcacctctttcttacctgcttctaattcacataatggcctttctagcattggctgattgtttctttttcatttcccctttatcactcccacccatgtcttatcaaaggggaaggctggtggttaatggtcagtgcattgcaccacaatttcatgcttgtgctgcatcaaaagtctaacctgacaatcagtcccttctcttccatctgacatcagaagcttctgcagtttctcacagccattggccatgaaagttcagctcaagaagtcatcgcaactaccttcatttatagcctgttgttgacctaaaacctaatgcatgtcagtgctcttctctgtttcttctctcatgtcagaaaaattaaaatgttttaatttttttcccaggctgcatttgcaagttttaatatgtctataacatttttatagtatatcagtatccatatcaaacatttaactctgttactctgcttttcttttcttttcttttttttttttttttttttttttttgaaatggggtctcgctatgtcgctgcagtgcggtggcgttagctcactgcaacctctgcctcccgggttcaagcgactctcagcctcctgagtggctgggattacaggcatgcaccaccatgcccagctaatttttgcatttttagtggacacgaggttttgccatgttggccaagctggtctcaaattcctgacctcaagtgatccaccaccttggcctctcaaagtgctgggattacaggcctaagccaccgcacccggcctacccctgcttttcaaagtcatagccatgatacccagggatttttccctcacatggtcctggtgtctactgacattagcttatcaatttcaaactttccttaagcaaaacaaatgggcctcctatacaaatgggaaggttgcagtttcatctcattttttcttagagttttgcctggttaaagcaatttggatgtttttagatattcacactgtcttatttagtgtgcagttgcaaatctgatttttaacagggagagaaggaagaggtagggctgttaatttgcattcccctaagactgagtactaccagtgggctacaggttgcccagataaagtacatttaattttaaagtaacattgcaaactctcccagtagaattgacagcatccttggaacttcatttcacactttcctgacttgggaatggttattttgagtagcacctcctattaacctaacttcttaatgcctggacagaaggttaaatatctcacttatctacatgttcggcctccatgaacagctgcttcattcacagcccttcaagggtttatcaaaatttccccatgtttaacattccagagagaacatccaggttgttggctcttgagactcaccattggttcactcactgaggctgatgattgtgactaatataatcttaaaacaaaaaatgcaataggatacattctgttaaagaaaatgcattttgaattaactataaaaatacaaagttctgtgatagccctatctgagtacccagttcatagaatccaaaaatgagaaaagatttcgtctccgtgattgtagtcatcatgtggtgtaatttgctaagaatttcaagtgcactaaatgttttacgagcaaccatactcccatattaagggcactgctgtactcctttacattctcagagtcaggagatgcaggattttcaaaaggccctgtgcattttgaaactttagcaaggtaggtgatagattgatttcatgtaacaataaaataaatgtcttaaagtttcaggatctctgacaatagaagataagtggtatcttagagttggcagaattgaagaccttatcagctataagaagaaaagttactgctcaatatctgaagctgccattgaccttagggaaacaagcaaaaaggcacatgatcgcttatgaacaaggatgtgcatctgatattattgagtcatagaaacagaaaacccaatcatctaacagtagcagatggttatatgacctttaaggcatctataaaatggagcatataaaaacacattgcaaaatgtaattggtaataattaaagatataggagaaatggtcatggttagttaaattttaaagatgataaaactaaataaacaatatagcacagatgtgttttacaatgaataggcataaataagaaaaagactagaaggaaatgtactactacagtaataactgtggcttgattaaaagttattttatattcttgttttcctaagtttcctaaaaactttactatgtatttgcatatgtgtatatgtacatataggtaagtatatacatatatctgcacatcatgtatacatgtacatagtatgtttatatgggtacatcacaatcagaaaaataaatgtttatgttttaaattatttttctccaagaaataaggtttaaagctcaaagcttataaacttcccaagggctttctgatgatcctgtgtggatctagatagtagcttgatctgtacgaaaccccagagaagaaaaagtaatagaccaacatgaaaaaatgagacaaagaactgtcctgtggtcatatcaccatctgtggagtgcccagagtgacggtgtcagcaactggctttaacatcatcagggctagatgtaggtaatgaagtgtgatttcaggagagggcctcctccctgccaaaggaggagcatgtgtgtgtgtgtgtgtgtgtgtgtgtgtgtgtgtgtgtgtgtatgtgcgcgcgcgtgtgtctgtgtgtaagagagggagagagagaagtaccctaggcctgcaaatgccacacagactatgaggagtagagaaaaagaatcctgtccataaagcaaaagcagagcttatgaaattgtcagataccaaaagaatttagaactgctgcaatagtatttctcttgatcttctttatccagatgaaaaaccagtttgatcaggatatccttatcagtcactgggtctggccttcataatacgatttcaaataaagtaacaaacgtaataaaaacacatttctcaatacttatatcaaattaaaagtatattttaagaaagagatacattttgttgataaagacatagtaattctcccaataagttttttttagaagtagatatttttaaacagaaatatctgcttcaattgttgttgtgaaaataaatccttcttttattgccatcctcatatataagccggtattttagtggtaaaaactgtgctgaggaaaacacacacgtagcacatactttcaaacaaattttaccgtagcacatactttcaaacaaatatgtatttaccgtagcacatactttcaaacaaatatgtcagctttttaatggtctgggccatgatgccgaacttggggagaaaagaaacatagcaacttgcccttcattcggtaaatacaggcagcagggaaagccaggaagccagagctgctgacttaggggggtggttgtggagggaactgaagccaccccaggactcattaccctcagcgtgtgtgtctgggccaggaggagttgagcttggccatctcctccagccctgtcatgttcaagtctaggcattaggatctgagggtgaggttgggaggctcccacatcaacagaagctgggatgctgatcagcaactcatgaaccgaaacctctacaagtgtcgggcccttccggtgatttgttgcacattaagtttgtccggcagggtgttcacctggctctgcagaaggacacgaaaggtggacatctgcggccatcaatgccacctccttgtgatccccctttctctccctcctgtggtgccccactgtgaggagcatccttcccatccgcagtgaaacagagatctccagattgcccaggaagttgttggaaggattgcacatttgcttctccctttattgtgtactccttctagaagaaagagcctgtgtttttagcttttattttattttatttctcttatttcctggaatcaagcattgagcttagtcggtgctcagtacagcattgatgactaagcaaaaagaatccaggcaagaaaataactaactaccaccaccgcccacccccgctagcaatttcagcagattctgagcataagtagtgtggagttgaatcccccaggcaataacctagaagccccaggcaataacctagaagcccgtccaacagctgccctcatctccaattccatggggttaggacccgcctccgtgatgtttctgaaaatgcattcctcctccgggctgatttccattccacaggggcccagtgccctggtcttggtgggccctcagcgacctaccccacacagaccaatactttctcttcctggttccttttactgtgttccctgcttccaaaaatccaagcaaagtgtgtgcattagaaacccttcattctctttcatcaaaggaacctagcggtttctgcatttttaaacaacaagaaagtaaatcatgaacttttacttggctacatagatcaaagattctcttgaaggtccaagtgatctcaaattatttttaattatttatatttccagatctgaataaaagactgcaaaacacaccccaaaagttttctgtttactttatcaaccctcagcaccaaggcagccatgaagtgctttttgttcttttctcccttcatggccataccaccaggaaggtggtcttaacatgccatcgatcatatctgagtggcaaatgtagcgctggcccggccagcccagcacatatcgctgtgagccgcagtgacacacattcatttccgctggaggcagccctagggagtccggcggccctgcagctgtatttcatctctttgaactgtatggcctcccctataattcaggaaatgagtttactctatctgtgacaagcatcatgttcacacagttttgggagcggccagcgtggtgcagggctgtatgggaatggaggtggcaggcgtttgccaaccctggggagtacaccgacggtacttcctctcccactgccgagtgctccacttgaccgtgactttcggcacacctgttgcctgagaaagtgtgctttatccccgtgtgctgggaatctctggctgtaatctaacctgagatgagtaagtcagtttcttagacagggcgcttcttaaaacagcaaggcctctcagttgatcaccactcagctcccctgaagctgtagaactggtgcctgtcttttgtccatgcttattttttttcgctggtaaactttggcccctcttttggttgttattaaactagtatttgtttggtgcacataatctctgctggaccaggttaaaacaagtgcagattgttaagggaagagggctctggtcagcgcggagtgtgcatacactcggatcaaggaaaggaatgccagagccagcccagcatcaaaatacactgcaagttggtggtgagcttttgttattttgcgtatggttaaccatctcggaggtcataaagcgaggcctctgtcctccggtgcagcagctgggtttatacagtatttccagattgtttattctggcccagagccagggctacatcgtttttccattatgcatgtttgacagatgaagagaggtgggaagtgggactcccaggaacaggtctgtgatttcctttctatttacattaaagggacttttaggagtactgaagattatgaaccagttcaaacatatgtcaatgcagcagaggtagagaagctgctatgtttgcaaaaaatgttcagatcttgggcagtaaaacaaaatcaaagcaaaatcttgggcagtgagcacatcgtgcttgtcactgcccagtcttgcatgcagacaggttactggcgagtgatatttatcattcacatccagaagttaagctagtgtttgtttggcagggcattgggaggagcccctgagttggcaaaccagaatctgtgtgcaatccactgacatatgcatttcatgcagatgggtgtgcctggtgccgggcagagatgtgtttccaaggtcccagtagaactttttccctgcagccttttccctgagccaccagctttctgtggatactcccaaaagcccgggctaagttcttccaccaggaagtgttcaagactgaccaaagagccacagttcacattgtatccacagcaaagtccttggcacataggtcaaatggatgtgattgaatgactgttttccttctaaataaaacactttcattttgctaatggagaaacatcactaaaaagtaccaaaagtgatggcaaattaagtaactgaccagcattcatacagcaaagtcaggtcacacaaataaatgtctttttacccaacagtgtttgaatcttcagttaatggctggggtaaatatcacacccagcacaaattcattagctgcaagacggtggcttctacatagctatttgtgtttgtggtgaaccttccttatcatggcatgtcttaagcttggctaagtatttgcaagcgttctgtcaccataacataatgttcttcaacagagtggctaagaaaagcaaataccactacctctccagaacaacctgtgatccaaaccttctctgtcagcctactatccagaaattcaatttccagaaatggaaagtttgctcaggaaggaccctcaactaaggaaggaatttagctaaaaagtgaagtatgcatagtcaacactgaaagttgccctttgggttaatccagtcttgcagatggatttaaaatacaggtttcaaatcaacaaacatttatggagggtggttaggtgccaggcatggagctggacactggggaactaaaaatgaaaaagacacagtccctttcagtgtgaaaacatttttgctggcttgcaagtttttcaccagatcctcccagacttaccaaagcattcccctcatcttagaacactcaagcccttcttttcaatggattccctgaatgccagaatacacacagggcaaggagaagtgggtggttatagatttccactcaatttggaaattaacagcctgtggtgtagcaaaaaggtgcaaggctgagaatcagaaagcccactttccagtgcttggactgaaatgtcctggctgtacagccttgagctggtcttgtgacctctggggcccttggtatctgtaagtaaaatgggtactgggaagattgagcaaggtagtgaggggcgatgtgaaagcgcattaatccacagagccctatgaaaatgagagggatgtgcttctctgcaggacttgtatgagaagttgcactgttcgggctactatttgtaaagttttaataatacagaaagcagccccctcctggcctcatgccaggttttattctctaccaacattgggtggccaactacagatttttatgtcactgggggccagctgttagaagaatctccactcaggaccgtaactactctgtagtgtccctgccactccctccccagggacagcgcagagcctggaagtctatccccctgtggccctgactctatggctgattggacatgtctataaagaaaaaacaatctctattgtgttctttaaatagaaagctcaaagtttgtttttttactttgttttccctcttctgaacacttcatagctcaaaaccagtgcctattttgaggaaattttcaatagttatcataaaattaactaagggaattatttgaccaatccctaaaggtaataagaaaaaactttttaaaaaaatatcaaaaacatcctgaagccacagcttctttttgccaaaaagtattgatgaattaaagtagagaggcagaaaaatgtgccttgccagcactattggtcccaaaaggcaaccaaaccacaaagttaaacactgaaatgtacagaccccagccagatgggagggtagactgcttctcgctaaggacccagcatttgtgggtctcctaggaatttctgtgaaactccttcagatactgcctttgtgcccagctgtctgtctccatctcacagacacagccaagccttccttgaatctgacagcaccctcgtccttctgatggtttcttttgttccctcaagaagcctgtacagaggagaactgtgtttccccaggtgctgagctgtggaaatacaaagataaatggggtatcgcttttgtcctgatcactcagtataaaaagcctctttggaagaacagctaaatgaaacctggtggagatgttaagaataaaatctagagaaaattttttaggaggtggatagtgcctcagaggcctcctaaaagttttccatctcttgattgaaacacacacagaatctatactctcagacgtgcacacacagcacatacggcaaatcttcatgatcttgtagtaagtatgaaagacccaactccatgcagagtatttaagataagcccaataagcctggtctccctggtgaggatttctgaccaaacagaagaaatgttgactccagcaaatgaatcagagtgagatgccctctctgcccccatggtgacaagccttgtgagcaggcatctcccttagactgtgagctccatccactcgtcagcaatgtggagagttaagaacctgggctcattagtcagacttccccacacccaacttcgggcttcaccacttaccagctgtgtgagcctgcacaaacttctaaattccaatgccacagctttaaatggtgataataagagacctctacagcactgggagctttataaggattaaatgtgtgtttagatatcttacaattcttggcacagagaaagctctcaaagtgccaactgatgatgatgatgatggtgatgatgatgatgccccattcactgcaacaattcctgtgcgtggtgcagaatagctattcaacaaatctttgcagaaagagggaaggaagatgatattgggcacaccagtgaggcctaattgaagccttgattttgacgagaagcacttactctctaggtttatgaaagcctgaattttagaatctttaaagcagaagcataaaactcgactttctataacagccagtcaggtaacataaaagaatgaaccggcatttagagtctgaggcaaactggaaagccctggcctctttcacgggggcagtcacacttggctccagaagaatgtagccgccctttgagaaaagccagaaatccagctttccatgtgaaatagaccaagccttacaacaactgaatccatttctaaaaaaaaaaaaataccccacgggccaaacaacacattgcctgccagtccgatcttgggctgcctttttgccaccctgtcttaaagggaggagctctgtattcgtctctttcttttaaaatgtttatcagtgggcacaagagacatgagccccttgaagttactctcagttcctgctaggatcagagaacgctcatggagtgaggtcttcacttcttcatggttaatccgacagtatgtgctcacctaacgagggcttcttcccttcccaaggaatgctactaataagtatagatttttaaagcataattgttttgtggctgaaataacaacaattatttgaaaaaaaatcctaacaacttcctctagagctgctattatggcagtctggagagaggctgattccatagtccatgtagctttgttttgtttggatggaaagtctggcattttacaaaaatgtggaaaacttagcaatggaatgacttttccatagcaccgattatcgtacagcaagacacacatccatatgtctttgaaatgagatttttaagaattctctgcttattatacaagacaaaccacctctggtctttccatatgaaggtgatagttttctacaggctcatgaaagctgccctggttatggtgcagtacttaaagttagggaaaaatctcaacatagatggggacccagattcaaattcgttttttcacttaccagccagctatgtgaccttgggtaagtttctatttctccatctgcaaaagaggggtcatgatattcacctcacagggttattgagaatatcaaataaaataatgtatatgatgatccaaactcataatgggtgttccccatcaatattggttgaatctgagtctctgtttctcctggcacaaaatagcactcctgtttctgaccgcgacataaccctctggcaatgtcattaaccttattaaatttggcagctctgtggaaaacgaaggtcaaaaaagctgtcattgtttatataaactgttcattttgttgttcacagtgctatgaggactaaaggatagagggttggatgctgccacccagggagtaaccagggagaagggaagaggctggaacagagcctgaggaggactggtctttataagacaggctgggaaagaggagggcgtagagaagatggaaagggagtgatcagagagaggtgagggtgccaggaaaacactgttgcagatgcaggggtttcaaaatggagtgtgtggcccacagtgtgatggggtcatgctgtgaggcgccctctgagctaccaacaaggaagcgagagtaactgaatggagtacagaaggaacagaaagcaggttttggtgagttcagtcacgtacgtaagctgaaaatgttacaacaaatgtagacagctcttcaggaagttgggctgtgatggggaggagagagaaaagatgaaagagggagggtgcatgagacaagggttttttcaagaagggaagtgagttttgatggcaaggagccagttgagagggagaggttgacaatgaagaagagggggtggatgagggagagaaggaaactccaaggaggcagggtgggtagacaaatgaagcaagaattggatattaatgcaaaactagagcttggggaaacattagatcccataagaatctgccaaaccagctgatactgaccctcatgtttagacgggggatttagggagggattaagaagagtaaggaagactgaagtaactgaaatacacgagacaatctgttgttattggaggggtaacaggaaaagcttctcctccaccctctgaagcttacttgaaaatgaacttacaataggcagattaacaggaaaaaaaggaataaaatttattaatatgcatgaaactgagcatggtagctcactcctgtagtcccaaatactcaggaggttgaggggaggatcgcttgagcccaggagtttgaggctgcagtgagccaccactgcactctagcctgggcaacagagcaagaccctacctcttaaaaataaaatgctacacaggagaaaatcacaggagagtggttacctcataacccagggaggtccagcttttttctatacctttcttcatagggaaaggggaaatggaggttaaatgtggcaattttgaagagtagtaaatgatatttaaggggaatgaatgggcccaatgctcagacaatggaaggtaaataattctctttgggaactgaatgggacccaagaacaggcaatagtttgggacaacgttcatctgagctctgagtgtggtgtttaatcttcagtcccttcctctgtgacatgagttttgatcttctctgattaatgaaattttaggggaggtgactgaaggcaattttgttcctctttggcaggtccaatttctaggtagataagggaacttcagagaacagcttcatccaggatgtactggtctccaatggccttcaatttgaaatatcgccataccaagttgccatatttggcggtcaccctccctggatccttaactattcaagaaaggatcttttaaagctcttgccttgtagccaaacatgaaaaagtcccccttccctcttgtcttaaaagtctgtcctctctgtggagtgttctagcaaacatagggctgggcctcctcatgttctgactagcactatcaaatagccaaagcacttttgtcaggctggtaaggtgacatgcaattaaaatttggttggaaaggctacctgggatcttatcaaatatcaatcttattaaagacctctcattactgtataaaagttggataagatatgtcaatgtagggggctctgagtgaaatcataagagccagtactttccagtcatagagtcgatggagtgcactgggattttagatgctggttatcaccagaagtctgtcgttttccgaacatggtaaatactaggtcaatttctgcctgggatagaatgtttcctactggaaacacaaaattacaagtttaatctaaataaaccaccaggacgcagttttacctctcaggtggaactctgcaaatagtggttgttggggtggttttcatcactgactctgagtattggacccagagatgatcgtgcccaatttttttttaatcggcccttttctcctcccaaactataaagccattagccattccctccaaaacacctgccagtttcctgtgagatcggttgttaagtttgggtgcctcagtcagcaggaggagtagtaggctctaggcctggacattgaccattatgctctaccacactgtgaagaaaggtgtgagaagcagtaatagccctctcacctgtccacaccaagaaacaacacagcaaaagcacagcagctgattgtcatgaggagcctcctacctctgccactttctggctgcatgaccttgaatgagttatagccttggcctcagtttcctcatgtataaaatggctcttccatcaaggggttattgtgaggattaagtatgattgtgtgtacaagtgcttagctcagtgcttgctacacattagttcccattaactgtagctgttactataaaaatataccacaaagcattaggctcagccaggactgtcaccatctcgcaccatatcagttaactaatcgtgcaaatatgtcctggttcttttcacttgtacttgaaggacacaatatcacattttattgatgtataatattttacatatttatgggatatgtatgatatttttttccatgcatagaatgtgcaatgatcaaatcagggtgtttagggtatccatcaccttgagtatttatcatttctatgtgttaggaacatttgaatttttttttctagctactttgaaacatacaatacattgttgctaactatagtcaccctactctgctatggagcatgagaacttacatcttctatataactgtacatttgtacccattaaccaacctctcttcagcccgctctccaacccagacatccttcccagcctctggtatgtatcatcctactccctccttgtggtcaacttctttagctcccatatatgagtgaaaatacacgatctttgtctttctgtgcctagattatttcatttaacatgatgacctccagttccatccatgttgatgcaaatgacatgatttctttcttttttatggccaaatagtattccattgtgtataataccacattttcttcattcattcattgatggacacaggttgattccatatctttaccactgcgaatattactacagtaaacacgtgagcatgcaagtgcaggtatccctttgatatgttgatttcatttcctttggatagatacatagtagaagggttgctggatcatggtagttctatttttagttttttgagaactctccatactgtttaccatagtggctgttctaattggcattcccaccaacagtgtataagagttcccttttctccacatcctcaccagcatctgttatttattggcttttaataatagctattctaactggagtaagatgatagctcattgtggttttgatttgcatttccttgatgattagcatgttgagttttttcatatacctcttggccatttgtatgtcttattttgagaaatgtctattcggaaggatataatgtcacttttgacagagttatttacctgctctgcccatccaccaactcccccatcctaaccatagaggaaggcattcagggaagagagttttattgtcatgaactaggagtaaccttatggcagttgacccagtcacctaatcgtaatcaaagaaagaaatgtataaacccattatgctgtaactttaaagaatattcccaaagtttttctggcctgaaattaataaccatttatatagcaaatcaactcaatccattatatagaccaacattttgcaagtgattgaagactagtaaaatgtgattggtatttctcagatagttttgtagtcaaggtatttatatgattacacttgctgtccattgtttttaggaaattactgtttcaaccttacgacaaagagctttgaggctgtgaaatagaacagatttccaaattacttctttacaaggatctaggctcccttttgcttatccccttggatcctttgccaggttgggccaaataatttaagtaatgaatttattttaaatcacaggagtcttacttttttgtgtatcagataacaaaaccctacacaatgtatagtgctctaagaggaagggattgaaggaggctttcaatgagagaattatttttcctctgcctctcaatgtttgacttaaaactctttatttcttgtctgtctttcataagattttttagctctgttttaaaaaacaaaaaggaacacctaagacctgtgaacaatgacccgccccagattagctagagttcatatcttcagagaagacagatattataaaatgttctgttaggaacccatttcagaagagtctatgccaagttatttaacagaaattctagagtgttcaatgtgtgttatgtttttaatttcaatgaagaccatgttatctatttacaaggatctaggctcccctgtgcaaaggacccaacctggcaaaggactttcaaaagagtcagtttgaaaagtaatacccttattcaatgaggctgttggccacatagagaatttatttattttttattttaattaatacctaatggggtacatgagatgttttgatacaggcatgcaatgcataataatctcatcatggagaatggggtatccatcccctcaagcatttatcctttgcattacaaacaatccagttatgctcttttagttattttattattattattattaattttagacagagtctcgctctgtcgccaggctggagtgcagtggcgcaatctcagctcactgcaacctctgcctcccgggttcaagcaattctcctgcctcaggctcccgagtagctgggactacaggtgcatgccaccacgcccagctaatttgtgtatttttagtagagacagggtttcaccatgttggcctggatggtctcgatctcttggcctcgtgatccacctgcctcgtcctcccaaagtgctgggattacaggcatgagccaccatacccggctcttttagttatttttaaatgtacaattaaattattattggctatagtcaccctgttgtgctatcaaataataggtcttattcatttttcaattttttttgtacctatgaaccatccccacctgtccccaatcccccactacccttcttagcctctacatagagaatttttcaaattccttctttagaattgctactgaaggcttcagaaggtacctcaaatatcctaaaaattgggaagtctatgtcctttcagatgagtctgattttggaaatagccatttggaactgtatttagtaaattatatacctattcaaatttgttgacaaaaattttagtcaaaagcaagattataaaagaaaatgtgagggcaaatcttcatgaccttggatttggcaatggcttctttaatatgacaccaaaagacaggcaataagaagaaaacagataaaatggtctccattacaattaaaaacttctatatgtcaaccttggatttggcaattttttttaatgtgacaccaaaagtcaggcaatatgagaaaaatggataaaatagtcttcattaaaattaaaaacttttatgcatcaaagaacactatcaacagagtgaaaagacagcctgtggaatggaagaaaatatttgtaaattatatacctgatatatgtgcagattatctaaaatatgtaaataactccttcaactcaacaataaaaacaaacaaaagcaaacaaaaaaaaaccccacttcaaaaatgggcaaaggacttgaatagacatttctctaaagaagatatacaaacaaacagcatttgttggacacatgcttgtcaaaaagcacatgaaaaggtcattagaaattagggaaaccattagcatcagcatcactacaggagtcattagggaaatgcaaatcaaaaccacagtgagataccactccacacttactgggatggctacaattttaaaaagggaggaaaataacaatcgtaggagagaattcgaagaaattggaaccttcacacattgctggtaggaatgtaaaatggtgcaaacactgtggaaaataatttggcagttcttcaaaacattaaacttagaattaccgcatgacccagcaattctgctcctaggcatatacccaaaataagtggaaacagggactcagatactagaatgcaaatgttcattataataagcaaaagatggaaacaacccaagtgtctctccaaggatgaaaggataaacaaattgcgttctatctatacaatggaatgttattcaaccttaaaaggaatgaagttctgggccaggcatggtggctcacacctgtaataccagcactttgggaggccgaggcaggtggatcacctgaggtcgggaattcgagaccagcctgaccaacatggagaaaccccatctctactaaaaatacaaaattagccaggcatggtggtgcatgcctgtaatctcagctactcaggaggctgaggcaggagaatcacttgaacccgggaggtagaggttgtagtgagccaagattgcgccattgcactccagcctggacaacaagagcaaaactccatctcaaaaaaaaaaaaaaaggaatgaagctctgatacacactacaacatggaagaaccttgaaaacatgcttagtgaaataagctagacaaaaaaaggacaaatattgtatgattccacctacatgaagtactgagaataggcaaattcataaagatagaacatggattagaggttctatctaatcgatggggtaagtagggtggggtaaggaaaggaaaggaattgggagttattgtttaatggatatcaagtttttgtatagactcatgaaaggatttttaaaacagtggtgatggttgcacaacactgtaaatataattaatgccactgaagtgtacacttaaaaatagttaaaattgtacactctatatataacattttcatgctattcagcaatgaatataaaatatattttgttattaagcattagtataaaattaagcatattttagttgtatatattttaccacaataaaaaatttaaaatttacaagggttaaaattatatttagactgggtgcagtggctcgtgccataatcccagcactttgggatgccaaggcagaaggatctcttgatgccgagaccagtctgggtacatggtgagaacctgtctctacaaaaaataaaaataaattttaaaaatttgtaaattatacttaagaaatctggcagcccttcctttccttttctggacaaatgcattgttgaaatagtaaaatggaaatggattttgtatcaaattaaactttatgtcaatattttaaaacttacaaaacaagattattagaaagtggttagacagctcttccatgcctccttctgagggtaaagcccttttctggtgtatcaagaaataaaagagggaaaatggatagattctgctgttcaaaagaatgtagaactcagagttaacaattgaatttggtccaatcgcatggttcacatctgatgaaaggaaatttgatagcttgtgcttcgtcaactcatgttgacattaacacctagagttggtaagtgtttccaaatattgtcaggaacccttcttctcttctaatacttggatatgcagttgcttccttaggtgctaccagagttgtacaggtaatgtgggtcctcgccgggatcccttctaagctactgcaaatgatggctcatgtgcgaccccggttctcttccagagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatatcatgggaaaagggggagaaatatagcccctagcctaataacttatcatttgtaaaatgacttataaaaatattacctcaatggtaggagacatccagacttgtatatttcagtggaaatacaaaaccacttcagagaccagggtatctcctctggaaggatctaagagaaggtaagacagattaggacatcgaaaaggaggatggagccaggtgccatggcttgagcctataatccgaggctgaggtgggaggatcacttgagcccaggagtttgaggttgcagtgagctgtgatcacaccactgcactccagcctgggtgacagagtgagactctgtctcaattaattttttttttttaaaggaggaggatctccatgggtaagtggtttctacccgcatgggtagagttctgcctctggtccttctcagggggcactttcaccaagagcagtgtaattatctctgaaagagcaagtcagcttgtgccgcatccccaaccaatccacagcctggagtacctttcaaggtcaaagtgcatggccagctccattgagacattccatttcaaagcaccgtgctgacagatatcaaagtactctagcagggaaaataatttgtttgctgtgtaaggaagaatgtagacaagacagataaatctgaaggtcatgtggcatcagggaaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaagggaaatgttcttagaggaggaaatatcctttgtcctgttcagagagaccagggccctaccattaggcatactttcagaagcaacctggagaacagctatcaatcatattcaaaaccagtacaagaactgctgcctggtaccctgtgagtcatttctatgaaattccatataaagaatgatgataagtttacacactgtgcaatctcacaatctgaaaataaagttgagttggctgtgttttctctgctcttgtcagaacattgggacaattggtcgttcaaaaacattcatcctcttactgcaagtttatctgggtacttttacctgtgtgttcaaaggcatttcttttcagcagtgatcattataacttcacaaaaaaagatgctgacggatttacttacagggccttaatgttattttgtcccagccaacaccctctaggtcctaaaagtcaaggtacttcagtttatttggcaaacatgacaacattttttttggccctgggcccaacagtttgtacttcatgaaacatattgtacattttacatagtttaatttaaaaaataccttttaagctagttgatctttgactgtcttatttattataacctttcagcacattccaaggttttagttactcaggaaggagttaattaaaatgattttattttggtctgatggatgttttttaaaaggaaaattattattatgaaccttcagcctactttcttgagtgccgtaaaagtgcttgtaaatctttttttttttttaagaagaaagaaaaaaatggtgtttgacgttgatggaaattcaaaaatatatatggaactgaaacattaacttagctaaaataaaagcaatctgtgtttga

SEQ ID NO: 1425 - DNA, 244043 bp, Homo sapiens
attagaccattaccattttatttgtattaagaattatttaaaataagtataatatatatatttcactgagcctaagttgagcaggctaaaagttgatacattgagtatgtagctacaactgtaacaaaactgacatatgttcttgaactttcatacaatcgtgaccacaattcagttgctggatttcacactctccttaggtttatacaaactgaaggacaggagatgaatagtatagaaattgctacaactttttgaatttcaactatgtttacacacagaaaagatacaaaaatacatgtataaaattgcaggtagtatctatttggaatgctgaggcagtccaggttgctggtggaggttagtagggaatcctagttgtttaaaaggcaaaatggatgcctgactaattaaattaagtatatatgaagatttgtgttttaaagttttttagtggggaaaaatactttttaccactaattgcttcagaaattgagttgcgtaaagtggcctagagctaaaaatcatttctaaaattttaattaccaatgagaagaaaccagatattaaacatcttttgaggaaaattacaaaatgttttactccatgcaaagtcttactgtgctctaaaatatgctctttatgactttgttggtatggatgaacgcaagaaaactgaaaaataaatttaattaaacgagggatgcaaattaattttctttttaaaaaattgcatctctcatctaaattctcttttgcaaagtttaatatccagttctttgccacataagtaaaacaaaatattgcccataaatatagatgtagttgttgcagtctcaatcagccaactcatatatcctgaacaaacccagctatgaggacagttctatagagactcttctataaaattatgatcttgatatacatccagaatggggggtccaataatgtcaagtgttaatattgatatctaaagaactttgcattcaatatgtcttgctacctaaatggatgacactggtcttttattgctgtcttttatcagttctcagaattatgcaaacattagaagggggtaatagtaaatactttaaacatgtaaattatcttggcttttaataaatcaaatgacgagttactgggttcagcacaccaacatggcacatgtatacatatgtaactaacctgcacgttgtgctcgtgtaccctaaaattcgaagtgtaataaaaaagaattgtggggtataaaaaaagaaaaagaaaagcaagtctccaatgttaacactgaaatttaccactatgcactgagcttgagaaacaaaaactggtagagataattaatcagcctaaatatctatgtctttttttgtgataggataaaagagaccattccataacctgttactgtagcacctgattttaaatctcgccagagtcgataattttgtgctgcagtcatggttaggcctggcaaaaggacaaagtctgctttgtttgcttttgtaaagtctttcattgaacttgaaataagagaaaaatgaaggtgaaaaaataaattgaaaaaaattagtccaaaacaaacatgcaaatttgcagtgcacgattgagcatttctgtccatgaaaagtgcttctgtacagctctctgcaggcagctcttcacagtcaagaaggccattttcttttagtgtagctggcaaaagtctctgatcatccttataattagtttaggagaaaggtctggatgtaaatctgtcttttaatccattcgacgaaatatgacacattactataaacgccaggccccaggactttggaaaagcagacggagccccatgaagttaatccaaataatgtccaccgtcctccaggcttctcacaaacaagaggcccaccgctgtcaccctgcaataagtaacgatgggagttaggaactggcatttcagggcagtaatgtgtgtccatgctatcctgaggatactataaagctaaacccagattaaccaacttggaaagtttcaacaaagctttccttgtcagcctgtggaggagttgtgctttccactgtaaaaacagaactttcaaataaacatcttaaactctgatcattaaaagggtggagtggcttgggaagaaattatatttttcccccaggaaattacctttttcaggcattttctgcacttataaaaatatgtcataaagtttttaaaaagtatcagaactaattacctcaaaattgacctcattctaatttaagcttgacttatgactgtggaaagtacccaaaatggaataaagatcccccccacacacagtactgcaaacatattctaaaatatctattttcaagattcttgctttgtgaatgaatacattaagcataacacaatttggggtcccttactacacttcttaatagttcttaggactttttaatttggcatagttgaatacaaaataagaccacttaaaattataatgaatcattaatagcctgtattttatttcatatatatagggattttcattcatgatatttaaggattccagttgaactatattcagtttttcccccaaatatagttaatgataaaatgctatggcattagagatagcaatacttgctacatctgaaaacaaaggtgtattctgcactgcctcaaaaaagaagagctgatatcatggaaaataaaagagtaaatacgtgaattcattgtggaaggttacaaatactccttgacctacaagactttcaaaattagaagcatatctatggtcttcctacttggtattgttgaagaacataggactaatgtttcctgatcctcttctaaacattttccacatattagctcatttaatctttacaaaatacctaagagtttatattatttattatatctgttttggagatgatgaaacagaagcacaggttaaataacttattcattggcagaggctagatttgaatccaggcagtctggtaacaggattccaactctataactactaggctaccctgcttcttaggaatattagggaatattattgctatgaaagagaaattaggcccggcgtgctagctcacacctgtaatcccagcactttgggaggccgaggcaggcagatgacttgaggtcaggagttccagaccaacttgatcaacatggtgaaaccctgtctctactcaaaatacaaaaattagccaggtgtggttgtggaaacctgtaatcccagctacgctggaggctgaggcaggagaatcccttgaacccaggagttggaggttgcagtgagctgagatcacaccactgcactccagcctgggagacagagtgaaactccatctcaaaaaaaaaaaaaaaagaagaagaaagagattaaaattttgattgtgctgtatgcttttgtgtaagtgatgatctttaaatttgtaactttccaataccctaagccaaaatcataagcatagaacttgcaaggagctgaatttttctgcctaagagcctaattgaatttttttaaagcaaaatttctttgttacatgtatataatgcttagacgaaaaagaaaaatttcctggaaacatttcacaaattattttcacaaatttgttttcacacatttcatatgcatagggtatttcattcttgatctctccttatataaaataaataagatgctcagctattgaagtggaactattatgtcagagggtgattaaaatggaatgtgtttagaatgtcagcacattttcacttccagatcagacatttagtaaaataattatttagcatctactctttgcaaagttctgtgctagtgtataaacaaacgaataaggcactgtttttgtcccagaacagccaaaagtcagcttgggtaacaaggataaccacatgaaagcaaaatctaatggctagaaagaggaggtcaaaggaatgagtgatgacttccaggtggagaggaataaaaaatgccttcctgagatgtgggttttgagttaggcttagtgagtcaggtaggcaccccattaagtgcaaaatgaaaggtgaaaagcaagcaattaaaaatgaaagggagactacagctaaaggcacaactgatctggtctgttcttttggtcctctttgtaatattgggcttgaaaccaacatttatatttggcttcagtattcagtattcaggtttatagattgtcacggagtaactcacgcttcattatgtcctgttgatacaattaaggaaaataatatctgtcatataatagaggtctaagtagaaaaatttgctcctgatatagtaaaaagtaggttttgtttggttttctacctgaagttgtgttagagaatatctggtatgcatttagtatacccagtactaaatgaacttccactgaactcagtatacaccactgaactcccactactaaagaagtcggcaagacctggttcctattaggcatcatgataagaacatgcccatgcctgtgtctgtgggccttcagctctctgtcaaggaatcatctcccttcccctcctttagcaactgccaagagatgatcttgaacatgtgccaagaggtgctagtttttggtaaacctccaaatgacattggagagaggaagaaatgtagttatattaatcattgctgccagactgactggtttcatgtcctcagtctaccaccttcatgctggctgatttggggcaaattacttaacctcctgtattcttgatctgtttagggaaaataaagacactgccatatgggttgattgtgataattaaatgagttattagaaagcgttttgcagagagcccgaaacataataagcactaaattgatagctgttaatattggtgtaattactattcattgaatgtctaagtatgtgccagatatcatatacagatatgtgaaagatatgggcttccaaatacattcacttagttaatcctcatggacagaattagtcccattttactcatgagaaagctatctagagaggttagataacttccccgggttatactggtctcactggcagagatgaattccaacccagatatttcaggcttcaaatcctgtgccccacacccacatcatgctgcctcctacaacactttattttgggcctgggaaatcaaacccagtcctcctgtagagaagggagggattcctttaccaccatccacgtcagcaggatgacttgtggccatgaagcagaaaggagggtggtctcagcgaaatgccaagggagctgtctgcctccctctttcccatgacaactatctaaggaatcaccacagggccattttcaataccctgatttttccattctaaaatggatcatcaaaaatatagtttatttaaattgagttagtacttaagagcactgttgtatcttttcttcattactaaactgtagggagcaatttactcccaattaaaggtgcttcacagcagcatagtataataactgtcttccccagtttttgttacaagcttatttgagcacttgcacttttccctcctttcctgggagccagtccagtataatgttcgatgtgtgtctattaagtaaaaataaaaaggcacctctacactattatgttaatatgttctgcaaactctcatggccatgaatcctgagtatctaaaggttgagttcagtgacatttgaggacatgctggcaatcaagtgagggcccagacaacaccagtgtgatgacccctgagacagaggtagtcctgtctcacaccctggaagttggggtgttgatgtgtggcttcctgccatcaccctaatggctgacaatgtcctttcatgccttccctgcttccccagggcagccaggtggaagccatggttactactagctcctcttagaacctcatttatcctagccactaaaatggttgaatgagatgaacaggaaaaattgtttttctcctgttgctgaacaagggtgatgttccccatatagtagatgagacagtagaaggcaccctgaataaagaggatgggtgtaattgtggggattgcttgtgtaccagctgcaggaaaatgtgctgttaataattaaacatttggcaacaaatgattttcaaaaaatgtttccaaagggccatacgtaataatgagtttataggaatccactgaagttattgttgaactgaatctccttggtaaccagaaagcaacttaccatgcatgaatcaactgtgccagactcatagccagcacatatcatccgagtggtgatggtcttcatgtcaaagtaggactgacaatgttccagagaaataatgcggacctctccctcttgcagcttaaatggcactgaatttttaaaaaataagaatatatatatgatgataaaatgactcaaaagtgaggctagtgaggctagccaaatatgaaatgcaaatataatataaatatttttataccaagagaggcatattctttacttgaaatgccattttaaagacatggctggtttggaatcagaattttctagttagaagcattcatagcaattatccggtgaaactcctttattttattaatgggtaaaccaaggcctagactggttaagtaagttggttcatccttaccatatgctacaaccaaaacaatagctactacaaagaaaagaaaaaaatcaagccagagctctgctggctgccagataggaggctgccagctcggcgtcaactcagcatgatagtcctgctctgctaaagtagagaaaacctgtttaatctaacagggaagggttgtcctattcttgatgaaaagaatatgcctcaatatgtgccccagcagccattacttgatgtaagaacctctaatcctagaggatatgacagagagatatcgaaaagcacaaagccatcccttggtattgacagagagaatatgtgaattccatcttgcttaaaagttcttgaagaatgacaatggatttcttgaagcaagacagcatgaatctttcactgtttagccattctgcaaaattatacacactgttcttcttttaaacagtgatggtgaagcactactgggtaccttattggaagaaagagccatttttaggaaaatcaatgtgatgcagacagtggatgtttcacaggttgtcaaaagaataagaacaatagctaacatttattgggcactagtgggtctcattgcctttaatctttacaatactcctgtgagttaggtagttgctatttttttccattttatagtaagcttgaaagttatacagtcagatcagtcaggtctttctgactgaattcagcagatcttttttttttttttgagacagggtctcattctgtcacccaggcagtggtcacttgcttactgcagcctccaccttggctcaagaaatccttggctcactgcagcctccaccttcaaggctcaagaaatcctcccacctcagcctcccaagtagctgggactacaggcacacacccccatgccaagctaattttttttttgtagagacagagttccaccatgttgcccaggctggtcttgaactcctgggctcaattcatgctatactacatgtgtggagtgtgcgttatgttgcactattgctctgagttcaatatggatattgtaggaggaatataagcagaaacaatatcaagcatagtctgctcttaaattacagaattaatcatagctttgaaaaaaaacagatgcataggagtggtgacagcatgtctaacattgccttcaaaattgttacatgtgagtttttttgaaaaagtcattgacttctgcctattgaatttcctttctgttctgtaattgatgaaatagaaaagaaactcaatgtaagtcaaaccttatctgactaaattttaagaaaaaattccttcaaatatacaatttctaaggccaataacagaatgccaatatacattattattcttgaaagccatggcattatacttgatatggacagagtaggcagcacttacagttttttttttttaagtttcaggtgggtggatcacctgaggtcaggagtttgaaactagcttggccaacatggtgaaaccccgtctcactaaaaatacaaaaaacaaaattagccaggcgtcatggcacatgtctgtaatcccagctactcgggaggctgaggcaggagaatcacttgaacctgggaggtggaggttgcagtgagccgagattgtgccactgcattccagcctgggtgacagagtgagactccgtctcaaaaacaaacaaataaacaaacaaacaattattatttctaaagtaggtcaaactgaatgagagagtccattataggggtttagagtaaatacagagtacacattttaaatttctatgtgttttatatgttaagtcatctacagagccaaactattttaatcaatttaaatagtcaaatagcaaatcaatatactttcttgaaggatttatagtttgtactacagatgttgataagaccaaatcacaacatagaattggaaatatgaccatgcagcttgactgcagagattcccagtgactgtctctatcattgggctatctgcaggcagatagagagagtccaaagcacagttcagtgacaggtctcctcctgccacaaggaagctccaaaacattaatagtaagctcccagagagagattctgaagtgtggagagggatttttgagattgcatctgagcttggccattttaaatgccatggttcattattaatgtctatgatttgcacagcagatgaagtgtgacacatcgctaagtatttaccatttgtggctatatttttgtaagagaaaatgggaaattacggccaaaagctacctagcttttgggtctgggtactgggtctcattctgttacccaggcagtggtgagatcttggctcactgcagcctccaccttccaggctcaagaaatcctcccacctcagcctcccaactgaggaacacaatgtttctcaggctcctgaagatcctggctgatatggtttggctgtgttcccacccaaatctcatcttgaattgtagttcccataatctccacgtgtaatgggagggatctggtgggaggtaattgaaacatggggggcagttaccctcttgatagtgagttctcacgaggtctgatggttttataaggggcttttcccccttttgctcagtacttctccttgctgctgccatgtgaagaaggacatgtttgcttccccttccgccatgattgtaggtttcctgaggcctccccatccctgcagaactgtgaatcaattaaacttctttcctttataaattacccactctcaggtatgtgcttatagcagcatgagaatggactaatacactggcttacttttattgcccatgtggccccagcctgtgatatagcagtacgtgtcaggctctagccactgctccgggttgggcaagcagacaggccggacgtagccagtctcactgatgtcttcactcagctcaacgatgctgatgtcatagtccaccactgctcgactgtagcggggatgcaggatgatggtcttcacaaagcgtgtctgcatgaacactgatggatggtctagattgttgatgccaagcaccactttccaaactgcagcattctctctcctaaaattataattcaagagctattggcatcttaaactctagtttatcatgtgaaattcacatgtaattttaaaacattttatttatgtaaataatggccattttcatgcccacctctcaatgtattcatataagtggcatttatataatagcctgagtgattagcaagtaagtattattgttgcagaaagcatagctcatgattcctgaatggggctagtctttaacataaaacttcttcagttttaaaggcaggcagagttagttacttgcttcacagaatgagcaagataatgaaaagctatgaagaagagagaggagcaagaggaaaagtgaaaaagaagaggaagccaagactaagagattcctccaagaaagagcaagtgacttgaagaaatgccaggggaacctcctacagatttccagctcagggcttaaaaaggtcacccacgacctccaatggtcattcccatactccactgtttttgaatacttgtcaacaatattttagtcgattcccaccttaaaacactttcttcacttggcttccaggtcttgccatgctccaaaatttcttccaatctcatggacctttccctctcagtcttttcttctgggttctcctctttggctctcagtctccatgttgaaatgctctggaatttcactctcagctgtctattctcactccatactcccttgatttcatctagtccaatggttttaaatcccaccatacgctggtgaccccaaatgtatatctccagctctgtcctttccctgagctgcagacttaatgttcaatggtctatttaacactctcagttggatgtttcagccaacatttattgagggcttaccatgtatgccacagtatttaatcattcaggattcagtttacaggaacttaatactataatcaacccaggtgaatcttctctttttcttacacccaacactgaatgcatcagcaagtctttgccaatcctgctttcaaatatatcccacatcttactgtttctccctcctccatggctataatcctaatctaagctactctcaactacatggaccatgcaatggcctcccaaatcatggtccttcttctaatcttagtccctgtagtccattttccttactatcaggatatatattgactatatcctctatattagtcagagcaatatttaaaaaaaattagatcaatccatcttctgctcactattctccaaaagctttgtatcacacttgagacaaatcctagactcccctggcctctgaggccctacaccatatgttcattctcaacccaaggactttcttgctaattttgaacatgccaagagcatcctcaactcaggagctatttcccctgatgttcccccagctctcacatgggtcctaccattactccttctcttcatccaggtctcaactcaagcatcatctgctcagagctgtttccccagccaacctgtctcacccttactctgcccccttcactctacttgacactgctttacttttcttctcatactatccattgatatcaatgacattgatataaccatttgtctattctctgtcttggcccctagaatatagttatcactgtgaaggcagggatttggctggtctttttcactgctttattcacagggcttggtacctggcctacagtaggtcctcaacaagtacctatttaatgatggctcaatgaatgtttttgactctaaccacaaagtcaaggtctgttcttcatcactccctccatcccttccttcactcccagtctctcctccaccagagtggtcaggataaaaaatgtggacatttattggaccacattgttggggcaagggtagagctttaattgtgggcatttccttatactctggtaatgtgagtcagccacactaccactgttcctgcttgggagcttgtgatcaaatcaactaaagtaggttgatttgaccagctagaccaattgtttttcaacccaggctgaacactgaatcctctgggagcctttaaaatagtgattctctgggcgtcacttctaaacagaagctcatggactggggcctgggagtctgtatttttaagagctctctagggaatcttaggcaaaaccccacccacaacccttcttttcttggcacgcctttctttaccatcagcatgccaaagattcgaaaggctgagatttcaagggagttaggaaggaggagccaaggtaggcactcacttggtttttagtattgttggatacttggggcagactctactaacagaccccctctatatagtcatgcatgttgtcctttttccattaaacaaatagtaatttcagggatatcagaggaacggacatcattcagtgaatagagagatagagatatatagcaattttctctatgccaagcattgtgttagggattacaagaataagcaagaaaagcatgattccctgcctatacaaacattgtaattgagtgaaggtagacaattaaataaacaattagattaaaatgcaggtagtactatcacatgaacattacaagataatgttacagaataatttctttttttttcttttcttgagtcagggtcttgctctgtcacccaggttggagtgcagtggcatgatgatagctcactgcagtctcaatctcccaggctcaagcgatccactggcctcagccccccaccaagtagctgagactacagacacacaccaccatatctgactaaatttttttggaattttagtagagataaggttttgctgtgttgcccaagctggtcttgaactcctgagctcaagcaatcctcccgccttgggcctcctaaagtgctaggactgcaggccaccaagcccagcccagaagaattatttttcattacataaagccgtcactagaagaacatgcttttcttatccttccttccttcctaccttctttccctccttcctttcttccctccttccttccttcctttctttttctttccttttttccttctttcttttacttctttcttcctttccttttttccttcttttccttatttcttccttctcttcctcccttctctcctttcttctttctctcgttccttcctttttcactaaacagtaataagtgcattaccatctgagaagttcaatatgtatttgtgattctattgtttcagacacctgaaatcaagcaataatttatttcaaatttctgactacttaatagcttcttgcccttgaatagcgttactaagttttggctgtgaaaaacattcatccacatgcttaaatcataagcagtattttgaataatcgaacattccaaattatttgtaacaaaattgaataacatcaaaattctggacttaattactgtattgagattaatgtaattctaattataaaaaattagtgtcaataaaactgctgaacattaatttgtacccagtagtctcttgttacataagctactggccttatggtatagacaggcagatcacgaggtcaggagaccgagaccatcctggctaacgcggtgaaaccccgtctctactaaaaatacaaaaaattagcccggcatggtggcgggtgcctgtagtcccagctatttgggaggctgaggcaggagaatggcgtgaacccgggaggcagaacttgcagtgagcccagatcgcgccactgcactccagcctgggcgacagagtgagactccatctcaaaaaaaaaaaattccaccaaaagaaaaaaaatgtacacaggaaattcacataattttttgtattcagtgatgacagtgttcttttcttctttttgttatgagtatattgtgaaaaataatgtctcttttgatgtcttccctcctgtcaacccgggtatggcagaaaccaaaaacagaacaagaaaaaacccaacctgttgtttgaaagagtctcctggggtgaaggacatgtacatacgtggtgattgttacatcaagcaagtgctaaaaagaaggagtcaggagtaatggcaaagacagccctgtgtctgggtagaagcaaaaagaaggaggacaatttcaggctacatgaatgccacatgagtttagtatcagttctaaagtacgaattaaccggatgtggtggcgtgcacctatagtcccagctactcaggaggctgaggcaggagaatcacttaaaccctagaggtggaggttgcagtgagccaagatcatgccactgcactccagcctgggctacagggctagactccatctcaaaaaaaagaaaaaaaaaaaaagtaccattggagaaacacatggaaacagactctgatcatatgactattttagtaaaaaccattaaattatggccaggtgcggtggttcacacctgtaataacagcactttgggaggctgaggcaggcgactcacctgaggtcaggagttcaaggccagcctggccagcatggcaaaaccccatttctacaaaaaatacaaaaattagctaggtgtgatggcaggcacctgtaaccccagctactcaggaggctgaggcataagaatcgcttgaacctgggagctggaggctgcagtgagctgagatcggccattgcactccagcctgggtgacaagagcaaaactccatcgccaaagaaaaaaaaagagctaaattaggctaccaagaaaagaaagccaagtatagcagctgaaaatcttcagtttaaagggaattacttgccatttggctgtcaagcctcaaagcagcagcaaggagagctggcacatctgaagtgcaaagaacttcagactgtgagaggaaggaagcaggccaaggtgaagccaggtgagaatccaccaatcccagggaaaacaactgaggaagatgttaaaacaccttattcttctttgtcctcactgtggttagtattttattccttgaaatcacatttagagtctaatttgcttcacgtttacactattgttttaataataaatgtacttcatagacaatattgagcttgtatgatttcaacttacaattcttcaattattaactctagagaaaaacaaaaactcagccacttacatatgtcagacacactatagcatccagaggaatttatacagaattgcaggcacaatgtctctggaggcaaaaatcagtctctttggtttgcaatttgccacactcagctctagtttagacatgaaatttttcactcaattcagctagtcaaatttaaagatttctatctttatcttttcttaggagtgaaaaatttcccttctctcaccctctctgactttgcttagaatatcttatatttaatatttttcctgtttaataaagttaatattataattaacaactatgatagaaatttatctattttacaagacttactccagaaatagcatagctaagtggtgatttggagatcatctgaaggttaccaaatctgcactaaataaagatataccacactatggcatcattgctgttctacaaatcttaggaatctcttacttttaatattgtgctctgtccttggcatttcatttttattatttatttattttttttgagatggagtttcactcttgtcaccccggctgaagtgcaatggcgcaatctcagctcactgcaacctttgcctcagaggttcaagcgattctcctgcctcagcctcctaagtagttgggattacaggcacccgccaccatgcctggctaatttttgtatttttagtagagacagggtttcaccatgttggcctatctggtgttgaactcctgacctcaggtgatccacccacttcagccttccaaagtgctgggattataggtgtgagccaccgcacccggctatccttggtatttttaaaaaattatctgtaacaggcaaggtaaacggattttttttttcttgaactgttattttaagttccgggatacatgtgcagaaagtgcaggtttgttacataggtaaacgtgtgccgtggtggtttgctgcacagatcaacccatcacctaggtattaagcccagcatccattagctattctccgtgatgctcttcctcacccacccctacccccaacaggcctcagtgtgtgttatctcccactatgtgtccatgtgttctcatcattcagctcccacttatcagtgagaacatgtggtatttgattttctgttcctgtgttagtttgctgaggataagccttccagcttcatccatgtccctgcaaatgacatgatctcattccattttatggctgcataggattccatggtgtatatgtaccacattttctttatccagtctatcatcgatgggcatttgggttgattctatgtcattgctattgtgaatagtgctgcagtgaacatatgcatgcatgtatcttcataatagaatgacttatattcctttgggtatatacccagtaatgggattgctgggtcaaatggtatttttgcttctagatctttgagaaattgccacactatcttccacaatggttgaattaatttacactcccaccaatggtgtaaaagcatccctttttcttcacagtcttgccagcatctgttgtttcttggctttttaataattgccattctgactggtgtgaaatggtatctcattgtggttttgatttacatttctgtaatgatcagtgatgttgagctttttctcgtatgtttattggccacatgaatgtcttcttttgagaagtgtctgttcatgtcctttgcccactttttaatggggttttttttttcttgtaaatttaagttccttatagactctagatactaaacctttgtcagataaataaattgcaattatttttctcattctgtaggttgtctattcaatatgatgatagcttcttttgctgtgcagaaactgtttaattagatcccatttgtcaacttttcctttcgttgcaattgctttcaatatttttgtcatgtaatctttccctgtgcctatgtcctgaatggtattccctaggttttcttctagggtttttgtagtttcgggttttacatctaagtctttaatccatcttgagttaatttttgtataaggtgtaaggaaggggtccagtttcaaatttctgcatatggctagccagttctcccagcaccatttattaaataggaaatcttttccccattgcttgtttttgtcatgtttgttgaagatcagatggttgtaggtgtgtggccttatttctgggttctctattctgttccattggtctatgtgtctgttcttgtacagtagtaccatgcagtttttggttactgtagtcttgtagtatagtttgaagttgggtagggtgatgcctctagctttgttctttttgcttaggattgtcttggctatatgggctcttttttggtttcatatgaattttaaaatagttttttctaattctgtgaagaatgtcaatggcagtttaatggaaatagcattgaatctataaattactttgagcagtatggccattttcacaatattgattcttcctatccatgagcatggaatttttttccatttgtttgtgtcctctctgatttccttaaacagcggtttgtagttctccttgaagaggtcttcacttctcttgttagctgtattcttaggtattttattctgtttgtagcaattgtgaatgggagttcattcatgatttggctctgtgcttgcctgttgtggtgtataaaaatgctagcaatttttgcacattgattttgtatcctgagactttgctaaagttgcttatcagtttaagaagcttttgggtcaagacaatggggttttctagatataggatcatgtcatctgcaaacaaagataatttgatttcctctcttcctatttgaatatcctttctttctttctcttggctgattgccctggacaaaacttccaatattgtgttgaataggagtggtaagagagggcatccttgtcttgtgctggtttccaaggggaatgcttccagtttttgcctatgctgcatgatattggctgtgagtttgtcataagtggctgttattatttaagggatgttccttcaatacctagtttattgagagttttttaatatgaagggatgttgaattttatcaaaggccttttgtgtgtctattgagataatcatgtggttttcgcctagttctttttgtattgaaccagcattgcatcctagggatgaagctgacttgatcgtggtagaaaagctttttgatgtgctgctggatttggtttgccagtattttattgaggatttcaacatcaatgtttatcagggatattggcctgaagttttattcttttgttgtgtttctgccacgttttggtatcaggatgatgctagcctcataaaatgagtgagagaggagcacctccttttcaattttttggaatagttttggtagatatggtaccagctcctctttgtacctttggtagatttcagctataaatctggtgaatagactttagaatagagacttcaaagtaaatatatgaagtggctggggtaaattcagtaagtacagactgtgtcacatcacaagccctgcccatcctgagggccattcgcctctcagctccagaaaattgttgtcatgttggaatgctcagtggaatctgaccttccaattgtctaaggaaagccaaagttctggattttatgcaaagtatctgtggttttaaatgctacctaaaaatttaaaaatggatacaacaagcaaactagattggcagcctggatgtctcattagtatacaatctcaatagttttccaagtgtttctacacactttattccaaatgatcctcacaccgactgtgagatgtaaacagggattcattgttccattttagagaagagaaatcagtgactcagaggagatgagcaactcatctaaagtcacagagacagcaagtgatggtaacagactaacttgctggtcctttgaacctgctacaccacatccttacaactaaacttctctgaaacaaagacaagggtccacaggcatcaaaaaggatttaggtactgggcacaggagggaaagcatgtaggatggatggagactcttgtgagtcataaggtgacagatagcaggaagatgtgtgctctttcctgaatgtatccctcaaatatgatagaaagctagccgtcggtgataaaattacaggaaatgaacaattctattatgctaggttccaaaaaatgcaagagaagggtttagtcacatgcatattctagaccttcaagaatcaagtttcagaatgtttcagggggaaaaagctatgataatatgtccagagattcttaaagcagtcatggctcaacaaagttgggagagtttaagtgccaaattctgatactaccatcacaaatagttgcagtatgcaagaaaatgaagaatcagttgaacagtaaatgtgactacataaagatttcagagcaggtgagtgcagtggcttacacctgtaatcccagcactttgggaggctaaagcgggcagatcacgaggtcaggagtacgagaccagactggccaacatagtgaaaccccatgtctactaaaaatgcaaaaattagccgagtgtggtggcacgtgcctgtagtcccagctacttgggaggctgaggcaggagaatcacttgaacctaggaggtggaggtttcagtgagccgagaccgtgccattgcactccagcctgagcaacagagcgagactccgtctcaaaaaaagaaaaaaaactcagagctttgaagtctatcataaaagaaaggcatgaaatcaaagtaattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtacacgtacgtaactaacctgcacaatgtgcacatgtaccctaaaacttaaagtataataaaaaaaaaaaagaaatcaaagtaattgtccaaaagtcttacttattgaatgagcagggctttgtctaaaaagaaacaaagtgggaaaaataaaaatggcttcttggcaaaatgatgtgcaaaatagaacaagaaaagaggaaaattgttgtctgtagcagataatttaaatgtttgtagataagtaagacaaagcagaatgatttgaagcttactttacccccaatttctttttttgttgttgttgttttgagacagagtttcgctcttgttgcccaggctggagtgcaatggcatgatctcagctcactgcaaccacctccacaacctgggttcaagtgattcgcctgcctcagcctccagagtagctgggattacaggagcccaccaccatgcctggctaattttttctattttcagtagagatgcggtttcaccatattttatccaggctggtctcgaactcctgacctcaggtgatccacccacctcagcctcccaaagtgctgggattagaggcgtgagccaccatacttggccctttacctccaatttctatattcaaggagaataatcttcagacaatacccagatgattaatctatgtgatgaaaacatacaggtgcttaatacattggaaatggtgaattgatgtgcggtccaaggcatgggaggagctggtgagatcactgactctctgtagaagagttaacatttctagtttgagacaaattacagccctacatactgaaatgactacagacatgattactaagaaacaccaagaagaggctgacttgtcaactaacaagtatttattgagtggctgctgtatgccatgctgaaagaaataaaaactcaagagtgaggaaggcagatggagttcatgtcttcatagagttttcattccactaaactagatagtaaaaaaaaagtacataaacaaataagattatctcgggcacttagaagtaaaaaaatatatttatggtaatgtaatagaagatttgacggggcaatcactttggctaggttggttagggaaggtctttgagaaagtgacactcaaattgagacttgaacaatgaaaaggaagtagttttatgactctatgaaagtattccaaactgcagaaacagcaaatacaaaagtcctgaggcaggaatgagcttggaggatttcaggagctgaatgaaagctagcatggttagagcccagtgagtgatgggagactagaaggagacacagtcaaagtgctgggactagaccttaataggctccaatgaaaagattttattcttgttataatgggaagccaatgtagggttttaagcaggggagtgacatggtgtgatttacattttagaaagttcactatcttactgtgtggataataggtaataagggaacaagagagtagtcaaaaaaagccaaataggaaactgtttcagtagtcattatggattggtcgtgtccctctaaaatctatatgttgaagttgtaactcctagtatattataactttattaggaaatagggactttatggaggtaatcaagttaaaataacctcatcaggatgggcttgaatccaatatgactaatccacatccagtataatgccggcaggcacacaaggagaacactgtctgaagaggaaggcagacattagggtcctgcttctacaggccaaggaataccaaaaattgccaggaaaccaccgggatctaggcaacaggcattctctctcaacactcagaaggaagaaaccctgccagtaccttgatcctgaacttctagcctccggaactgtatggttcaaatcacccagcttgtgatactttgttatggcagccctaggaaataaatagtccagaagtgagatgatggtggcttggagtaggattatagcattaggatgggagagatgcttggcttccacttttttggaagaagattctacaggatttactgataaagtaaatgtgagaagaattaaggatgactcctaggtttggtatattagcgaaccgatggatgatgccttttactgagatgggggaagtttgtgaagcaacaattatttgctcagtgggagaagtgagaaatcaatagatttgtttaggtcacataaagtaagatgtttattacatgttcaaatgaacatcttatcttcacagttaaatgtattcatgtgaagttggtgggtggtggtgattgggtggaaatctgggctgggctggagatataaatttaaaagttatgaagaaatatttcatatatttgatattcaagtatattcatattaatattcacatactttatattcatattaatattcacataccttatattcatatttttcaaatatgaacaagtatttgttcaaatcaggacaggtatataaaccatgtgatgagatgagtgagtgtagacatacaagaaagccaagaatttggtccctaggaactaaagcattcagtagcctaaaaatgagctgaaaaaagagaaaaagagttagtctctgacatatgaagaaaacaaggagtttttgtgttattttagaagaaaatgaaagtatttcaagaaggatgtagtgataaaatactggagagggttccagtgggttgaaaactgaaaatacatcattggactgcaagatggaagtcattagagattttaacaagcgtcacttctgtaatgatcttgacaagaacgcaaccagagtgggctgaagagaatgtgggacatggagaggtgtagacagtgactgtaggaaactcttttaggaatttttctgtgaacagtggctggaatggagcaacagatgaagagggatatgaattcaaaagaatggggctcaagtttgtgatattaagacatggcatggttgctgaagggagtgatccaacaaaaaaagataaattaatgatgcaaaataaaaatgataactttaggagtaaagtctttgaaaagatgaaaggggatatgcttgttttaaaatgggagcaaagacatgtcctccaccatactcaagggaaagcagtgaatgtggccaaagaggcaggtgatttgttggaattgggggtgagacaaggtgaaagacatgatggcatctattttattcatgaagtataaggtgagatcagtaaaggatgacaaagatttggagacagagaataagctgtcaaatagttgtctattcacaatcagagtagaaaagtgactttactgtggaagtatattgaaagtgtctgattgtgttagatgctcatttggggtttatgatcatatattttatgtgacctcagttagcagacaggtgtatgatattctccaaagtgggtcaggtgttcaggtgcagatgcaacatacatgactagggagtgacaagactgaaagacacaggcaagtaaccacaacaatttaaaacgagagagctccaagtttctgaaagccccccaaaacaatgggattgcacgttaggccacctgctagctatatcctagacccagacattttccagtggagaggagagggtgacggaaaacatttccatagagggcagggcagtggggagtatgacgtaaggtcagagtcacctagggatttttaaatccacacttgctcactccccagtgatgctgagaaacagcaccccatgggaggtatggagctaaaatggaaaatttttcttttagtggacattactattgatgggaatgggccaaatccttagagtagatggaatagaaagacaaattgtgagtgactggcacagttcatacactcctagaagataaagaagtaggcagaaggacacagcatgagctcagtaataaaaagtcaaaccaaacttctcacttccttttctcagtgcattaaaagactgacagagcagggcaggtgggcaagcaagaacaaagattttgttcttgggaataggagagagagatgtttagaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaacaggcattatcattatttagcactcattccctttcaaaaagaagcactaaatcatgtcaacatttcaagaggagaatttggactgttacaaattgttagagctgttttagtcattctccctgctgacctgtgtttgaactgcatgaggtgttaggattataatgtgtatgatacaaaagttccaacaggtaaaacataagaataactttaggcagagatcaaaagtaaaataaaatgtatctagctaggtttttttcctcctcttttcttgtccattgtaattctgcaatatagcaatataaaataaaataaacaacacataaagagaatcagtggccatttagcatttatttagacagcataaaagttgtaagaattgtaatatttctatgtttgtaggttgttgttgttgttgttgttgttttttttttgatgaagtcttgctctgttgcccaggctggggtacagtggtacaatctcggctcactgcaacgtctgcctcagggttcaagtgcttctcctgcctcagcctcccaagtagctgggatcacaggtacatgcaatcacgcccagctaatttttatatttttagtagagatgaggtttcaccatgttgtccagggtggtcttaaactcctgacctcaagtggtctgcccacctcagcatcccaaactgctaggattacaggcatgaaccatggcacctggcctcatctgattattatttttaaactattgtaatcacataatagaaaatggacaaaaacttcccctaactcatacttttaaaaaggcaaggaagaaccctctaaagggaatacttgatgatagaataagagccaaagattaaaaacacaagagtatttcataatgaatgaattataaacatttgattttaaaacaaatgtcatacatcctagccacaatgaagaagagtggcttaagatataaatttatttagaaatttgaattgactgttagattaccgaagatatcaaaaaaacctcttacaaaaataagaatttttctttttcttggccaaaatgaatccggctctccatcaattccagaagttctgaatgcagaggcaaagtgagatggaaagtataaaagtcagaggccacacatactggtcatggtgtttctcctgataacctgcatcctgagaattcccttctgcgatagaactacctatggacctcctaaatccaggtaaagccaaaagaagataaactttagattttgttatttaatcaggtcattcttaaatcaggtattcatagggcaacaagatacttgcatggggagtgcaattaggagagagtgtgcactgatgctggataggaaaatcattgcaaggaacaccagcctttcaactcaaaaggcccccagctgccctgaggaagggctccacagacatccacaggatgtttttgcatttcattcattagcttccaagaggaaaggcaatctagatggaatttctcagttataagtggaaaatttaagaaattaatcatcaaggataggggagtatcattatgaaaattaggtttccatgaaattcttgaacactggcatgtttctcatgcacaaacataaactttcagcaccagaaatgtcatccaatggcccatttaaaaaagtcagtgaatttgtttggttgtatttctgccatcgtacagaatctgagcatctccataacttcaatttccctttcttttttttccagctttattgaggcattcttaacaaataaaaattgtacatatttaaggggtgtaatgtaatgtttgatatatgtataccttgtgaaatggctaccacaatcaagctaagaagcatatctatcaccacatagttacgtgtgtgtgtgtgtgtgtgtgtgtgtgtgtgtgtgttaagaacactaaggccaagaatcttagcaaatttcaagtatacaatttagcatcgttaactatagtcaccatgttgtacattagatctccggaacttattcattccacattaccaaatctttgtaccctttgaccatctccccattttctccatcccctagtttttggcaactaacattctactctctgcatttacaagttgacttttttagattccacatataaatgagatcatgcagtgtttgtctttctgtgcttggcgtatttcacttaatatgtcctccaagtttatccatgttgtctcaaatggcagaatttccttctaagaatactgagtagtgttctattgtgtaaagaaaatgtagtgtgtgtatgtgtattctttgcataaaatttctattgtataaagaaatatatattctattgtgtaaagaaaatgtggcatcacattttctttatccattcacttatcagcaaacactgaagttgttttcatatcttgggtattatgaagagtgctgcaattaacatgagagtgcagatgtctttttgagataattatttcctttagatatatacccagaagtgggattgatggatcatatggtaggtagttctattttaaattttttgaggaatctccatactgtttttcataagtactgtaccaattaacatttctaccaagaatatatagggtttccccttctccacttctccccaacattttttatgttttctctttttgatgataaccattttaacagatatgaggtgacatttcattgtgattttaatttgcatttccctgatgattagtaatgctgagcaccttttcttatatttgttggccattctatgtcttccttttagaaatgtctgttcaggtccttagtccacttttcaatcaggttatttggctttttgctgttgaattattttagttccttatgtattttggatactaacctcattggatatatggtttttttaaataactttgaaaattataaaagtaatacttgtacacagaaaaatatatcgacaattataaaatgataaagttgttttcttctcctatcatatcaacaattataaaatgaaaaagttgtcttcttcctatcttagatgcatagaaacaaccactgtaaatagtgtttgagtatctttgtcaagctctttctacaattcatgtatacatttccctcctttgctacacacgttgttctgtgtggtcttgatactttcacttagtgacttatcttagaagtctttccaccataacagctaacaggtgttaactgttttctatatgacaagcactaaaagactaacttgttttatttaatcatctcaacaactctgtgacgtagactttataattatttcccattttggagatgaaaaaattgaggtagagaaaacaagtaacatgcccaaggcacaaaacaagcagacggcaaagctggtaatttaatccctatggtctcatgtcagagtacagttcttaaagtgtgaaccctacacagttctcccccattgacagcacaccatgttcttttgatagctgcatagtgtttgttacatggatgttcatacatttacttaactaatctctgcacacataggtttgggggtatgataaaatagcagcagttaatatcgtaaacattcaccttcgcctacatgcaaaagtatgattttggaataaattcctagaaataaaatcattgaatcaaaatttgaatttttgattggtattatgaacttccatttcaaagaataatagtaatatacatgcacatcaagaatatgtgtgcctgtacttctccatttttaaaactatgtaaatcatcttacgtaaaaggtggctggaacttaagagctgctcaaattttgtttgatgattgggattgcttttgacttaaataattgaaaccgttttgtattatatgaaaagacaaaaaagtcctgttgtgtagaaagcaaaagagaaaatttaagcatcaaagtcactgtatcctaactgagtctgtgcaggtaatacagactcaaaatgcttccatagcatctatggattcatacacggagaaggaaattttagcaatgatctaatccagcagctagggcaagagtaccagtggaggcccaattgccatttgtctacatatttagaagttataaatcaagttatcaagctgttaaagaaaatttctctcctcctctcttgacaaacacatctgttaggttcaaatacagaactcttggactcctgagaacagtgggtttcaaactttagcattcatcagaatcacctggaggacctgttacaacacagatttgttggcctcatccccagattttctgattcagttaagtctcagatgggacccaaaatctgtctctctaccaagatcacaggtgatgatgatgatgctggtctgagaccgcactttgaaagcatcactctagaaaagggatgaggctccatgtgagcagaactccttggctaacagagtccttaccccatggggtgagctagaggaggagggccggagggtgcctataaatcagggtttctcaccctaaatgctattgacaagttataccagttaattaattgctatgtagagtgattcctgtgcactgcaggatgttttgtaacatccctggcttctacccactagcaagtaagaccccatcaaccctggatttacaatttaaaaaataatgtctacagacattccaaatgtcccctaggacaggggtccccagccccagggcccctgttaggaaccaggccacacagcaggaggtgagtgcggggcaagccagcaaagcttcatctgtgtttacagctgctcaccatcacaggcattactgcctgagctccgcctcctgtccaattagtggccttagattctcccaggagtgtgaatcctattgtgaactgcgcatgcaagggatctgggttgcgtgcttcttatgggaatcaaatgcctgatgatctgtcactgtctcccatcaccctcagatgggaccatctagttgcaggaaaacaagctcaggtttcccactgattcaacattatggtgagtagtataatgatttcattatatattataatgtaataataatagaaataaagtgcacaataaatgtaacgtgcttgaatcatgccaaaaccattccccccatcccatcccagtctgtggaaaaattgtcttccacaaaaccagtccctggtgccaaaaaggttggggattgctaccctaggggcaaagtcacccctggttgagaaccactgctctaaatcatggagcccagggcaaggcccctctgctctgggcctgaaggcagtgctatacagagaagcaaaaggatttgccttatatttgcttcttgaggaattgtgtagtcataagacacacatacaaatatatcacttttctgatgctgaaatgagagaacagagctcattaggagttctggaacatcctgacattatgagagggattaaatatttcaaggcttaggagaacagccagatccctagacaatttggcctactctcccatcctcaagtcacttcgtttagtaataaatatcccatgcttgaattatgattatgttggggctgcttacttaaaaaacgaaggtcatcacaaattcccccaaaaccagggcttttttcttacctctaacaacaagacagaagtgcaggaattacctagacatgtaacacacttcagttgaaggataaggtttgtcctcttccatctattgatgggggaaaataatctaagcatccagcctcagtccttgacagttcatcttgacatataaatgcctttcacagtggataagataaattttttgcaattctaaatatcctgttccaaacttgaaacatttatactaaacattttgtatctgatttcaaaaatctcttcttgaatcttgtcatattctccctgtttgggtcccacagatttgacatactaataactgaaagttattgtgtcaagtagaaattttaacaggcaggtactaataggtttcaaacaaaacatgaatgaactctgctacagaaacatttctcaggctggatagctcagttcaatgggagtttatacagcaaaactttcatcaatagaaatgcttaaagcagagcataagttctgagcttatttttctagttaactcagtattttaaaaacactttttattgcaatcctaactgacaatagatgatagatagatagatagatagatagatagatagatagatagagatagatagttagatagattttttttttttgagatggagtctcactctgtcgcccaggctggagtgcagtggcgtgatctcagcttactgcaacctccaccttccaggttcaagcaattcttctgcctcagcctcctgggtagctggggactacaggctcatgcgaccacgcccggctaatttttgtactttttggtggaggtggggtttcattatgttgcccaggctggtctcgaactcctgacctcaagtgatccacatgcctcagcctcccagagtgctaggattataggcgtgagccactgcgcccagcctataattttattctttgactatgtgtttgtctatctcagagatggagtgtagtaactgtattaggcaaggatctataggtacaaatgacaaaactatctcaaagcaaaggggggaggttaatggatcataaaattaacttgcagagtatttatatttcataaaataaactaataaacaaaactaaatatttaatccatttccaatataaaaattacaaaattgtaatgtgaactaaaatttaaatttataaaatatgactgttaaatatacattatcattctaatataaattagaaaacaaaattaataaaataaagcaccatttaaaataaacatcttattaaaagtgtaaaaataatcaatcataaacattttgaatgaaaatatcatttgaacatatataaaattcagtcttataaaataaacatgttgtaagaatatttttgagcagaagtgtctacctcttttggaatctatgccagtccagatatttccttctggctattttattttcaaaaatctcatctccttttttcgagaacttgaccttttgggacaacacttttttttgagagacagaaatgcaacattttattgacaatttaattttagtttcaaagaaaatatttcttgtttatcttcacatcttttgtttcatcatgtaaagctagagattatcagtttcaatttcaacatgactttttaaattccagttcttcagaaagactgtgaaccagagtagaatgtatttttctaacacaagtcttgctttgttggctgctcttctcttcttcttgagtataacaggaatataaaaatgctttctaaaaatacgtgcatcacttttcacttcaaagttttaagtcagtatataactatatggatccattacaagataaattaattcaaaattcaaaaaaaattaaacaaatattgaattaactaaaaaatcggcattttaaaaatgcctaaaatagtgctggaatatatgagtatcaaaaagtggaaatgtaattgattactaaagagatgtggatggtcttcaggatgattgatgccagggaaccagtaccctcaaggctcttcagctcgtctccacttccttctgtgttgtggggaggagggcaaaggggatggcagcttgattggcttaaagtaacttttctgcaagccaaaggactggttgcctacagctctaaactcacaggcattcgtctttataaccaaaaaagaaagaagtcatctctcccaggtccaatcaaaataaatcttgggccgggtgtggctcacgcctgtaatcccagcactttgggaggccaaagcaggtggatcacgtgaggtcgggagttcaagaccagcctgatctacatggtgaaaccccatctctactaaaaatacaaaaattagccaggcatggtggtgagtgcctgtaatcccagctactcaggagtctgaggcaggagaatcacttaaacctgggaggtggaggttgcagtgagccaagatcacaccattgcactccagcctgggtgacaaaagcgaaactctgtcttaaataaataaacaaataaaaaccttgttgaagatacaaataaaaatcttgttgaagaaacaagtatcccaaaaccaattactttggcctggcagtaagacactttgattggtccatcttgggataggtacctacccctcaaccaatcccagacccaaaagagaaagtcatgtacaaagaaggttgctcccatttggagcccaaggataaaatgggaagtgaagtaaatatcgagaaggaagggatgtaggtcccaaaggaagggaggaatgcagagaagcaacacaatatgtgcccgctgcatgtgatcttaattgaaatgtgttagttcattgttcttgagagtcaagattctacatgttcttcagtttgtatgttagttttaagaagacataggaaatgtaaaagattaggttgaaattagatttgacatgtttattaatgatacaatgggttaatcagtgagtgttcaagctgatataaagtgagttggagctcagaagaaacattatagtgacactttaaacaagtgacagagccagatagacaagggttaaaactgatgcttagaggttaatgaggtgggacagaaatggagacaacagattggtgttgtatcagatggagtccctctctgaggagctattattttagttagaggaacaaattacaaacatgtaaaaaactattttggatactgataagttgttggaataagacaaaataaccaaatgtgatagagttacatgctgagactgaaagctgcctcaagtaggattgtcaaagaaagcctaagtcacagatgtatgagctgagacatgaatgatgaagccctagagttctgtattctatgcaaaaataacggtgaaggaaagtttgaaatgttttatgcttgaaatgttttaacatcaatattaaggtcaatgtgtctaaagtttagtgggcaagtggagaatactaggatatgtattgggtcagagaggaaggcaggggccaaattatgcagtgtctgacaggtcagagtaagaaatcagattttcagtccaaactgtaaaatagtaagaaaagaagaccaaaggcttttgcatgttggtaatattattgctgtcagtcctgtctttcaggtaaaagccagattgcagtaggttttgaagacaacatgaaaaagacaccttatcagaagttaagtcattactaagggtctcctggcatatctagcttcaaaagcagactgcttccttacaagggcttctaacagaaataatacaagccctctttggtcaactcctgatggattattcaagttataaatcatgttcttatttacccaggatccattcatatcatgtccaagacaatgctgcaaccatggtgatgactgggagtaaattttaggaggaagttaaagtgtaaacccttataccagggattattagggactagtaggtaatataatagatgttgtctttgtggttttgcccagatacagaaatattctttgaaaacaatgtttgaccaacttctattgaccaacactaaaagattagggcataaaatcaaattgcaactaactccataaaagcatttttgccaaaatcatatgacccagacacactgtttcccgattatctaactttagataaagcttgtggagcccagagatataaagagtcacctttcccttagactaactcactcaaataccagatgtttcaactgagcatttggcaaatattagaaggcagtctaaactctgatttgtatcatcaattaaataaatgtccataggttttttgatactgaacatgcaagtagcaaagtcaatatgctgttgacatgatttggctgtatccccacccaaatctcatcttgaattgtaactcccacaattcccacatgtcatgggaggaaactggtaggaggtgattgaattatgggggtgggtcttcctgtgctgttctcatgatagtgaatgagttttaggagatctgacagttttaaaaatgggagtttccctgcacaagctctctcttttctgtgtgctgccatccacgtgagatgtgacttgctccttctcaccttctgccatgattgtgaggcctccacagccatatggaactgtaagtccattaaacctctttttttcttcccagactcaggaatgtctttatcagcagtgtgaaaatggactaatacagtaaattggtaccagcagagtggggtgctgctgtagatacccaaaagtgtggaagcaactttggaagtgggtaacaggcagaatttggaaaagtttggagggctgagaagaagacaggaaaatgtaggaaagtttggaactccctagaaactagttgaattgctttgatcaaaatgctgatagcgatatggacaataaagtccatgctgaggtggtctcagatggaaatgaggaacttgttgggaaccggagcaaaggtgactcttgttatgttttaccaaagagagtggtggtattttgcccctgccctagagatttgtggaactttgaacttgacagatgatttaggatatctggtagaagacatttctaagcagcaaagcattcaagaggtgacttgggtgctgttaaaggcattcattttcataagggaagtagagcataaaagttaggaaaatttgcagcgtgacaatgcaatagaaaagaaaataccattttctgaggagaaattcaagctggctgcagaagtaacgaggagcagaatgttaatccccaagacaatggggaaatgtctccaggacatgtcagaggtcttcatggcagcccctcccatcacaggcccagaggcctaggaggaaaaagtggtttcatgggctgggaccagggtccttgtgctgtgtgcagcctagggacttggtgccctgtgtcccagccatgacagctatgactaaaaggggccaaggtacagctcaggatgttgcttcagagggtggaagccccaagcattggcagcttccacatggtgttgagcctgtgagtgcacagaagtcaggaattgggatttgggaacctctgcctagatttcagaagatgtgtggaaatgcctggatgcctaggcagaagtttgctgcaggggtggggccctcatggagaacctctgctaggcagtgtggaagggaaatgtggagtcagagacccccacaaagaatccctactagggcattgcctagtggagctgtgagaagagggccaccatcctcaagaccccagaatggtagatccactgatagcttgcaccatatgcctggaaaagccgcagacactctatgccagctcatgaaagcagctaggagggaggctgtaccctgcaaagccacaggggcagagctgcccaagacccatgggaacccactttttgcatcagtgtgacccagatgcaagacatggagtcaaaggagatcattttggagttttaagatttgactgccctgctggatttcagacttgcatggggcctgtagcccctttgttttggccaatttctcccatttggaatggctgtatttacccaatgcctgtacccccattgtatctaggaaactaatttgcttttgattttacaggcttataagatggaagggacttgccttgtcttagatgagacgttggactgtggactcttgaggtaatgctgaaatgagttaagactttgggggactactgggaaggaatgattggttttgaaatgtgaggacatgagatttgggaggggccaggggcagaatgatatggtttggctgtgtctccacccaaatctcatcttgaattgtaacttccataattcccacatatcatgggaggaaaccaatgggaggtgattcaattatgggggcaagtctttcctgtactgtcttcatgatagtgaataagtttcacaagatcatatggttttaaaaatgggagtttccccacacaagctctctcttttttgtgtgccaccatacacgtgagatgtgacttgctcctccttgccttccaccatgattgtggggcctccccagctctgtggaactgtaagtccattaaacctctttttcttcccagtctcgggtatgtctttattagcagcataaaaatggactaatacagctgccatgagaatttaggggcttgatttatgcattcttctaatcagagagccatcatacttccaatctgggctgaactcttgagatagcaacagatgaaagcaaaaagttttcaaattcaacaaagaactctaaatcttctcatctagacaagcactgagttgagagcctagcatttgagcagcaacacatgaaaggcataatttgggtctaaaacatcctaagtgcaggtgttttaaatcaactgcctctatcatgaaagcatttcagtagaatccctgcaacccatgaaatttgggagacctgcattcttgataaattccctccaaaatataccccctgaagtagaagaatgatccacttggaattagggtatgctggttccggaccctacatacacactacaatgccgttctctataaatgtttactgaatgaacggatgaatgaatgagtgatacaacaaatttatactatcaagataagattaaagttttatgtttttcttgtataattttaatagaaatgccatgttctatgcaataagtctacaccattctctgatggcaaaatatctggacttttttctaactttgtgttcttggctgtttacctacatgtcttccccactccattataaactctgatgatgttattcacttttgcatcctcgacccaatgcctagtccagtacaaggcccataagcagatactcaaaaataaaaagggaaggggaatgctgaatggaattagttgggagttgctttttaaacttcaagtttttgatgcagaatatgtctgaatgtacaaaggcaggctggcataaactccactccagaagctaagaaggaacaccattcccacttccctccttgtgcagcataggccaatcatggccagacaaacccttctagcaagggctttgatctggaggaaatgactcaaaggtgcagggtgacttagagtttatttgaggcatcggtggcagaatcatgaatttgcagcacagcagctggtctcgagagacagtggtcacatggcagctgcctgagcctgttccctcagcaggaagatagcctcatcttgaccattaccatcattcccggcatagcctggctctccagatttctgtcaattcatgagccactcaagtcaactaaagagtaaacttcaaggcaactaaaaagttcaaaaactactagtactcatttctttggaggacttatcaccacttacccatttttcccattaaatcagtcaaataatggatatgggtttccaaccacacctctatctcagattttcctagtccttctgtgaaataaaataatctaaaataaaaagtatctgcatgtctatttgaattttatatatctaaagatatctaaaatactgaagtttcattttccagctatgttgagaaaatggagcaaatggagtacataattttttaaaaatccactgtgcacacaatagccaaaggtgggaataatccaaatgtctgaatggataaacaaaatgtatatccatttaatggcatattattcagtcacaagcaggaaagaagtactggtacatgctacaagacagatgattgaaaatgtgctaagtaaaagaaaccagatgaaaaggcctcatgttgtatatttccatttatattgaaatatccagaataggccaatttatagaggcagaaagcagattagttgttacctggtccagtgggtacgagaaaatggagagtaactgcctagtgagtacacagtttccttttgggataataaaagtgttctaaaacaaagagtggtgatggttgcacaacattgtgaataaagtaaatgccactgaattatacactttaaagtggttaaatggtgaattttatggatgtgtattttaacacaataaaaatcccaatatgcaaatatttagaagaaacataaagaagcatatttaaaaacaggaacctttctatttacaatagaacagctatgttcagggtggcttgtcaaaaggactttctggttgtaaaatctttgcagtttcaaccttataccaataaggttttatcgagaagaaaaataaaaataaccatattcaaaagatttttcatttatctctgaacacaatcataacctatttcatttagacacaataaggaagttgtgagaatgaagtctaatttaatagatcttggcaaatataatttttccactctcacaaagtttaaaattcctttattatagatgagcattagttattcaattcctaaagatgttggtcttcacatgggagaaatggactcaagatggtgggagctgcatattagtaattctttaaactaggataacaaaaatgtgctgctagttgctatcccataactgcatgactcattattgtaaaattgtttcaagtttgttcaatggatcttaggaaatggcatttactcaattttttatttagtctagaattttagaactcctttgtcttcaatttctctaatttctacatttcccccaaatctcaaatacatcaatggtaaaagaaatacttacacattctaagaccctgaaaattattgctttccacccccaatggaattgaaaaagaaaaacctcacaaaatagcaagtatctaactttcaaaggatccatttcagtatatctgtatcaaagccagagtgaatcttttcattctactaagaagcaaatatactgaactatttcttgatttacatttactgccttacttagagtaaacagaaatgccagcaacttcagcttatttaaaaatgtgtgttgcttaagaagaaattttcaataacctcttggggggaaattacaagatattttcatccagattcctcaaaggaaatgattgtaatgcttttataaataatgaaagcatttcattgcagaagtacttaaaatacaattacttcatttacttttagaggcttcatcaaagtacatttccagcacacactcttcagggcaggtgcctataattaaatatggtcctctcacctgattcatttcccgggttttgaaggactctttgtttgagagcactaactctctgtgcatcctaaggaagatattactgccaagttccacaaagccttctgagaaattcatcagtgctacaaactactgaccttaccctaaacccatctgcttgcaggccagctgactcaatatctcctgccagccatctgcacacacatggtgttctgtggcagctctgtgaaccatcagaaaggaagaggagttcacatttatagagagggtcactagggaaagaaaagacaagggaaaccctaattaaaaacatttcttcccatgaaagcacataactttacatgcctctgcttcattggcatacattcattttcatttattttagttaatcatttgatgtgtacctaccctgtgcaaatcactgccttcagtgtgctagagggctaaaaaaaaaatgaattagaaatgttctctaccctcaaagaaccgtagactctaatgaaagagacaggcagttcttaacttttcttaatgagttagaagacagccagagccaggcctcatcccatgagttaaccaggatttgcataattacaagaagcgagttgtaaatctatttctatcatttccttcaagaaagtatacgagaacgcaagtgcgtgagagggatgcaaatttaggattaatttggtatatgtgttaattcctattatataaaggagaatcctctgtacttaaccagcctcagagcacttaggaaacgctgcacaattgatcacaacacacatgagaatcatgatttggctggatgatgcaaaggactgagaaagagctgagtgaatggaaggagtgatgagtgtgggatgaggaaattaatcaaactcaagatcacaaactgcaacactggaggtgctggtaggagatgtctttaattcctgtctgtgtaaggagctagacagttagaagtcttggacctgaagagtgtagggaaggcagaggggccacttgactattctattctagcaggtagaggtgacaaaagaatggcagactatcattaaatttattgaagttgggttttaatgaagagtttttaaatcctctcccagcaattatatgattacaacattttgaacccaaacgtttttccatacaatatagatatttcaaatagagaagtagcttcgtggggaaattttctgtgagttggaaataacacacatagatcagcactatcagcttttataacagtaaaacaaaatagatgaacttggtcagtaaaatccaggaagtaatttaggatccattcagcttcagtggctgacaggcatgagagagtacaacagatggcagaaacaagtagctcaccacagtcccattcatctgaactgtctgagcagtcggcttcaccatcacaccacaggtcacgtgacacacacgcatggtttgcacattccagctcatcatcttggcaaaatgctggcatggggaacaaaaagtgagaaggaaaacattttagaaataaatgtgattatcactaacatgcatatcttcatgtgccagcaggagcatggaaagaagaaaatatgtgatcactgaggcttccaaacgggcataaaaacagaataacataatttgtaaaatatcatttaatagacatcaatacatacaaagagcatttaaacagaattactatgttcaagtgactcaatgttctggttctaacaatcagactgaataaacagtactcacagccgcagaaataccaaagatcagagaacggggttaaaatctgcatgagcagagcatgagggatgaacagactgaagccgccttagatagaaaacaatctctgtccacagagatgcataataagtttttttttccatctctattattaaatgactctctgagtcatacatagttctcttttgggttttaaaaattatagtaaatctccttgattgcctacttaacaaccatttcctttctccctcctttctttaagggagcccgattttgttcaggcccctacaccagccatccccacttccaaaggaagatcctgattagtttaagctgggcatggcatttttctgtctacagtttttttgtttgtttgtttctgaatacaattagtagtccaggagtaaacatgtgctccgatatcagggccttgacctacggttgtgtgattgtgcttcacaggacagctcctgcccaaactctgctgctgtgccatgtgccctagcctgggacaggaacaacctggagaaaacagcaccttttttttgattggttctccctgcgtggtgcttctttttgcagttcagctgtttgtaggaagtgtcttttctaactacacaaagactcctgacggctagctgtgactccgcccaaagttgacctgagcgaatcccttaatgatatcttggagatatgaacacagttcttcctccttccagctggacatgatcaaggaagcatggtgccccagatgcccttggtaatgtcatattttcaccattgtgggagccagcctgagttgaagctgaactgaaaaaatcacagacaaagtgctaaactgctgcatacagcctcaagagtccacctacttgactctatatgataatataaaacatgtgatatgtatatgataataaaagataaatgtcttcattatttgtcattttgatttgggcttttctgttatttgtaggtaaaacatcttaagagacataattattttctggctctaaaagcaatggccattcacttagaaaatgtagaaaagatagaaaagcacaaaaatttaataattataccacccaaagactataactgtaaacttttaaatatgactttctgatctttttctatgtgtagatatatgtactttcaaaactcaggacaatagtgcacataatactgaatattctgttttactcaactaatgacatataatgaatccaagagaaatttttcttctctaatttaattttaatatttgtatattattttcttttatgattgtagtttatgttccctattattggatatttggaggtattttgattttctcatattataaataatgccagaagaatattatagtgtatatattttacacatatttagttggcttcttagaatatgtctttacaagtggagtttgatcaaaagatgtgaaaatactaaaagatttgtatgcatatttacacacttttagcttgtattcaaaatgagacttaactggtgtttaaaataaaaatgctctgttgacaaattcgcataagcacttacagcagtttttctcgtccatgtaatcagggcagtctgggaacccatcgcagatcactgtgtgcttcaaacattgtttattggatggacattcccaaagatctctctctttacaacctagagacagaagaaaaggttatttgcaatagacgtggaattgaaaataatgataaattcaatcaatgtagaaaaattacgctataaaggcatgatgttggcagggcgcagtggctcatgcctgtaatcccagcactttgggaggctgaggtgggcggatcacaaggaatcacttgaacccgggaggcggaggttgcagtgagccaagatcacaccactgcactatagtctgggcaacagagcgagactttgtctcaaaaaaaaaaaaaaggcataatgtcttttttcttaaaaagttttgacctctgcataccatgaataatataattttgaaagtagaaataaccaataatattcatattgtgatataaattgtacagctctcctaacagaagatcaaaggtgacatatggggccaggcacagtgactcacgcctgtaatcccagcactttgggaggctgaggtgggcagatcacttgagctcaggagttggagaccagcctggccaagatggtgaaaccccatctctactaaaaaatacaaaaaacagcaaggtagtgcgtgcctgtaatcccagctacttgggaggctaaggcaggagaatcatttgaactcaggaggtggaggttgcagtaagccgagattgcacaactgcactccagcctgggtgacagaacaagactctgccttttaaaaccatataattaataactgaatcaggattagaaccctagtcacttttctcatgtattttctattcttttcttttttgagaccaagtctcactctgtcgcccaggctggaatgaagtggcacgttcttggctcaccgcaacctccacctgtctcaaaaaaaaaaaaaaaaaaaaaagtgacataggggacatggagaaaaaaatttaaaagcatacattaacattcatctttaactgttcccttttctttctgagtgaaattgctgtcaatgcataagacttatctataaaataatgttatgcttttaagcaaatatgccaaagtctagtgatctaaatgcatatcaccttaaaatgtaatttcattctacaaatcaggaggccatctgtttttttagcaaaagaggctccttctatgccaaacaaaactagtttaagagccaggtgcaaaagctattactttatggtagtcagagatctaaagttggaaacttcatcaattaataagagaaatgaatataatttgtacaacattaatgtaataacttgaactgtaatttgcctatgaaatagcaagcacttgtgatgtatttaataaatgccattgatgattcatgtgcagtgcatttcatatgcctgctaaagtttgacaagagtctaatatgtttatgtcattccggtcagatccctggccccggccaggccgtgaagtacatgaaggaagagactacatggcaaaaaaaatttgagtaccttccacccccttggctagaacaatggctagcatgtagcaggccctcaacatgtgtgtgttttaagtagaacttcatttcatgtaaggaacaaaatgtctctggctctcaggaaaatataatttattttaaggtcagtgaaatgcaaagcagtgatcaaataagaagtttcttaaacaatgttattgttcatctaacctactacaaataagtcgaataaattatgtagatgattgactcaggtttcttggaatccattatgagaaaaaaaattggttttcaaacttttcattaaaaacaattataaaaataagtgacccaaaatgcttactataagctaaaattagatttagtgtgtttcatcatccaaagatataggaaataaatagtgagagtctttcactggctgataatccgggggggtcttaggcccagggacatccattccaagaactcacagggacattatttagagttttcagctagtagaggatccagacagcatctgaaaagttctgacaataagagtctcttgagatttgagaaagagcctgaagcctgtcctctgtgacccagctcccgccaaatggtacagtctgctcattctaccagagagcaaaagacatcaagaaagaggactcaacactccatgcatggtgctgacccttctccagggctgctcctctgctcacaaaacataccacttgctaatagagaatgaaataaaatagcatgagtttttcctgacgattcccaaggcccattcttcttaagactacaaggaagaacttcgacatttggaatgagatgatgaaataccacagaaatagatcatctgggacagaaggccgcctaaagtgcatcctcacaaataataataataataatgatgataatgagataacatgtattatccactatgtatccacattctagatattagctttaattcttaaaataacactataatgtcagtattatgctcaccattttataagtgaggaaactaacatttagagaaattgaatccctccacatcacagctctacggagaaagatctggatgggatccaggtacaagtcatcagttgcagtcctttgtaagatgcgaacatgaagtatgcgtaaggggtaggagcagtggaagcacagctttagagtcagacaactggatttgaatcctagttccaaatctcactagctgtgtgagcttgggtaagttacttaacttctccaaactttggtttccatacatcttaaatacaaataataatgcctgcttcatagggttgctataaacattaaaggaatactccataagcattcacttttcacctctccatgtcttctcttttctcataaaagtttgcatagcataatacctcctttgtggagttacagtgagcacaaaagaagtaggataaaaagagagagatattagttacatgggagatagtattattttaagaagaaaccactttctttgtaaagtgacattttggtgcaattatgttttaaatgtatattctaaaaggaaaaggatatgattccatcaaaaattaaaaacaggcatggatgggatgggctgtttaatgcacctgtaggttatgaaaccaaataattgttgatgtcagaataataacctctccagcacagagacaatagcaacaaccaataattgaggatacagtgttccaaaaaagtcaccaactcaccccagtttgccagggatttaattgatttgagcacaaagtgtcccttgttccaaaagatccccatcagtcccaggcagatctggttgactggtcacactaagtgtgctaagcattcatctgggttttttgcttactctatctctcattttcacaaaaactctgtgaaacaggctgccctgacagaggcagtacccccccacccccaaatggaataccttgtttctctataaaaacagttgtcattacaaataaagtcagcaaatcacctcaaagcagatgctttttgttctgtaagaatctcttagctatgcagctatagagtaagtaggtccactcatcctcttgagttgagctgcatgaaatttttaaattctcaccctttggagtggagccgctcacaaggaggaaggagacaaggtaatactgcattattgagctgacaaaggctggaacagtctggatccagccatcctggaccagtgtctgccccaggaagtggctgtggatgtgacctataaggagctgtagcagccagagtacaggcctaacaggtgtgaagagccttctacagcatgcaggatcctggacaacaaagccccttccctcaaagcatggctgcaaagggctctgcctctgcacctgctatagcagctggaacagaggacctgcttcccactgtggtctaggcctgattatcagggcagccataccagcacaggccatccagccaccatccagctggaaagtcgcagcagcctacccaattcctgagtcacttcccactcttagcagtgccattgttatggcatgctcttcacatatgggtggcccagtctcccgtgaaagaggcaggatgaaggaatggatgggactttaaactgcatggctctaatcctaaaaagagagaacatccaacccaaaaccaacactatctccaggaaaagacaccatccatctacctgagtttactatgtgagccagagacctcccccagcccatgctttagcctgacagaccagcccactctcttttgccataaacagctgtcagaaacaagactatgctagacaggactccttccctcaagggagatggctggggcagcctttgaaaggaatcgcctcctgattttccaccaccacagcaggtgagttcccagttattagcttctgaggatgaacagggcatgttataagcattccaagctgtgagagataatgtgggtgttctctgcatcttacccagagaagtaaactgactggccaaacgtcacacagcctctaaggctaagtaaggatgtaaattcaagtctaagtctacgcaggacactctgccattccagcctgccttcccaagacaccacagaagacgatgaaacagttaaccaagtatttaaagggaaggagaaaatttcccccttaacatggaaaattaaaccctactgagtgatgagaaatcaatcctgaaaattcctcctgaaagcacatttgtggatatgccaaagctatggacataatgactctcactcttctgctagctacagagcaaagagtggtctcctccccagacaaagagacacaaaagcatagagactggtagtatttggagtgttaagaaagccagttaagcccttctgtgagataactcatagaaatgctatccaagaatccaaaaagaaaacatgccttttggaaactctttgaaatcaagctgtaaaacccgtaaatatcagagtcagatcttctaatacaacctaaggggattctgacttgaagaaatggctcaggttatatttaaaggttttattttatttaagatcaagaggagaccaaagataggtgaagaactgatttttggtcatctgaagataaacagaaagtcacttaatgacactcagacatttgcattgctgtcaatcttttctccatatgatgtataccattttacttagaatagtgatcaattagtaattttgattctgtgttcatgtaataaaggattttattttgacagtcgatataaagcacctgttgtagctatattttcatgtgactgctccactgggagttgctgcttgcttgcatcacagcccaggtaccacctgctcttgtagctgacccaaatcgtggaggtaaagcctagcaagagataacctcagcctcacacactcaaatctatagagtgatagaacagctgaaacatacaatccctttgttgttttccttagctctcctttctttgatgtcattcttgatcatttattttcccatgtctttccctcatgctccactgcatggctatcaatgcttggaaaatgttacgttgaaaataaactcatttatcaagttgctagttttacaggcagctccatctatatcatgtatgctcaattacttaagcatacagtaattgacatcttaagcatccttaagacaatgcagtacttctgtactgacacagtgcagattctgctcagcattcccctgtctcttagacttccttcccatatcggatttgcacaattcatcccaacacttgctgaaaacttttctagtactgacattttcaactcttgtttacattggcaattacacaatcaaagcagcctcaacagcaaaaatctaccacaagagctggagacatttaagaacagtattactgattgctaaattctaatgcatatattttaaaagtgtatttataagttaagtgctttggttatcatgtttctccattacaaaagtgccaaagaaacaagaagtaatttctcacacaatatttatttcataactgagttaaataagtattgttttgagtggaaactcaataaccttgttagaaattctgagggagctgcagattcatgacaatgaatagttaattgtccaattattcagtaaagctcaaacacttaataacacaacggacagaataagtcagaaaggcaagaagcttggggtgaaacccagctttgctggagctggtgcttgcattaccagatggtgtgcctatgcacatacgaaaacagaaagacaaacagcaaggaggcaaatggaaacagatgacttcctattagtcctctgttgagccttcatcaacctgacttccttatttgatttgaagtggtgtgtcctcccaaatcactgaacaagcccattcaaatgcatgcagaagtatcaaaggggaacgaagtatgtaaagttttctattgttagtcactttggaaaacttctcataaattagtactgctggagcaattaattgaactccaaatgtattatttcttacccacttttaactttccttaactagagctctcaatagtgctgtcaattatttttaatttttgatagagattagacaatatattctattattttgatgtgcctttaattgtgtgattaaaatactggtgaaaaccaattacttaactagaaacctgatattttagggtcgtttaaaccctataccaatatgatagtactttaagtttattttttgcagaatatgttctagaactcagaacttttagtcttggtaaagttgttttgttttgtttttaactaagcttttgtatttctcaaatatttagtcccctacaacaaatttaggtctagccaccccaacaaagtatcatgcaacctctttgaaccatctaagataatctattttaaattgcatctcaaataccatgacccatcaaagtcatagttcagtgaacaaatctaatacattctcaataaatcacttatataaggtatattcaatgaattttgatttatttctttacaaaacaaaaaaccacaaacaagcaaacaacagtagcttctaaaaacactgtacattcctccataacaaaattaccccagacattgtaccatcattctgacagctgaagttttccagaagatgcattagtccatatttataggagctgacaggatttcagttgattgcttgtgacatttttgtctagatcagaagggcaatgtttaccacctaaaattcacttaatggagcaacgcaatatttcatacttcaaaggccaaaagaatgaaattatttcaaaagatgtactgccttacgtgcttgtcatgaaagtgtcaattcttcttaaacaggaaaggctaaataatcataaccaaacaattctgtggatagatcttcaatcattttgctttcctcaaaaacactgtttattaaagaccattgtctgacttctattccctaatacattgtggttacaagtacaaagatttgcagggaaatataatgacaactaagtccactcaaattaccattggcatttatggcttttccactggcgattttggaactcaatggcagaaatgtcaagaagagttttatcctttgccgaaagagaaaaaatatgagaggacatgaaaatgaatcccaattagactgggaatgatggagtctgaactctgaatgttggagtatgaactctgccttcatgcatctagatgtctatttagcaacatgggaagcatacgcaaagacactattattctggctttaaaactgataacaatggctttataatttaataataaaaataattctttacatttgtgaggtgcttctccttttaataagtgtttgcaaatatagtagtgcccctccacccttatctgaagtttcagtttccacagtttcagttatccctggttaagcatggtccaaaaatgttggcacaatacaataagatattttgagacagagagagagaaaccgcattctcattacttttctttcagtacattgttataattgatccattttattattgttgttaatctctcattgtgcctaatttataaattaaactctatcataggtacatatgtgtaggaaaaagcatagtactgcatatatggggttccatacaatctatggtttcaggtatccactgggggtcctggaacatatccctacggataagggggaggggtactgtatgtatcagggttatatagaagtgcaatttagaggaaatcaagagtcaggaaaaacacttaaaatatatgccatactgttcaataatttaagaagtaaagacattagcattgaatcctagtcctactatcagtgaatagtttccatttttaacacagtttcttattttattctagttatcactgtacattcaagaaaagtaccattgcacatacataccacagttttcctcatcactgtcatcgtcacagtcggcctggccatcacatcttctggaagccagaacacactgtcctgagcggcacttgaaatgactaggtgagcattctattaaaaacaatattactgttaaagggctgaaaacccagaaacatcagctaatttatgtatttacatgtaggatgttgtcaaggagcttttactgaagataagggtggtctcttgcaaaacgaaatagccattttgctttggcattcttctgcctgccaatcagcatctttctccttcattcttggcctcatccctctagatacgcggtttaacatctatgtattccaatgattaattttctttccaaatgggacaacccaacaattgccagagcctgatatgccttgtgcagtcagtgctcctgactacctagcggctctcaatgtgtcaaaatcattttcacatccccatctttccacctagtccacaattccatttctgtacttaatgatcctatgttgccatggtccccaaatgttttttacttgaaggaaccaaggtttgatgttcacctttgccttcaggatcactagtataaaagcatccatacataatgggctctgtgagtaaagtacagtttaaaaaacacctggagtactaattaaactcatctctgagttcattatttttaattttaaaatgattttttggggggaagatggagcaagatggccaaatagaagcctccactaattgtcctttctgcaggaacaccaacctgaacagcatccacacaaaaaagcaccttcataagaactaaaaatcatataagcaatcatagtacctggttttaaattcagatcactgaaaaaggcactgacaagggtaggaaagacagtcttgaatcaccaacaccacccctcccccattccccagcaagagctgcatagcacagagaatctgtgcacttgtggagtgattgtgggactttgcattggaactcagtgctgtcctatcacagcagaaagcaacaccaggcagagctcagccagtgcccatgcatggagggagcatttagatgaaccccagccaaaggggaatcacccatcccagtggtcagaatttaagttctggcaagccttaccaccacaggctaaagtgttttggggtccttaataaacttgaaaggcagtctagctcacaaggactgcaattcttgggcaagtcctgatgctgtgctgggcttggagacagtggacttgggggcatgcaacctagtgcatgccgcagagtggccaagagagtgcttgtgccaccccttccccaaccccaggcaggcacagctcacagctcagaaagagactcctttcttctgcttgaggacaggagaggggagagtaaagaggattttgtcttgcaacttggatatcagcttagccacagtagaatagggcaccagacagagtcctgtcctaaggcccccattccaggccctagcttccagacatttctagacatatcttcaaccaaaagggaacccactgccttgaagaaaagggcccagccctggcagcattagttaccagctgactaaagagcccttgggccctgaataatcagtagcagtactcaggcagtacttctcatgagccttcggtgagactctgagatgggctggcttcaggtgtaactcagcacattcccagctgtgatggctacagggagaaactcctgcttgagaacaggagagggaagagtaaaagggattttgtcttgcagcttaggtaccaggcttggccacagcggggtagaacatcaagtgaattcttggggtctctaattctaagccctggctcttggatgacatttctggatgtgccctgagtcagaggggagccccctgtcctgaagtgagagtcccaggcctggcagcattcaccacagactgactgaagaacccttgggccttgagtgaacacttgtggtttggtagtacttgtcatagacctggggtggtagtgatcatgaggaaaaaccactagcactcttccattacctctctgtggaaagaggaagagtgagaagaactttgacttgtggcttgggcgccaatactgcagaaattcaaaggatcatcagagtctactatgagcaactatataccaataaattggaaagcctatgagagatgaatatattcttagaaatatacaacctactaagattgaaccataaagaaatccaaaatctgaacagaacaataacaagtaatgctatttaagtaatacttaaaagtctttcagcagaaaaaaaaaaaaaaaagcctggtgcccagtggtttcactgctgaactttgccaaatatttaaagaagaactagtaccaattctgctcaaactactccaaacaatagaggaggaaggaatacatccaaattcattctacaaagccagtattaccctgaaaccaaagctagacaaagacacatcaaaaaaaagaaaactacacaccaatttccttgatgaacattgacataaaagtcctcaagaaaataccagcaaactgaattcaacaacacattaaaaggtcattcatcatgaccatttaggattttttttttttttttttttgagatggagtttctcccttgtcgcccaggctggagtgcaatggcatgatcttggctcactgcagcctccacttcccaggttcgagtgattctcatgcctcagccttccaagtagctgggattacaggcgcctgccaccatgcccagctaatttttatatttttagtagagacaggttttcaccatgttggcaaggctggtcttgaactcccaacctcaggtgatccacccacctcagcctcccaaagtcctggcaagacaggcatgagccaccgctcccggtgaccatttaggatttacaggagtgatgtaacatatgcaaatcaatcaatgtgatacatcataacaacagaatgaaggacaaaaatcatatgatcatttcagttgatgcatttgataaaattcaacatcccttcctgaaaaaaaatccctcaaaaaactgggtaagaaggaacatagctcagcaaaataaaagccatatttcacagacccacagttagtatcaaactaaatggggaaaaactgaaagccttatctccaagatctggaacatgacaaggatacccactctcaccactgttattcaacatagtgatagaagtcctagctgaagcagtcataaaagagaaagaaataaaggccatccaaattggaaatgaagaagtcaaattattcttgattgcaaatgatatgatcttatgtttggaaaaacttaaaaactccgccaaaaagctacagaactgataaacaaattcagtaaagttgcaagatacaaaatcaacatacaaaaattagtagcatttctatatgccaacaacaaaaaatgtgaaagagaaaccaagaaagtaacctcatttacaaaagccacaaataaaataaaatacctggaaattaacttaatcaaagaaatgaaaggtctctgtgatgaaaaccataaaacactgatgaaacaaattaaagaggatataaagaatggaaagataatccatgttcatggattggaagaatcaatattgttaaactttccatattatgtgtattaggccattcttgcactgctataaagaaatacctgataccagccaggcgtggtggctcatgcctgtaatcccagcactttgggaggccaaggtgggtggatcatgaggtcaggagatcaagaccatcctggctaacacagtaaaaccccatctctactaaaaatacaaaaaaaattagccaggcatgatggcgagcacctatagtcccagctactcgggaggctgaggcaggagaatggcgagaacccatgaggtggagcttgcagtgagcggagatcacgccactgcactccagcctgggcgacagagcgaaactccgtctccaaaaaaaaaaaaaaaaaagaaaaagaaatacctgatagtgcataatttataaagaggtttatttggctcatggttctgcaggctttaaaggaggcctagagtctgcttggtttctagggaggcctcacgaagcttacaatcatggcagaaggtgaagggggagcaggcacgtcacatggcaaaagcaggaacaagagagagagagagttggaaggaggcaccatgaccagatctcctgtgaactcagagtgagagatggttcaagccatttatgaaggatctgcccccataatccaaacacctcccaccagaccccacctccaacactaggattacatctcaacatgagatttgggtggggaaaaatatccaaactacctcattctgctctgccccttcccaaatctcatgtctttctcacatttcaaaatacaatatctcttctcagttgctcccccaaagtcttcactaattccagcattaactcaaaagtcccaagtcccaaattcaaagccttatcccaaatccaaataagttccttctacctatgagcctgtaaaatcaaaagaaggtatttacttccaagatacaatggctgtacaggcattgggtaaacattcttatttcaaaagggagaaattggctaaaagaaagaggctacaggccccatgcaagcccaaaacccagcagggcagtcattaaatcttaaagctccaaaataatctccttggactccatatcctgcatacagggcacactggtacaggggtgggctcctaaggccttgggcagctctgcccctgtggctttccagggttcagtccccatggctactttcacaggttgttgagtgccaacagcttttccaggcaaagggtgcaagctgccagtggatctaccattctggagtctggagggcagaagcctacttcccacagctccatgaaacagtgacccattggggactctgtgtgggggctccagccccacgtttcccctctgcactgctctgacagatgttctctgagccatggctaaaggtagagcagcctggatgcagggagcagtgtcctaaggctgcaaagggcagtggggacctgggcctggcccataaaaccattcagtcctcctaggccttagggtctgtgatgggaggggctgcctgggagatctctgaaatgccttcaaggcatttttcccattgtcttagctctttgctcccttttggttatacaaatttctccagcaattcagcctgcttgaattcctctactgaaaaagctttttgtttctttaccacataggtaggctgcaaattttccacacttttatgctctgcttcccttttaactataagttccaacttcaagttatttctttgctcctgtatctgagcacaggctgttagacgcagccaggctatctcttgaacactttgttgcttagaaatttctttcatcagataccctaaattttcactctgaagttccaacttcaacagatccttagggcataaacagaatgcagccaaactcttttctaacacaagatatgggtgaacctttcccccggttcccaattagttccacatttccatctgagatctcatcagcctggccttcactatccatatcactatcggaattttgggtcacaatcacttaaccaatttttaagaagttccaaactttccctcatcttcctgtcttcttctgagctctccaaactcttccaacccctgcctgttacccggttccaaagttgcttccacattttcaggtatctttatagcaatgctgaacatctagtaccaattttctgtgtcaggctgttcttgtgttgctataaagaaatatctgagactgggtaatttataaagaaaagaggtttaattgactcatggttctgcagcctttacaggaaccatggtgaagacatctgctcagcttctatgaaggccccaagaagcttacagtcacagtgaaaagcaaaagggaagtaggcacatcacatggtaaaggagcaagagagagagtaggggaagagatgctacagcacttttaaatgaccagatgtcatgtgaacgcagagcaagagctcacttgtcatcaaggagatgacccaaaccaatcacaagggatctgcccccatgatccaaacacctcccatcaggccccaactccaacactggggattacatctcaacatgagatctgagcagggacaaatatccaaactatatcactatgtaaagcaatctatagattaaatataatcccaatgacattcttcacagaaatgggaaaaaagtcctaaaattcatatggaatcacaaaagactcagaacagccaaagctatcccgagcaaaaagaactagaggaatcacattacctgacttcaaattacactacagagctataatagcaaaaacagaatggtaccagcataaaaacagacacataggctaagggaacagaaaactgagaaaagaactcatacatctacagtgaactcattttcagcaaaggtttcaagaacacacactggggaaaggacagtctcttcagtgaatggtgctgagaaaactggatattcatatgcagaagaatgaaattagacccctatctctcaccacatacaaaaatcaaatcaaaatgaataaagacttaaacctatgacttcaaactatgaaactactagaagaaaacattggggaaactttccagtacactggactgcacaaagatttcttatgtaatatcacaggaacacagacaaccaaagcaaaaatggacaaatgcgattacataaagttaaaaagcttctgcaaagcaaaggaaagtgaagagacaactcacagaatgggagaaaatatttgcaaaatatccatatgataagggattaataaccagaatatataaaatgctcaaacaactctatacaaaaataactaataatctgatttaaaaatggacaaaagagctgaataaacatatctcaaaagaagacatacgaatgacaaacaggtatatgaaaaggtgctcaacatcactgactatcagataaatgcaaatcaaaactacaatgaggtatcatctcacccaaattaaaatgtcttatatccaaaagacagacaataacaaatgctagcaaggatgtggagaaaaggggatcctcacccactattggtgagaatgcaaattggtacaaccactagggagaacaatttagaggcttctcaaaaaactaaaagtagacctaatacatgacccagcaatcccactgctaggtatatacctaaaagaaaggaaaccagtatatagaagagatatctgcactcccatgcttgttgcagcactattcacaatagccaagatttggaagcaacctaagtgtccatcaaaagatgaatggttaaagaaaatgtggtacatatatgcaatggattattattcagccttaaaaaagaatgagatcctgtcgtttgcaacaacaaggataaaagaagacgtcattatgttacctgaaataagccaggcacagaaatacaaacttcttatgttctcacttatttgtgggagctgaaaattaacacaattgaagtcatggtgatagaaagtagaccaatggttgccagtgtctgcgaagggtagtggtgggggaaagcagggttggttaattggtacagaaatatagttagatagaatgaataagatctagtatttgatagcacaacagagtgactacagtcaacaataatttattgtacatttaaagataactaaaggagtataactggattgtttgtaacataaagaaaggataaatgcttggggtgatggatatctcatctacttgatgtgattattatgcactgtatgcctgtatcaaaatattttaggtaccccatacatatatacacctatgtacccacaaaaataaaagaatagaaatagaaaatgacttctttatttttaaaatgaatgcaatatctaacagatgagtgccaaattcttcaatgcaatcaagttcacaaattcactcacctaagcagcctgattggaaactaaatagaaaacaaacaaacaagaagccataaatagaagaaattcaaaaggtagctaacatgttcatccatgttagataccctgctgtaattaattttaaaattaaccttccacatattcatcaggcatcaggcaggtttgattgtctgaattttcctctggaaattgactgcaatctgtgtcttcaggccactgtaggcccacaatcccaagaacagactcacagcgttctttagagtgttcacacaatgccctagatgaacaagaaagacaaaacattagaagcagaaatagctccatctgagacagatgtcataaatttatgtcaagttttaattctgtgtatgtggcatgtattgtgggtgtgtggatataaaagatgcacatatatatgataggtatttgggaaaccaaaatgagtaatatctctgcaaagagtatacattccagcaccacactttcaccaaaagaaactttattgcagaaataggtctaaagatgtttccaggacacagattcccttctctacactgcctttctcattctgtcttctgtctttgaaggagacatattctccaaccttttgttccaaacagggaagtctccaacatcactttggatagtttgccaccaaagtcattgaatctatacaacaccctcatcctcagagatctccccctctgcagaccagccttgtgagccatctcatgtgccaccttagcttgcctaaggcatgcctcccttacttcagcttccatcaatattggtgaaaagcttaggactccttccaaacccacttacgttgagctcgagttggttaaaatgtttggtttttgttttaaagaaatgatatattattgtatcaggtgctttcgtgcgtattatgtcttttgtctccagaatatttttaagttaaagtatcagcgtgcctcacagaagatttctttacttctttttttacttcttatggaaaaaaatatgatttttgtctcaatatattactaagaaattagttacacagttaaaaaaaaaactaaccaaagtaagttcctaggccaatatactcttaatggactcaaataaactcttacttatcaaaagtttcaaattttatacactaattcaactaagttctcatttttaagataaaatgggagacagatcttccagaaaggccagctccagtcttgcccaaaactggtagagaaagtgtaacaatcaaatgaggaaatttcggagaaagttctgtctaggtttaagtctggacaaagctcagcataactcaacactggcttagcccaggaatttgtggtaaagataaagccatggtatttctatattaggtcaggaaagatggaaagttcaatagttgataactgtctgttgaactaactagttttgttgcagatttataaaaaatgtatataactcaattgcaactgctattttaaattagtcatatgatacttatttgtacaaaagactatatagtgcctgactctaccacttccaatttttttctgtaaaatggaaattacaacaatatgcagcaccacaagtccagggggcgctgttcttatcatagtccttgtagtgttcagccataggtagcacctctgatgatacacacttcaaaaggttattttgagtacgctacagcataacaatcctcaagtatttagcccattgtaaggactcgatgttagatttttcagtctcatagctaaaaaattcaatgttaaaattaataaacacacctagcaaaagcaactatgtattgctttatgaacttattagcatattattcaaaaatttcttataaacaaatatcaaaatataaaattcgtagtgatagacactgaaaatgaaagatgtatgggtaaacctgaaaaaaagaaataaatttatctaaaagaaatttaccaaaattttgattgaacaacacttcaggatcatccttggtcttatgcattttaatatggaacttaagccctgaaattataaattacatctggatataaattcacatttatatttatagcagaaaatgctgcttcagggaaatttttatctacatatgaaaagaaagtcaaatgccagaaattgttaagtactattaaaagaaattattcactatcactgaccttgctttgcaaaagtgaagtaagatttaaaacagctttttaacataaaattggtagatgttttattagagatacttttaaaagtacttagcagaaattttcagatatttttctacacaagctaacatttagttttattctctctattggtataatttgttcagttccccaagtcattttgaaattttattatttcctgtcctgtctctatagatgcccttactttgttatccatttggtattcagcatataatttattgttttctcttctgtccactatagtaatagtactgctttttaaaaaaaactctgcgtgacttctgatcccaacatatggtttctgcagttgctactcgcatttaggccagcacatttgtatacctaccccttgagggaaaacagcactgaagagagtagcaactcacttctgagagtcatcctgtatatgcaaaccctctgactacaatgcctaacacatggcgcagcaaagggacagactgccaagaagctattgtgttcctgtgctatcatcatagctattgtccattcagggttcattacaatgaatcagaagcactttacattcatttgatctcaaaacaatacaacccaacaaccattactatccttattctacatgtaaaggaaccgaggctgagagagactcaggattttgtctaagggctacctagaaactagagaagggtcaagattttaacccaaacatggactctggaacaatactcttgacactagaatatcactcatattcaaagtccaagctacgctcttgaaatagcgcatcttatttcattcaaacaggcagagaaatgtcagcaatgtccatcgctgtccaatctgtgagtctggcactatgtattcttatgtcatatctctaacaagtgctgtcagagtgcagcattgtaaacacatcagtgttgccagaaaaagaggcagatatatcccttttatactatcatacttttttaaaaaaatggctttttaatacaacagaatgaaatacctgtgaatttatttgattaaaacacataaactatcatcaaaggacgttcacagctcccttgtttggtacttcgttaatgaattctgactcaaatattcattttacaacttctacttctttgtctcacttgttaaatataaagtatttgataaatgcagagctccttagggaaatttacgttgtccaaactcaactaagtcttcaccccttggttctctctgaggcaaaataagggactggggtagatcccatcatattacctgcaaggagggatatgctcgcctgtattcacatcacattttggtaccaaaatggtgcaagaaaagaacatgaggtatttataacagttggtttgaacaagtgcagggaaaagagaagactcccagctgatggatgcttccttttgagtcctgtggccaaaataatttggataacttgtactgttgtagggcaaattcatgcagagttccaatgtaattggttcacattgacctaacaaagaaacatacacacaaatatttttaaatttcacatataaaaacaacttctttaagttttacaaacttgaagtctattttattctttctttagagtagctaagactagaatgccagtagtatataacattttttatggatattgaaaataagtaagttgattagtgaagtgccctggcaactaagattcatttctgtatatgtagttgctagcactgtgacaacatcttgctttagaaagtccttcctcattttttcccttggctcaacttatctaaagatgactctctttcatcattccttttattgactccaattcatcttcttcttctgatttacttattactactaaaataggatagccccatcatcttcactgtcactaaactaattaatgaatttgatcaaataggcaagtagataacttctgtctatatgttttattgttgattaatgtgtttaaatataaggctacaagatttcagggcaagaggaggctcagatctgttgaatacttctcactaataagacaaaatccaaaccccttagcttgaagtctgaggctattttatacttcaaccctaggctaacttttcagcttcattgcctgtgattatccaatcaacagtatctctgctgtaataaattctattcccttatgacaccagatattttaagaattgtatgactttatgcaccctgtttgctcctctcttacctcctcttttataacatgctcataattatctccccaaaggtggtcatggttctagctgccagggccatacggcacctgctgcctggattaaccctttcccatcttccccaacaagctaactcctctgtggtctggaagactcagcacaaatacctcttccaggaaaccttcctggccaaccactcttcccattactacttccagaatgagtcttttgtgagtgcaatagcgtcttaggcacatacccaccatatgttcattgcattctgccatattctttatttacttacttgcctcccctacacaatcctgagatttttgtgaaatgagactttatctcttgatcttgaagtctacacctagcacagtgccagaatgaagggaggaaaatgtatcagggactatcctaggcaatgtaaatgtaagagtaatgagaaatattgtctctgccactgaggaactccacaatctcgataggaaaaaggatgcacgcgctggtagctgtagtagaatgtgaacagggtaggatagagtttgcatgaactgaacatttgtgtatctccattcatacgctgaaactctaacctgcaatgtgatagtatttggaggtggggcctttgggaggtgatgaggtttcaatgaggtctagatgagggtggcatttatatgggattaaagtccttataagaaggagaagagactaaagctctcgctctctcagccatgtgaggaaacgcaagagggcaactgtctgcaaaccaggaagcagcctgttaccagagaccaagtctgccagcatcctgatcctgcacttccagccttcagaactgtgagaaataaatgtttgtcatttaagccacccaatccatggcattttattgtagcagcttgaacatactaagacagacatattgaacaaaatgctagagtccaaagggaaaaggtagtgcaagagtgaactgggaagccctctgatatggtctggctgtgtcccacccaaatctcatcttgaattgtagctcccataatccccacttgttgtgggagggagccagtgggagatcactgataatggggcagttttccccatactgttctcatggtagtgaataagtctcacaaaatctgatgattttataaggggtttcacctttcacttggctctcattcttctcttgtctgccaccatgtgagacgtgccttttaccttccaccatgattgtgaggcctccccagtcatgtggaactgtaagtccattaaacctctttcttttgtaaattgcccagtctcaggtatgtctttatcagcagcgtgaaaacagactaacactccttccaatgataaatgtggtttgggcagctttgggggaatacagcagagaggctcccagctccctctctctgtttgcagtagatatgccacattccctgtgtggagaggcaggcaagcaagtgtcctggtaaaattcgcccaggcagaccaaagactccatgccttattgagagtgattattcaaattaaatttaattatttgactaagaagtggtatccatgcaaatagatttgcaataaggactgggctgaaatattaaaacatctccaggactacttcttaattgaaagaatccgaggatatcacagatattatatttataaggaggctgatgttggcctgattaaaaaaaaatgatgcatgaagtgcaatatgactctcagtttgctgaagaagacacaacactgaaaggctggcataatcttgaggatgagtcagagtggagagaagactagacggaagaggtttggggttggtcggttcagtttatcctttcctgtgatttgtgaaggaggggttggacattatggactaaatgtttgtgttcccccaaaattcatatgttgaaatcctaacctccaatgtggtggtattaggaggtggaggctttgggaggtgattgagttataagggtacagcccccaagaatgggattagtgcccttataaaagggaccacacagatctctctcgctctcttttcacagtgtgagaatacagtgaaaagtcagccatctgcagcccagagagggtcctcaccagaacctgaccatgatggcaacctcatctcagatttccagcttccagaactgtgagaaataaatgtatgttgtttataagcaataatgatttgttatagcagtctgaactaagacaagaagtaacatttaaatattttgttacaagatttaaaaatgcatgtttttcataacaataaaaacactacaaagatgcagaaagaaaaagttcaacatctctccactcccctttctgttaccttccctgcaagccaacagaaggctttgaatgcttccatgcctttccccgctcacatttatccatacatgcctttgcacacttagacagggatttctgtttgcttttgccaaagcagaagcataccattcctatcacccttcaatttgcttttgttgcttatttgtcatgaccatcttacaagtcagcacatgcagctctaactctatgcttttttcctgatatctttaatatacttaaaattttacacaattggttcacttacagatatttctgatgcagtcctttctttccttgtgcataccctccgtttctttctttctaccaccccatcaaggttcaactttttattgatgtatttcactgaagatgattaacagaacatatcgcatgaataatttttctcttttttacatgtggagaatgtatcacttttgatttgggttaagacataacttttaagtgtttaggagccaaggaaaaggaaaggattaagtaatgatcatatattattctgtagatctttattgaattcggtaaggtttattggatcttgagttttattcctttaaaggcattcttcacagaatgctaagcaagataaactctcaaaatacctgtcaaccccaaattctatgatttatgatatcaataagcttttttatcttaagcattaggctcatgtgtgatcctgatttaaaaatcgccactagagggagatcgcatcacaaacgtgaggatattttagggctgcagaactgtgcttccgatataagtttgatgtagtacccagtacagtgtcccgaacacagatgaggtttaataaagatctgtcaaagaaaaaaatcctgatggaatctcaatggtattccacctttcaaagtctgtaacaagattcgttcaattcaacctaaagatgggatcgttaactcaatggtgttatatcgttatgatgtgatactctgaagttactagaaatcatgtattaagcgatggtcatttacatgaaaaatgtgacttttctacatctagctgcgtatataataatattcaaaaattcatctttgcctcaaactctaaatccctctttaacattattatttttaatagtttgatattattttaaggtgaacatccttataactacctcccaggtcaagaaactgaactcaggcagacaccgcagaaaccttccatatatcttgtcttatctcaactgtctcacttccttgctcttctatatatatatatatatgcttttttttttttttgtgacagagtctcgctctgtcacccaggctggagtgcagtggcacgatctgggctcactgcaagctctgcctcctgggttcgcaccattctcctgcctcagcttcccgagtagctgggactacaggtgcccaccaccacgtccagctaatttttttgtatttttagtagagatggggtttcaccatgttagccaggatggtctcaatttcctgaccttgtgatctgcccgcctcggcctcccaaagtgctgggattacaggcgtgagccaccgcacccggcttctttataattttattacctaagtgtgtaccacccctggatattgtaatttaggcttgcccattttttgaaacttgtcctgtcttttaagtctctcgtagtctttgggttcctcctccattcttttgtttttctttataatttaactatagaagaacccagacatttgacttgtagggtataccagcttttgaatcttgcttatcgcacactcctggtgaagttaaacacgttccccattctttctatttctgaacctcggcagctgaatcaacaagagtgggctgggcttcattccattcacaagactagaagtggctaagctgttctttcaccagaagccacatcattctgatttccctctttttgtgatgttagcagctgtagatgctccatgtcttcattcattaattcaacgtgttaccaaatggtaatattgtattcaatctttttttcacttattagaaaatgcacatggaaatgcttttgtaaatacatcattcctctcttctactatttgctcctaaggacagaagtctgtaaccattatagtgattggcttctctaccacatgactacaccgtttactcctaccaactgaagcttgcaaagagagagtaggaaattgctagacccttagggaattattcaaaaagcaaacctgttcatttcttccttggtgttgaataagaggggaaaatgcacgagtaagcgtaaaactaaaggttgacgaacactgtgggaggcttgagagagggcctgggacatgacagccatgcctggatttcacagccatggtcagcatgggcacagggaggcaggagagacatgcccaggagtcgcttttgcaggttctccccattgtctggattgcataccacaagggagaagtgatggattagtccctccacaccggaatgaggagaatagcattcctgctcctaccctcaaaggcaaggacacatctgtattttgcctcccaacatggcacagaaatgttaaagatgctgggttgtgactggacatggcaacacaggctgctaaaagctatttcttgaaaaaactatgtatcataagaaatgtggtttttaggctttttaaaaaagctgtaggcacttctgtgaatttaaaataagcttctccactgaaaaatgcacatgggaatacacaaaccttttcatattctatttcaaagttctcacatacccctgcagcccagtcataaataggcactagagcaatacattctcaaccttggctatacattgaagtcatctgtagaattaaaaaatactgatgactgggtcccacccaatatatctttagcgaccattagaaaatcacataatattttatgggatggcaagaatcagagtcttcaaggacaagaatcccggcaactccagtgagaggctgtctccaccagacagaatatctactacattctccaaactcaaattttcctttggcatcaagcagactaagaaattactgttcatttgtgcctcagaagctaagtaatactagtctcttgatagtggtaaacatcttcaagtaatgaaccatattttcaaatgtatgaaggattttctgagatgccacttgtttgtccttacagagacctaagtatgcatatatcatcttgaagttctttgaaagatcaggaataacatcttgactttcaactgcaagttaggcacatacgccttattttttatttatttatttttttattgagacggaatctcgatctctcacccaggctggagtgcagtggcacggtctcagctcactgcaacctccacctcctggattcatgccattctcctgcctcagcctcttgagtagctgggactacaggcgcccgccaccatgcccggctaatttttttttttgtatttttagtacagactgggtatcaccatgttagccaggatggtctcaatctcctgacctcatgatccacccgcctcggcctcccaaagtgctgggattacaggcgtgagccaccgcgcccggcctatgtgccatttttaataacacaggagtaatgagggcaagtggctagcctagtggcttttactcagaagagagcaggtgcaaacgtttgctgaatatatgtggagagaagttggcaagaatatacatgatgaatgaggaagctggtgacacagtgagacactaggtaaactgagtgtatttaaagagcttaaagagaacaacagtgtagaatatatcagtgggaagatgacaatatgttctcccacactgaaaagtgacttctaagaagctagaagcctgtctcctttctccaccactagaaagcccagcgcccatcccgatgcttggaacatcatgtacacactacaaatattggtcagctctatgagccaagagttatccagttgcctttcctacaatttattcttttgacaggagacaacatattttaaatatttaaaattcgaaatatttcaaatatagagaaaataggataacatacacccagtcacttcctacccaaatttgacacaggctaacattgccttttctacatttttgagtctaatagtaagtgtcattccatgtcaaacaacccccaaaactttaatagtaaacacatgtctttgagatgacactgtcactatttaagttgaaggtgaagtaaggaaatcgctctgaaaaatttccacggcagattgagagacgagtaaaatgaaacaatggaaacagtggcccaaatatgttatacgtgtgtgtgtgtgtgtatatatatacacacatatatacacatatatatgcatatctatagatatgttctatttaaatcagtttctatttaaatcagtttagaggaagtaaaatggcagtttgagtgtgttgactttgtggcttgactaatatctactgttctctcatatgggaaatggaggaggggtgggcatgtgcttccaggcaaagagttattaaatgccacagtcaatcctgtcagtctgggttaattagctgcctgcctacacccccttcccagcctccttttttcacccccttgagactctgtaacagttatagaggtactcactataagctctacagtgacccagaaaaattaggaccgcgaaactgcagcaaatgcaaggccgaagactttcagcatcccagcttccaagggccttagactgagaggacatgtgttaagaagtaataccctggctgggtgcagtggctcgcgcctgtaaggccagtggattacttgaggtcaggagtttgagacctgcctgaccaacatggtgaaacgccatctttaccaaaaaataaataaataaataaataaataaataaataaataaataaataaattagctgggtgtggtggtgtgtgcctataatcccagctacttgggaggctgaggcaggagaatcgcttgaacctgggaggcggaggttgcagtgagccgatatcgtgccactgcactccagcctgggtgacagagccagactctgtctcagaaaaaaaaaaaaaaggaatatcctcttgccaactgaaaactgactgacctgcttttaaatttctaatcccaacctgaaaatgcagcaaaaagttcattagaaaaagtgaaagaagcgagtataacatgaaaacagagcccaggagtcagaaatcattactagaaatcagtcgctggggattttctgattccattttccatgagagtccatagggtgctctttcacttccgcccattctgtcttccccaaataactcctcctcctgaaagtcattttagagccacctgcttacaccgtttggagctgttacactgtcaccgaaacaaattagcctaatggttccgaaaccattacaggtcatcagagttcctggaaaggcgagaataaatttcattaaaagaaccgactgcctataatcccagcactttgggaggcccaggcagatggatcactgagggtgtttagcgcctgtaatcctagctactgtggaggctgaggcagaagaatcacttgaatttggaaggcagaggttgcagtgagccaagatggggccactgcactccagcctcggtgacagagtgagagtgtgtctcaaaaaaaacagaacagattgccaaagttgtatgtggctatttctatgaacttcatatttgcttcttggttaaagtttccatttttgaagctatgctttaaaaaggaagaaagatagcatctgcctacagatggagccaagaaaataatacagagaactaatgctgagttgaaagtaatggtaatgatattaagcaatgtggacttataggcgttcgcaatgacacatttgtttctgattgaagttaattaagaccatttggtttctttactgctaccacatgcgaccttttaaaaagaaaaagaaaataggtaggcttttttggagggattccagacttcagtatttgaatgtcaatgcagaagaaaaatgctgaatgcatgccctgacatggctattgcatttgtcagctgttgtacttactacagttattcagactgttgttcgggtcacagagagagctaccaccacatgaatcaaggcagggattgtagaggcatctttggtctccttcttgacatgaagtctgaactacagagggaggaaaaggcacattggctttcatcatctacaaattccttacctaaggatctaaaagatcaggaatgtctgatggagctgaggaataacacaactttaatttccttccaatttctccaaaagtattgaacgtacgttgaataggtgctttctggattcattttcctggtaattaaatacaatccaggtattccaaaataggaatgaagaaataagagacaaactacactaaaaacaggtggttgttgcatttaatgggaaaaaaatagtgttttctttttacatgggtgccaacacttgattacaaaataaaattcaagagatttgagggacagagaacgttataaaaatcttgaaattctgaatattaagtgacacttttttaagactcatttgctcccaattctagtctccctctaaggaaaatgctttctctagtaataaatagggcatcaacaccaatacaataaggatactttaccataatacaagtgttatgcagctgttatccatattttcaatatgtccttggaaagtgtcatcagcctagctgtgatgacttgagaactgggtttcttgtttctaagtgaatgacagcagtagtatcagtgtttgccctaatgatttttccttaaggtaggtagagaggaaactgcttttccttgattccctggtcatttgtagattaaatggagaaggtaataaattactgcccattcactctctcccccattacgatcaattaccttcaggcatgtcatctggaatctagtcaaccttgcaaggcacttttaagtataaataatagtatgtgtgtatgtataatcattcttacctataattctaagatgatgtttattatactgaaatatttatcctttccagtaccactaatgtgcaaattaatacacaaagccttgcagaaaagagatgtcactctttttttaatgtcagcagggtcaaaattttttctcaaagcaaacctaaacaatttctgtgagtttaggctcttgaggaggttttattgacatcatgcattcattattttggcaaatattaagtgcatgccatgtgacaatctatgtgacaagctaggcactgagcattaaaacataaaagggcataataccccctgggaagtggcttgtgctctgatagaggtatcatcctgaacaaaaccttctgatgctgtgtgatcactgctttatggaagacatatttatttttacttatttattgtttcatagagatgggggtcttgctatattgcccaggctagtctcaaactcctggtctcaagtaattctcctgcctcggccacccaaagtgctgggattacaggcatgtgctaccacgcccagctaaaatacatttaaagagcagtagaagccaatgagaccagtatggggaagtttctcaaaggacttttccaagtcatggtaagaggaaaggatgggtttcccaagccaagaaacagcacatgcaaaggcctagaatagggaagtgcacaggtcaaagtaactggagcttcaaccactgagaaaggggctgagagaggctagacagataggcagggacagagcctgaagagtttcaaaggcctgactcttcagcaagacccaaagtctccagagaagtggcccctgcttccctttccagctctgtctagcagaacaaacctgcaacccatgctgacaattatgtagtatttagtaccaggccccctttcgttctcagctctctaatcacaatggtctgccttctctcatggtcctcctacacatgccttgcaccttcccaccacaggaattttggtcaagcggtgccttgtgtctcaattgctttttcaagccccgttctttttggttaaccccactcatccttcaggtctgagctccagtatctcttcctcagggaagctttgtctgaggcgctttaccagggcatgcaccctattaagggcatccaagcaccctgaatttcccttcttagcctctgttgctgcatggttaagcattgacttgcctaataattcgtagcatgcctatgtcccccaggagtctgcaagctccatcagcggttttgcttaccactgaattcccaggggatggccacatataaacaccacaatatacattttttgagttgaatccattaaagtgaacaatataaaaatactaaaattttacttttaaatctgttttatcatatgactttcttacatctcacacatgtaaggaaataatctacaaagcctgccatttcatcatgaaaaatccaaaattatttcagagttgaattatacagaaagaaagaatagtttgatgcaaacggaagtgctcggttgatatgcacacaataaattacgtttaataaaggatttcattctgaatttaaaaactggtaaaacaaagcactctttatatattatttttatgtaataagtctgtgactgaaaagctctccctttaggtcttgggcatttttccattaaagttattctaatgatcaatatgcattacgacaaacctaatttatctataggtgaccagtctcattggctgattatgaatatacacagcccaagatatgctttaatgtagtagccatgtaataaaagctcacatatattgagtttttgccatatgccaacactatgaagtagttatcactattctgagtgtacagacacgcaaactgagacctaaaagggatgtaagtatcttgccaaaagtcaccatatagtaagtagcagaccgaggcttgatcctgggtatcagggctgcaacaatcatgttattaacaactaggctgtgcccgtgtagtataaacaaatgtgatgtttgagtctaggcatattcttccctggaccctactgagaggcttccacacacactggagctgcatagaactttcttttctgacagaaatagttacatttaaaaaacaatttattggatctagtttttctttttgagattcacacgcagatatcaaatccttttaaagtgtattgctcggtaataagaggcattaaactgcttctctgaacatgattattttaggaagacattacatttcctttcagaagccaatttcttctcactggaatctaatctgatttaattggatgctatacactaaacttctctctttatcacggctttccccatcgaacagttaagtgaatctgaccatgctgttcaggtgtctcacctgaggaatgattttcagtgtaagttgcttgagaattatgtttagcacaagaaagtgtttcctggctgactagggctgtgaggaccactatgttaggcaatctgggattatttacatgggaatcctacttaagcaacttcaaatgtgttcctttgttcccaaggagaggaccaccagtaaaggaatgttctggggtggtgggacacacttactgacgctgcagttctcctcatcactcccatccttgcagtcctcgtcaccatcacattgaaacgtgctggggatacattgtccatttctgcattccaccagaccctggctgtgacaggctaggaaggaccataacaatattcactttatttattaattcttctctctcaatctgcacatcaaataagcaacagccatttatcaagcatcgctaagaaacaaggtgttctgcacacacaaatgaacatatcattgattttatttctagaatttttcctgccttattgaacagcacttaccaagattaactttttcttgagaactgtgtgattgtttttagtgatggaagtatcatgatcctacttactaataaaaatgacaatttgtaaagggttcattatatggcaagagctgtgctaactgcattgtatatataatctcaaattctcatataaatcttgtaaagtagatactatcatctttgttttacagatgagaaactaaagtttacagagcatagtacttgctcaaagtcccatggctaagagctacagccagaatgtgaaggcaagctttttggactctcagccccaatatttcattatttatctacttgacctcataagccaacaaaatagtatatgggaaagaacttgcatagtaactaacacataataaacactttatttcaacacttgtttatgacaactgatatttgaaagggatggcctaatatccattaaccttctaattcctatcggttctctaaattctatacctattgtcttttagagtatcggaaacccatggatcatgtgacctcagccttcactgaattactaatattatgacctctctgttcttgagtcaagactccacaccagaagtgttctacctgagcaccatgtccttgcttctccaagatctagtgagatacagtccactctgttccactgtgtccactaggcaaggactcggaggacatcccacttcaaatccatttcagggaagaggagagctacgcattgtgactttttatatgacttttcttatgtcaaaataaaaactatgtaatccacatttctatttttgcctcaaattataagccaattaaatattcaatctcatgtatataatcaactttcttacttttactagacacaaaaagatgaaatgaaaagtataattaattcaaacatgcaaaagaacatatcacattaactctttcaggtcaactgcactctctcttaagacctgacagcttctattcaatcatgtatattattctctaatgggtatagtatattttccagggggaaaaagtgttaatagccatacttgttattagtttgaagtataacaactgtctgaagattttcattcacacagaaacacaacagtttataaatttatattattactacgttctctctttttttttttttaaagatggagtttcaccctgtcacccaggctggagggcaatggcttgatcttgactcagtgtaatctccacctccctggttcatgccagtctcctgcctcagcctcctgagtagctgggactacaggcacctgccaccacacccagctaatttttgtatttttactagagactgttggccaggctggtctcaaactcctgacctcaggtcatctacccatctctgcctcccaaagtgctgggactacaggcgtgagccaccatgcccggcctattatgctctctttgtatcatcatatgaacattaaaggctctcttctctctgacgattctttccatgttcttccacaaatggcccctgaaaacatgttagggcactcctgcagggaagcttaactactcatgtattgtttgcagaagaaaggttccccattctgtgggcagagcatcacctttgacaaagtcacagaagcataaaagagacatatggagcaacgagagagaaaacagacacccacttggctagatcagccaaatgaagcttggagttttgcagggagaggtgtggaagtcagatacactccattgctattgtcatcccatgactcagtgatctttacaggctagaaccaaagcataagaatctttcccttggaatgctgtgtatatagtgagtcttaagtacagtcctcaaccttgagtacagcctaaagaaccagaaatggaaaaataagcaaaacaaacgtcctcagagcactcacagcagttgacctcgtcagacttatccacacagtcgtggtcaccatcacacacccactccatggcgatgcagcgcccgtccccgcagcgatgctctgttgtgggattgcaatctggagaaatgaaaactcacgaggatgcagagaaccagcatgactaacaggcaggattctatggctcccagttcccatcgaagagagtctgttccaatggctccaataccttcaataacatttctacaataggtctggcccaattaaaatgccacgccctccccactcatgtgccccactgaccaccatcactgtggggtaagatgggtctgtttttcagataagtaactactctagctgccccaggacccgtagtttgttcttattgttgttggcttttgttttctttagttgtcattttctttccttatgaaaaatttatgatttctaccctggttcaaaaaacagaactgtgatttgtgtttcacaatgcggctagcggatttgatgtatctgtaacagctctctcacgtttctaggaattataacttacctgtctggcaaattgggaaggcacgtatctccttgtcatctctcctgatgctaagcttaagtttttaattgattatcttttttttgagacaaggtctctctctttctcccaggctggagtgcagtggtgtgatcatagctcactgcagcctcaacctcctaggatcaggtgatcctcccaccccagcctccaagtagttgggactacaaggaatatgccagcatgcctggccttatatccaaaagaactgctaggtaagccatgcaaaatatttatgttatattcatgattctttttagcctggacttcaactttgtcccaatttatatattagtgaaaaagaactaagtgataagttcgctctcacaaagggcagaatccataggatgctttgccatgagaggtggtataccctgaatataagcagtgttttagaagatgtatgtggattcatgaataatagattccatgagaaagtatgatgagtctagtaacagtgccatggtcatagacagacttccggagtgaccatggatcttaaagcatattttggatcaacagaggaaagtatagggaggacataggtttgagaaaagaagaaaagcataagaagtgcttgggcaggaaccagaagagcacagggagccagggcagaggctggtctgaaggaaagtgataattattgctattagatggagacaactggcatccagacacacaaacttcatgatagcctgctatcttcagaggaattctgttgcctgttaagaccattttttctcacatgctacctgcatgctggccctctccactaacctatccaactaccaaacgacactcactcattttcaatcccctgcatttcctaattatctcactggtaaagggaagggttgaatctgatgatctccaaggcctcctgcaactataatttctgtgatctatataattacaatttcctctcatcctttttctcaagactagtcagtcccaggatataacccacatctaaatgtaaattagtatagtcattatggaaaacaatatggaggttcttgagaaaactacaaatagaacttccatataacccagcaatcccactactgggcatatacccaaaggaaaggaaatcagtatatcaaacagacatctgcacccccacattcactgcagcactactcacaataaccatgatatggaatcaatttatgccatcaaaaaatgagtggagaagaaaatatggtacatctacacaatggaatactattcagccacgccaaaagaataaaatcctgttatttgtagcaacatggatgagcctggaggacattctgtttagtgaaataagccaggcatagaaacagaaataccacatgccctcactcatatgcagagttgatctcatggaaatagagagtagaacagtggttactagaggccagaagggtatggaggaggagggacaaagagagattgctgccaggtgcggtggctcatgcctgtaatcccagcactttgggaggccgaggcaggcaaatcatgagctcaggagttagagaccagcctgaccaacatgaagaaaccccatctctactaaaaatacaaaaattagctgagcgtggtggcacacacctgtagtcccaagtactcaggaggctgaggcaggagaatcacttgagcccgggaggcggagattgcagtgagccgggatagcgccactgcactccagcctgggtgatggagcaagactccatctcaaaaaaaaaaaaaaaaaaaaaagagagagagagacagagattgtttaactgatacaaaattacagctagataggaggaacaagttgtaggtttttatagcactggatggtgactatagttaatgataatttattgcatattttcaaataactaaatgagaagattctgaatgttcctaatacaaagaaatgataaatgtttgaggtgatggatacactaattaccctgatttgatcattacatattgtatacatgtattaaaatatcatgctgtattcaataaatatgtacaactattattagtcaaaataaaataaaaataaactattatcagaaaaaagcaataacccacctctatctagtcacacaggaatggtttgtacacatacattttaaaatatttttacagatacagcaagtggcagctagacagcgctcctagaaaccaccaggtttcccagcatggggttattcctaacattcatgattccaatgccttcctctgaccataccgctgatccttcccaaacattcattttgatgttatctaatgcaggacattgtctgatatcatttgtccagggtgtatcctcatcccagtttgcccttttgttcatgttgcaaagttcctacgtcactcaataatatgctacctaaaaattctgaagctagtcacaaagccaaaaaagtaaatgagcaagaggaattttgctgattttaattcatgagatggcattcagaattggacatgactctttaaaaagtggggttattctttaaaagataagatcaccatgtgtacacaaaacaaatgcatcatcctaaccctgggtgtagctgctgaacaggtggtccctgtactatttgaggattaaataaaggaggggacttcagtcacatgtaccaagggaatcaggcacagacaatatatctgccctcaaagtttgctcaaaagcccaaatctaacgtaagccactggctctaaccagaggagaaacagaacacatttgaggagaggaaaaaaaactattaatgcattaacaacctttaccagtcttcccatcccacttcttaaacattttcttaatatgattttttaggtattacatttacacataagacattactgaggacagtgactgaacaaacttcctccttctaaaaaacaagaaaccaatcattttgtaatttaaactgctaatcatattaacacataatgaactgtaagtttttggttataaatttctatgattttaaattaaaacctttggggaaacaatgctacttaccacagttttgctcatcactcaaatccccacagtcatcatatccatcacacacaaggctgtaattaaggcacttgcctgtgtgacagtgaaacagattctcgctgcagtctgcaaataaaagaagccaccagtgtgtcatcagagccatacagaatgctattgtagtacgatatttaacaaaagccaatcatggaagggacaccctaatggtaacctggtccacacctattgttttataggtgagaaggtggcacacagagatacaacgacctgttcaaggccacttgaacagtggctcccaagccaagtgattttatcactttctgatgtgtttctctgacttctattttatgtcacctgaacgatccttgattgttaaagatgagaaaagacattctcagttcaccatcattcctaatgaagttcttgttcatgcagaatagactttagtaactcttatgttttctttagagttgaagtctaggtttgtcagtagaaagcataaacataacaaataaaataagtcatttagattatggagttattatttcctttcacataaacattactgcttaagtcaattgagtgtttcataatgcaatcctcaaataagcaagtactgtccaaagactatggtggcaagatgagaagtgctatgtaatctcaggatgcttatagtttaatgttgaaataaacaacatccagggcaaatggtttcctgattttaataggaaaataaagtcttgtccttgggtaaaccagaactcctatcctggttctgccatctactagctgtgggacttttagtgtgttattgttagttcaagtctaggagtctgtgaactgatgtatgaaattgggacaaaatcagccacttaatagggtttgaaagaagagtttaatgaaatagtgtgtgtaaggcaattcaatggaaagagaatgttcttttcaacaaacggtattgggacaatactagaataatatttgcaaattatatgtatgataaagaaatttggatatccagagtctctatagaactcttacattcaataatcagacgaaaaagaattcaattataaatggtcaaaagacttgaatagaaagtcttcatgaaagacataaaaacacatgaaaaggtgctcaacgttattagtcattaagcaaaggcagcgggaggtgagagggcaggacaaaacaaaagaaaaaaaaataagctaaggcaaattaaaaccacaagaagatataactacacatcccttaaaatggctacaatggaaaagatggataatagcaagtattggcaaggattttgagaaaatgaatctcatggatctctggtgagactaaaataataatgccaccttggaaaactggcagtttcttatgaaggtaactgcaaccttaccatacaattaatttgtgaattccactcttaggaatctacccaagataaattaaacatatatccacatgaagatttatatatagatgttcacagcagcattattcataagccaaacactggaaaaaaatccaactactcactaactggaatggacaaacaaaacgtaatactcatgcagtgaaatactactcggtgattaaaaggatgaaactaccaatatatgtgacagtatggatgaaccccaaaaagttacgctgtgtgaaagaaatcagatacaaaaattacatattatatgactcgtttatggaattcccagaaaaaacaaatttatagaaacagaaatctgagaagtagttacagtagctgagggattagaattggtgactgactacaaatgtgtgggagataaattttgggggagatgcaaacattctagaactgtattgtgcggttagtcgcataactctataagtttactaaaaatcaatagatgaaatttataggatgtaaattatacctcaataaagctgtaaaaatgtttaaaatcaatatatgtaaagaaatctgcattttacagaaactagatttcttaagtatatttttatttcccttatttaaagtaaattaagtgcaaaacagtttgcttaaggctggagaaggaatacagaaaataggcggaatttcaatagggtggatgtaatgaaaagtttagcatatttcaagcagatgaaatagcaagaacaaaggaaagaggcaaaaaaatagggcacgtttgaagatcagtctacttggctgatgaaggccagaaatcaagcagtcagtggttcaatctcctgaattccagctgattgtttctcctcaagcagaagcctgtatctcatacaagtagcagccaccactttactgtaaacatcccatactagatgacgattcgttatccaaagcctttggcattgatcagttaaaacattaggcttgccaaaatatgacacttacatatacatgaatcataaattactgtttcaaaaaagcactcttctaaaaaaaaaacaacttaaagtttttagaatcacatcattttaggaatggaatgggccttagaaatcacctgttcagtgtcttcattaggaaggtgtgtatgtgcacagacacacacacgcatatatacacgtaagtccatacttataagcatacagaactttgtaagtactttttatttttcacttcccccagcctgaataattttcaaataaggacagccaccataagggaaaatataagaactaagaagtcctagcgatcaccttgacaacggtattttatcccactcagcagagggcgctatttccccaccctgcacccccactgctgaatgaggctacaacacatgtgacagctgagtggaaaggttatgacactggttcttctgcccacagggtagatctggggaattcgtgcatcaagatatatacactaccttgtgaaattctaaaagatctttttgatgtttttttgtcttaatctaaattactcttgtgggaagttttgagtcaacatgctagaatcagcaatagcccgggaaataaggcttctcaacttgacgatcagtgcaaagtatacgcatgcattcgcccagaggatgggggacagtgtttcagcacaatttaaaccctaggagttaatttctttgtaagcactacactcactttttttgacagtaggactactagggaatcaaatacccctttcagaatctgattaacctaagaacacaccaaaaatttccaaaagtttatttgtcttctatgaggcccattctaggacccctggtaattcatactaaaacactgcattggagatattttaaaaattgatgtcctcatttattaaattactttataaatggagaggattcaggcattttttaaaaatcctcattgttctcccaggtgtggattcaactttctactattataacttgcttggttagaagccatttttagaagtgagatacaaaatgagctgcatttggaaaacaatctgttacttccctaaggtctgtgtgattagtaaacacgcaaaaccttaaccagaggcactgcaaagccagaaatacaaatggcaaatgcaaatacagtagcaaatggcaaagatcacagtgtctccttttactgaaataaatgtttatttgacctggaaagagatgttgtcagtgcaatttggggccagcaaatcaaaatttgaaaaagctgcttgctgtgattttcttgctcaataacaagcataattttgcatggcctaaggtagatgtttttctagacacacctttttttttcttaaggagagcttgatacaaaatgtttcttctgaaattcttgcatgttaatattgatttcagtttggcatctcatacgcacactattaattcttgtctctcaaaattattgttaaattagagcagaaaactaacacacagaaaggctttttctcaaaggcttctttcaactgtacagtctctatgactataaacatgaatgtgttgcctcaactcaagatgcaagtacggatgctcagtttccacccacagaagattaaatatggaaaggaccagaggttatttcatccaatcctctgattctgaaatgaccagaggagttagacggtctgtccactgttgctcagctcatttacagcagaaccatgagaagaaccaggcttcttgactctctgagttctttctactattggcttccagctctagaaaagggtttctcaacggcagtatcatttgacattttggactgggtaattctttgttgttgggggctgccctgtgcagggtagtttgtttagcagcatctctggcctctacccactagatgccagtagcacctccctccactctcacagttgtgacaataaaaaaaagtctccatgcattgcaaaatgtcacctagagaattgaaaatcatgttgcacagtatacaaacatcacctgagtgcaaggcctagctttaatcccatcttttccatcagctgtctacgcaatccagcttctagtaatcttactctttttactagaaggactccctgctgctgcctttttttgtttgcttgtttacctcaatttttttgactttgtgatattgcttgtgttatactgttttaaaataccatatttaggctgggcacagtggttcacgccggtaatcctagcactttgggaagctgtggcaggctgatcactttgagctcaggagtttgagaccagcctgggcaacatggcaaaaccttgtttctacaaaaaatacaaaaatcaggcctggcgtggtggctcacgcctgtagttccagttactcaggaggctgagcctggagaattgcttgagctcgggtagtggaggctgcaatgagctgagatcacacctctgcactccagcctgggtgacagagtgagactccatctcaaaaaaaaattttaaaaaacatatttaatagtttctatgtgtatacgttagttccctgatttgattaaaagactcataaagaaagaaaccatggcttaacagtatctttctatttactaggtagctaaaacatgattcatacatagtaggaattaaagaatattcaatactttgattgattcagtataatcagattgccactatacaaaaaagtaaaatttgcaaacatttagtacttcttccataagcatagagtttttttatttttataattttgatgaaactatttctagcatttacttgcagctacatcttagtagaaagattattatagatacagtcatttttgatgattcaaacatcatttggaatatcaatttttattttgtgctttttaggctgcctccattctaaaatagcttcacgtggtgctgcttttaaaattgttgtgcatattttgtgtttctctcttccttacatgtatcagctgacattatcagctgtccccacgacttccagtggtcattctctgcacctagtaacaagaggtgctgggtgggagtggaggaacaataagataacaacagtgacaacaacagtcacgaccgcaaatcctagtgctttttgagacttactgcatgcaagacattggtctatatgctttatattcagtgaatcattattctgaacaatttgagagatattcactatttattgtttccattgtactactgaagaaactgaggcacagagaggttgagtaacttgcctaagttatcagaggcaggaaatggtaagatcgaaacctaagcagcctgactcaagaatttatagtagtcattactacaccgtattacactcggtgtaattagatagccaccatcctcaaaaataagtcaaccaattttacccaaaattcacagaaaatgattttcaaaaatatttgatagtggtttttatgtgtcataaaatgtgtgaactttgtggcagctatttcactgtgaaaacgttttccttgagtttctaatttaaaattaagaagtattcatctactaagcacttgctatgtcctaggcactattctaggagccagttatagactcaaaagattatagaatcttaacaacaaaagagacaccaagcaccttctagcccggtgcttccaagtctggccgtccattagaattacctggagagcgttacaaaagtactgctgcctggtccccactgcagacaaactgaatcaaaatctctgcagatggggcttcctgaggaggccagcatgcagccatccatgatgatactgaaagccagggttacagaagtggcctgcctaaagccacagaggtagacatttctaaaattttcctggtttttgaaaatttttctactgcaccactaaaattgtttcaggtgtttggaaatcttttcatccaacaaatacttaagaagagattgacaagacaaaaccagttaggggagaaagtcagaaagtcacagatacctggagtgctctttaataaacaattacctctgaaagccgtaatacatcaaaatcagttaaaacattttcctgcaatatgaatgatcagagtataatctcactaaatctgaacttttttatggacaaggacaagtcaaaggcagacgagctgaaagaaaaagcattagattttgaaccatttaagactgggttcaaatttagcgaatcatgggcaaatttattcattgccctaagctctgtctctgcacctgtacaaaaggtggtagataacacttcctatgctgataattaaatcaaagcatgtaggtaaatgcttctagcatagtttatgaggtaactcacaaataataagtcccttttctcccttcctttgaacctgactaaaaaggaaattaataactcaatgaactacacaggccacctaatatgacccatgttttataaaagcaggcaagtgcttagctagagatcatttttgcatctaatccatagaagcataatctcctctgacagtcctccttcttgcctacttgcgagaaccttaggaactaggcattttcttctgttcctcactgagaacgcacagcaaaacttccttctcctctcatgagtatctgtgggttgcattcactctgattcacatccaaggcctaattcagacttacactattccttcaccacagggtggtgacaaaaggagtatggcaccctccataaacactcatgctgaaacaccacaagcattcaaccttaaagctcaaaagcagatgtccttgtaaggtcaaaaacaattgcataagaagccttcaatgtctgtgttttcatacagaagttttctgaagggatgtatttccccaacggaccaaaagatcatttttgtgatatgttcatgggaaagggccatatctattttccttaataaatgcttcagctcctcagacattggcaaatgccttgcaaaacagtaacacgttgttgacaaggaaaattagccccttcaaatttaatgttaacaaatgcagcagaaagcacttacagggtttggagtgcaatgctcagtactattgaggaacatatgataaaaaccatagttggcccaccacaggagatacaggcatatgcagaatttgaacaataccataacttgggccacaatgggagaatagctagagattctaccaaattcccataaattggatatcgttacattgaattatttaaagttccctattttggctgctttgcacagcatcttctgctaagcccacagcaacacttcccagtgtaaatacacagcctacaaaaatgtttttatgtaaaattgtgtgccatgcgttgttttgaaaagaaaattccaagtcgtaaaacacaaatttcttactgaaaagaacgtttcctgaaatatgcgtggcataattgaagttccacgggatgctagatagtaggcagaataaaaaatgcatgaataaatgaataaataaaggtgaagattcacatgagaaataattctgatgaaataaaaagttaggcaaatgtctttttttaaaactacagaatttctcagaacctctaatatacaaatgtgtattctaaccctctaagaagtagacctgatagtatttcccaaagtttttttttttcaagcattattccagactcagatactacatgaaacaccagtttgggaaacactgacctgaaatgttaccatgataaactgccattcagtagttctgccattcagcaggacaaaggagcgtcctagcccatcagatgaaagatgagttggtccatttggcaaacagaccagaagaattttttgattaagatcagtattctcaagcacttattacatcttggcaattcccatgaggagtgaaacacagctcttgccatactaactgtggctgtttatataacccttaaagaacaattagaactcagatgaaagatgagttggtccatttggcaaacagaccagaagaattttttgattaagatcagtattctcaagcacttattacatcttggcaattcccataaggagtgaaacacagctcttgccatactaactgtggctgtttatataacccttaaagaacaattagaactcttgcatgtagtgttctaattggagatacttctgttttgaatacagattactcagtgtaattgttttctttttttaacctactaggggtgaacaaataggacactagctttgtttattacaatgtacttcttcaggatggttttccccttctttccagtttgtaagtgcaaaacaacttgaaatctgaatctatattggacaaaccactggccaattcagtcaaaatgactaatcaatcaatggggaataaattgaggacacataaggctgaatctactgattagtggattttaaacagttagtgccattgactatctccaggtttggaagaagcataaaaaaaaaaacaagaggctttgtatttactgtgtcatgaaagttaagaatcattagggtgaaaatgttgctataaaaatgtccttttttaaaaaaaattgacctttatactcataaacaaaaatgaaaattctcacccaatcaaaataaaccaaagccttctcccaatttaaaccactttgtgcaaaaacgctgcaatccctcatctgttccaatgcagcctctacctgttgagctcctaataaaccatgcctttgaaaggtgtgcaaacatgctgctgtcattctgggggaagataaacacgtttgctcgctttagaaaggcaaacaaaaagcagtctacacaaatgctgatgattgtcaggatttgagaatccctgtccactcagacaaaccctaaacagcttgtcacatactgcaatgagcctcgtcactccagtcgtcacagtcgttgtagccattacattgcagtttcccggggatgcagattccactggcacacagaaagttctcaccccttccacagagcactaaaaaaaaagggcaggaaataatgtcagaataagatgggttttttttcttttaagattacaaaaaataaatacatagaaaatcttcttttgctattcaacagatttgtttccaaattccctcagttttattgtcatcaatttttctttggcatcctagcacattaattgaaaaattacctggaaataatacaaagagtgattgcttgtctgaggaaagcaggagatagttcaccagtgggcttgcagagtgaggcatccatgttcagagagcaagagggtagcttcatcatttgcacaatttatgtggggagaatacccaatgggtgtatctttctaaataattgaaaattatgtccaagtaaagtgctactaattgaaccaacatttaaaaagtctacctttctaaaaagctactctatgtaccacagagaaagttccagtaaaaacagagtcagtaaataaccatttactgtgtgtttgaacatagcatagagacccagtgccctgtatttgaaatgtatttacttgccttaatgaaaatgccagttaaaatgtcagcgtctattttggcataaggaacgggaaatggcattcactaataaaattttcatttatttttccttaacacagtgacatttttatatttttgcttttaatattttggtgttctttttctcttcaaaatgcaataagtattccactgcttcaaaattacagtagacaataaatttaagacaaaaagatacaaaatttttcaggaagaccattaataaaaggataaatcagctcaacaaagtggatgttaagataaaaaatatttggtaatgtgcatcaaatgccttttaagtgtgcataatctttgactcaggaatcatcttatttcttagacttcacaaaaaggaaatcattatgaatttatgttttatgtttaatgatattcataccatcattgtttaaaatgaggaaactatgaaataaccactatgcaatattcaggggctagttaaataaattttgataccaccataatgaggaatactgttacagccattgaaaactacattgtagaaaatacttaatgtcctaggacaaagttcaagctactttagatgagaaaacaccaactggtcctagaaaacaaaatacagtttggcatcgggagaggtatattatctttggtattaggattaaagtaagtttactttttactgtattgtattctgcattttacaaattttcttacaatgatgatgttttatctttttagctgggaaaaaaataacttttttatgagctctagtttcagataaaaaaaagttaagtagaaccttcaaaaatctccttctgtctctctctcaccttccaccaaagcttgtgtgtgtgtgtgtttgtgtatgtgtgtgtgtgtgttgactgtgtggtcagttgcctggtcactgccaccattccctgcagtatgtattccttgataagatgaaccttgttgactagttacagggaatccaggaatatggaacattttaactcagcaatagaaatagagaaaagtacaggctgaaagctccagtcaatgaagcccatgtctgttatagttcccatcatgttcctaggacccagcggagtgcctggcactcaggaggttctcgattaatatatttcccacccatgttcctgggacccagccagtggctggcactcaggaggttctcgattcaatggaaaaagttacctaaatccctaatagaacaatatattgccataaagcagaaaaaaaacaaaattaatgaattatttcccaatgctatcaaggaaatcagcatttcaactcattgaacattaagcattagttgatctggtaagtttcttatgatactacttcatgtaacatcttcacaatatcaacaacaaaagcccagttttccattatagtccataatttcagtatcaatacaaattacatctatggatttcaactgccaaaatatccaacatgtttagtatggtgtcagaagattccgcacaggagtgcactcctatacctacaaatacagactcctaaacgattcatagaaaaccagatctaaaaatgaaaaaccaaaatactaagattttacctatccagtctgtacaatatcctctctctgggtttaagagaaagttttaaaggagggtttatcttattgtgagattgtttctgtattatactagagagtgcaaaaattccatatgtctgcatttcagcagctgcaatgcctcacaagaattattgcattccccacctatggctccgatgattcctcaggaaatggaactgaaagctcaagattcaatagctcctaacctccagattttatctttaagaccctacatatttgactccagtaaagccatttcttgcatatggtcatctcaaatctggatcaaatttaaaacccagcacagcttgcattgttttgattattgatatcccctgtcttggctgattcagcagaaactgacttcttttgtgtggttcctcatctggaagtgtggctgtccttggttttagggtatcataaattgttactgtattcttgttcttttttgaaagttcacagttttggtagttaatattacttttataaaactagaataacttttgtaaaatctttctgtttgatttcttcttaacctgtattcagaatttccactttacttgtataaaactgttcaattattaaagtactacaaacatattttatttggtagtttacaaatgaaggaaatgaagtatcatgaggtcaacattgaaatgggccaaagccacataattaaggaaagatgaaaaacaccccaaatcccaaggtctatgatctaggcccaatcctccatgccacacccactcccctgttcctggtacttgtgcaatagtgtagtcggctgatactcggccagtttaagggcactaggtttgagtaaaacttcaacattgtctttttctctctaaacaaaagacaaatgtctgtcttgcagtgaattggatccagatgagatgacattccatgtcagttctactttttttgaacaccctgagagagctcttatcaggtttctgtagagatttttctaccataaatatcactgtcttataacaatcattttccaacaggcttttgagtggccccttaggatgacaaagggagattccatgagaagtcatgctatacaatcttgaaactatttccactaactataattctaagaggtatatgttggaatttaaatcaatggcagattgataactggaacattcgttcattcattgaatatatatttactgagtgtctactatgtgcaaagtactattctagcctctggtaatatagcagagaagaaaacaaaaaaaaatccccaaatagagcatatattctattgatcatcatctgatgaagataattttaccaagtaaagatacttcactgccaaagctgacttccattacacatgggacagttaattaatactactgcaaaaatagcagtatatgaagttatactgcctaaaaagctagtttacatgtccagatgatggggacaattatggatcccctggacttcagaatgacatggatcttgaagagtacatacccaaaggatgatcagctcttttcagcattcttgtctctgacaacagactgctaaaataataatccctagcctgaaatcaccttgagattttctgcaattgcttccagcttcctaggctctctctgtctgtgtatcaatattattggcaaatgctcttattattctggttgttaacttttagagtccttttcaaaaattatccaccagcctgccacggactgtatggtgcccttacttgccctgtctttgagtccttgctgaaagtcaaaagctcagtttcaactccacctcggaagagaaagctgacacagctctgcacatcacatgggcccgtgctgagagcctgtcagcgctccattctccatgctgctcgaaatcaagtactataaaccactattgcccttaccttttacaaggttatgtcattagatgaaaaagactgagtgtaatctttcagcggctgatacaagaatacttcttggggagagcactgtatctgtaggcacaatagattggtaaaaggattggggtaaaagacaagaggtgagaaaggggagagaaaatctaagggtgtgctcaaccaacccaacatggactttaccctgccttctgaggaggtgagtcatattagatggaaggcccttcattctgctgaaattaagatattttcagtaggtatggatgagggtctggaagctctgagtacaaaaggagtgaggggccaggtgcagtgccgcatgcctgtaatcccagcactttggaaggccgaggcgggcagatcgcctgaggtcaggggttcaagaccagcctggccaacatggtgaaaccccatctctactaaaaatacaaaaattagctgggcatagagacatgtacctgtaatctcagctacccaggaggcgaggcaagagaatcaatcgcttgaacctgggaggcggaggttgcagtgagccaagatcatgccactgtgctccagcctaggcaacagagggagactctgtctcaaaaaataaaataaaataaaaatgaaaataaaaaataagaggagtgagaattcccatgaggagaaaggggagctggtgctgctgggcactgtgctgggggagagagaaatttgaaaaggtggctgagtctccattagaagtacagtatttccattttttggaaaatagaaatatctaatgacgtattttaagttatttcatgaggaactggagatataacacacgccttcctccatctgcaaggcttgtgttgccctctgatttatgcactcatttctttaacattctgtattattacagaataactattattctgtatattctataataattaattattatagaataattaatactattctgtattatgtatttttgaatacagaatagctcccttgccttgggaagcttatactctagaatgacaaactatatcaataagcataattttaaaattcttatataacacacaagatgttaataaatgctatgaagaagagagtactgcagggtaagggaggtatagggtataggagtggggtaataacattaatattattaatattggcacccaatattaattagggtgccagggcaggcctcactcaaacctgacatttgagcaacaacttgaaagaggtgagggagtctcaggaagattcaaggaagagctagtgcaaagttcctccggcaagagtctgcccggcaggtgtcaggatcagcaaaaagacctgtgtggctagagtagcatgagcagggaccaagcacaagaatgaggccaagcagaagggagggtccaaacacacaaggctctgcaggcctttgtaaggactttgtaactttaacacaagagtcattacatggttttcggtaaagagtggcatgatctgactgaaattcttaaaggattgctctgcctattgtgttggaaatagactctagggggacaagggaagaagtagggatagcagctgggagtctatttattgagtagctgtggaggtactgagacatgagtggatgctggatgtacaagccatgtaccacgtaacaacatttttcttaacaatggactacatatacaacagtggccccataggattacaataccaaatttttactgtaccttttctatgtgcagatatgtttacatacacaaatgcttattgtattacaactgcctagagtattcagtacagtaacatactgtataggtttgtagcctaaaagccataggctggactgcatagcctggacgtgtagtaggctctacatctaggttcgtgtaagtacactctgatgtttgcacatgatgaaatcacctaccaacacacttcttagaatgtatacccatcgttaggcaatatatgactgacagtactaacttctgactataggttggctcaggtcaaataaacaatgaccatccttgaatatctaggagcttgggaaatttcaaactttcttttgaaaacagagtatcatccacatcaagaatatacttacaatctaaaaatgaattcaatctatgtctttctgtccctctaatcccatcattaaatgtggcttcctcagaagtatctgtgttccaagctaagcaatccttctcactctcttcttagacatctattaaatgcagggcaggcactacactaaccactcctaatagtgccagtgcccaagaccatcaaaattgcagtcttctttaaaaaaactgttttattatagctcacataatttatattcacagaagatttccgtttgctgattgtctctctctcccttctagaatgcaatttccttgaagaaaggcattttatcagtttttcttactgctataccctgagtctagaatagaactgacacattatacgtgcaagttagatatctgttggataaataaatgaagactgagaatatgaggtgtctatggagcatgaataaatgatcgttcctatttattggctctcaatggcaatgaatatcttacaacttattatttacattgctaggagaataaactactgatgcaggaataaaaatccctttgtgttacagtgtgatgctcactcaagcctgcagacacatctggtttatgagtggcatttgctcttagtaggacaacagatggcccttctgcggaaaataatcttccccactggcctgtgatgatgtgtctaacattccacccctgacacccacattacccacactttgggttaaaatggtaggttttagaagaactctaggttagcaaggaaaggggctttggggccacatcatggattaaaggggtgtattcagtttcctactccatttcaaccaaagagctctactgttggctgctttatacacatgagtccatggaaaattttctttgaaaatgggcttttgttgtcaaaaacaagtttgaaaactccttcacccttaagattttctgttcagttgaacacttagttctgaatgtaattatagactgtttagctttatgttatcattagcttttcattgtacttagacttgagaaatgaaacatagaatgagtgacttttaggggtagagggggactcaggaaaggtatagaacatgaagactcagagtaagaagtgacacctggacccacaaatgagctcagaatagccctgcttgaaggtgtacagtgtgtggattcaacgctgttacatcagggtacaagaaaagccacaatattttcttaaagtaaattcatacttccccactcaaaaagctgatgagaaagatctttcaggcatattttgcagggatctctccctccttaggatggtacaaggatgcaaggggcttacatggaacctggaagaacgaaggaaggacttctagctttcattcctcagagaactgccagaggctcatggcctctaagtcctcaagtgagtgctagacagaacgcgccattgtgtctgtgccaagccagggtacagggccatggtccccagggtccagctttcctggctgccccacacagccattccttttggaggtccagcctcttctacaagcacgtgagcactggtctctgctatataatgggaaggccatcctacatccccctgcttcctcctccaccctccagacatttctctccatgccactcaacctgggtgacccaacacaatctctgctcagtccttccctcctcaatgctgctttccctttccggaggctgcagagatgaaaacacacttttttttgttttgtcttcttagtagatggtgctattatactgatgtttccttcactactgagaatgcaaaggtctccattagtaccttttaacttacacatttttggtgaaaagtagcatatgataggtggttggtaaatgcctgctgaataaatgcacttaaggagctcttaacatcaatattctaaaaaaggcaatgtcatggtgacatcttcttttatgggctgtaggcttcaccttgctgcaaagacaaggtaaaatcagccccttgacaacaatacaactctttcattcaacgtcccttggtgtcatttatatatcttttaattagtgagaaactgtctctgtcaaacaaatgttcagagaaaatcccaaacaactcctgaaattaagtcaactcattggttcatttttttcctttgaaataaagctatgctttgattcaatgaaaactttgccatctggccttcagcttaaattcctaaaaataagagctaagtatacttattgcctgcctgatagcatgatggaagagctattactctataaaaaaaaattagtcatcataacattttctaaaacattgtcaagaaacaacagaatagatctgtaactggtggcactttgataggagagagaatgtaaatagaatttagaaagcatttccatgtcatcattcaacatttcaagtacagtcacagtaaaaaatcctacccagtagattttaaatctaatttaaaaagtagaaagttttttttaaaaggcagagtaaaaagcaggaagctaagctttatgatcagagactgccagaaactgaaggccaagcagaaatctaaagaatcttaattacatttcaattttggaaggaaggaaggaagggcgggagggaggggtgagggagaagtcctaaatatgacctggaagcattttttttaaatcgttggaaaacaagatgtacatcatgattctgttatttatcatttcctgaacagaagtgcagtaacataatttcaaatttctaaaaaacatgggcaatttttaaacttttttgcttattatctatctgcctctcaatgagacagacagatgtttctaaattcaaagataatttctcatttaggtttcttgggaggtgctaccttccgaatttgttttaggaaataaacacttagtttctttaaaaaaattgtgtttaataatactttaatatatttttgagactttcctccaattataaggctgtttcaagtgacattttgcatttattcactatgaatcataaaatgatagcaatggaacaacatataaactacttctgacaaattttaaacaaatacaggatggtttctataaaagagttaaatgattgcatataaatctaagaaaaataaaggagataaattttatttggaaagaaaatagtctcttgcatacatatggtagtatctgaaaagctatatatatattagtattttttctagaccttttttaaatgtgtaactcagtcacaacgtttatggaaagacttaggacaaacataaacaaagaaaaatcatcagtttgaagagccatcccatggtatttttcttattcgttgggctatactgtacaaattgaacaaatttcattttacaagttaacaatttgtggacttcattccaactctaaccaaacttatttttaatcacagtttcttttagtccattttatgtattggctatttaaaagctaaaataaattgcctatgactttacaatattatgtatcctgagaaccagaaatagaaaaaaaacatacttctttcaaatttacagtgaaaagaactttgaaaaatatctttcaaaaacagattacggttctaccctaatgtctaaaaattcacttccaatcccatgaagaatgtattgcatcactttcctacctactctctattgttgattaccataacttgactatttcaaagcattagcattctttttttttcttttttttattatactttaagttctgggatacatgtgcagaacgtgcaggtttgttacataggtatacacatgccatggtggtgtgctgcacccatcaacccgtcatctacattaggtatttctcagcattagcatttttaaaaatccactgatcttcaggatattggtactgtaggacctcaactatcttccggattggataaccagcggttggatgccaagattctgaagccctaggtcagcactccgctggagcccctcctatactctccattcccttcactcaccacataaaccccacccaccagctcccatgcagcagccggtagtgacagcacatattcactgggtcaaggtagaattgggaaaacctagctacttctgaacatctgacccttcatgcttaaactaccccagaataatcagataacttccattctgaacactaccataattaagagaaaaaagttaatggtgaggaaatgagttcataaacaccctgatatccacactaatactgaatctacagaccagaaaagaaactattcacaatcatgacctgagataggaaaataaaggtaatcttgtagaaaagcagagattggtatttaaacttacactatctgcgctgctttggcgaattacttaacttttctgagcttcagtttccttacctgaatcccacctactttgggatcgtctctgagtatattaatcagtaatggacataaagtgccgagcaccaaatcaggtaaggcccagtatgttctgtttactaaggctgggaagtgtacaactcacctctgaaagatggccatctcaaactattgaaaaacgccttttgcttaaagggttaacctgcagttaagctgaggtcctaacccccaaacttatggatatagcatatctacttagacttggaaggtaggggcacctgggttctttgaaacaacccagataactggaggagaaagtggtctcaagtgatcaacacacacaggcattaatacaacaacatctaggaacagaattatttaatacgaacttctctttggctcataaacagaaaaggaagtcaattgcttcaggaaagttgattttcactgtttaatcgtttgtgtcctgttaaatgatttacacgctggtggaacacagaggtctctggattctttctcccaggctcctccgcttttctactaccgcatgcctttcacagcacactacataaaatctctctcagtatccctagttaccaggattgcatataacaaagccacacagactaaacctaacaggggaaaaaaaaattaaccttgcgtaaaactaaatacaagcacaatttaattaactcgcattccagagtcatagctcccaatttgctaagtctagaggattggttacacaacatccaagcactcagcagggaggggagaaaaactgctaaaatgtttccagaatcttcacaggactcacatgttcttttatactggtaaacaggaatgatggcccctgtgaacaatctatagccatccaatcaaggagacagaacgagccagggcaataaggggtaagaggttcaaagaggttgaagtttcaggagagactacaggggaagaaatgtacagaaaatatctggccttaagattagccctgagtcaagcagagaatggtctactttatccataaagagggaacgcattgagcagataacgggaagtcaaaaactgtgctcctattcctatgaactctcattgctgcaatttgagcagatacagagtctcctctaaaaacacgctatcgatcaactgaatatgcttaaccccgagaggtttcataacatgaagatatgtcagtggtggagggtgtgggaggaggggctgaactcagaatacaggtgatacttctgagagaaggttcatttttttccacttgacaaaagggtaggacacgtgcagttcccaagccatatcacacgatggcagccatactcagcacgtagtcgctgtgaggcacacacagggaagaattcagcctgatcccctcaactggtgagaggcatggcgacccagtggatttcagctaagagatatcttttctgaagggcatacttggcttgtgattgcgactgagtaaatctgaaataatgaaatcccacttctaccaatgattacttaaggtaagtgaaagcccttcacagtttatgcctactcctactgtttgcacacatttctactgctttttttccccctgactggtttatcagagctccttgtgttgcaattattttctcccagtgtttcctgtatttgtcttttaaatctatagcttcttcagctacatgaaagttttgcaaacgtgaagtctaacatgtcagtctttatggtttacgtcttcataaaccatgcttatatttgtgatagaacaaaaactctgtgagggcagtgaattttacctgtttggtttcttgctgtggctgaaggacccagaagagtgacaagtgtagagcatgaactaaataaactttgcattcacctagagcctttctaaagcagatggaaaatactactgccaaaattaagagatacattctggccacaatacaccaaaaacaggccacaagatagagaaactaggtcagatttcctaatagtcaaaactgatttcgacgtggccatagggggaggagacagattgatcaatcggttgatttttgttaaaataatcaagcttcccaaaagccatagtcaaaatgaaaaatacgtagcctgacctctcaaaatgctttccagattcaaatttcagcaaaagggaaagaaatttattaactgctttgaagccagtacctttcttaacacctaccacaagagggagaccacatcataaattcaagcacacggcccgtaaaatatttgtgaagtgccccccgtgtgtaacagtatttgaaaaccatcctatttcatgtgttttcagtatttattttaaaacaaaatcatagctcttttaaaaatcattttgcattttacatgccaacacaaaaatatgaatcctcataaaccaataactatgttatttgtgcatttattttagaatttgctttttacattcttataataaacaataacttcagaaattcagtttttactcagccagttttgtttcaaatggctttttatacatttttactactaatttgtacataatgtgatttctgtggatgctgaatggatttttcagcaggtgatctcattacaagataatctcattacaaatccctgttagaatttctcaccgtggtatccagattgaaatgaaattcttcacagctgtagaaaagttcttccgaaatttgttggtatcataagctctaaactgctctactctatggactttcaagaaaactaccaacttttgcctttccgtctggcggcagccatcaggtaagccaagatgggtgcatacaagtatatccaggagctatggagaaagaagcagtctgatgtcacgcgctttcttctgagggtccgctgctggcagtaccgccagctctctgctcttcacagggctccccgccccacccggcctgataaagcgcgccaactgggctacaaggccaagcaaggttacgttatacataggatttgtgttagccgtggtggccgaaaacgcccagttcctaagggtgcaacttacggcaagcctgtccatcatggtgttaaccagctaaaattttgctcgaagccttcagtccgttgcggaggagcgagctggacgccactgtggggctctgggagtcctgaattcttactgggttggtgaagattccacatacaaattttttgaggttatcctcattgatccattccataaagctatcagaagaaatcctgacaccccatggatcaccaaaccagtccacaagcacagggagatgcgtgggctgacatctgcaggccgaaagagccgtggccttggaaagggccataagttccaccacactatttgtggttctcgccgggcagcttggagaaggcgcaatactctccagctccaccgttaccgctaatacaagtaaagtttgtaaaattcatacctaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttatctttgctttatcttattagggagttgtatgttagtgtataaaacatactgcgtggtataataggcttaataaattcttaaaagaagagaaaaaaaagaaaactaccaacttttctcagcaactatcctatgaaaattttgtgacagtcatttcaagactgcttaaaagtagacagaacaggaggccaaaaacttcataaaatgtggtataattcgaaggaatcctgggaggtctctctgcttaaaatatttcccagctgaaattcctcactgtgaatcccactcgtttaacttaagccaaaagtcctcaattaaaagccaattcctaaggactcctctatcttgcaactaaccaagatttccagaggctctccacaaaaggcacagtcctggacatggcaaaactacaggaccttaagagatgaagccattatcagtgattaatacctcagcagatagcacttaatatattcatcttctttatttctactttttaaaagacattagagaatttagatgagaaaataggaaagggtggcatctaaagaatggggccctggtgagaatatacctgggtatgtactgaccctacaggaccaggggtcagtgtggggttagcaggggctaaagaagaggggagtagtaaattacaagggagtaagagtggagggaagtcctttgccatgctaagagccaggcatccatgatccttttaaagctaatacttatctggtgctttctcttcacagtatatgtcttaaagactttaccttcatttttccatagaacacattcaagaggtgataacctcgttgactagaggatgaaactaaagctccagttactttccccataaaatagctaataggtggtggagctacatatcagaatctaagcagtttgactccagagttcatgctgttaatatcaatgctcaagagggccgtattagtttcctattgctgccataaaaatttgccacaaattgggtggctgaaaacgacagaaatttattctcccacaatgctggaagtcaaaagtccaacaggggtctcactgggataaaatcaaggtgttggcaaagctgtcttctagaggcatccctcatttcttggcacatggatcccctttgtcttcaaagccagtaacatggcagttgtttgatcttagggctgtcatcacatctccttctctgactctcctcttctgcctacctttttaaagatgcttgtgactgcattgagcctaatgagataattcagaattcccctatttgaaggtcagatgaggagcacccttatttccatcttcaacttcaatttccattgccacataacctaattacaggtcccaggatttaggacatggacatctttgggggggtcattattctccctaccacaggtgccttaatatcttattcattttttatgtgcctctgggttccataccaacaaccacctgcaaatggctgactcaagcaagtgtgccttctctcccacctgctgactgccctcttcttccctcctattgcctttgtcagaaatgctgcagcctggaatctttctctagtcgaaatctttggctctggtcttatttcgctcatttctcctacagcgaggagccaaggtggcagccatcttggccatgcaagatcagtgggaggagaactgctgttagatcctactcctgtaatgagaatgttcaaaagactggggaataatactctaaaatgtaaataaatctgacatcaggccttggttcaaccaagtgttccctgtgcttttgtagctatcagctacaagtgcttgtgactttcccaggaagcaaaagctgagcaagaaacagaagagggcaatggcctgacgaggagcttagccttgacttccctccctttccatttgtcgttaacaacccaaatctctttgaaacctcaaaagagcaatatatttcaggacaaaaaataaggtaggagatgtcatattgttctgcagcagacatagaaaagacagcaaagaggcagttgcagaaagctgaacagatagataaatccttcagccagggctggctacataatttgcagtactttatttatttatttatttatttatttatttatttatttagacacaaggtctccctctgtcgcccatgcttgagtgcagtggcacaatcttggctcactgcagcctcgatctcccaggctcaagcaatcttcctacctcagtccccaagtagctgggacgacaggcacccaccaccacacctggctaatttttgtattttttgtaaaaacgggttttgccatgttgcccaggctagtctcaaactcctgagctcaagcgactcacccatctcggcctctcaaagtactagaattacaggcatgaaccactgcacctggccagaagtgctttaaagatactaaaatataaatatgtttttcctttaaaaataataaataaaataaataccaatacattattaatgtgacatcacaattgattataaggtttttttcttactcaatgttttgaaaatttattttttaggccatcaaaattgtactgtagcaaaattattttcattctgaatagctgtaaatggcattagtagctctacacacagacaaggttgcaagcaatttttgttaacttttaagtttgacaaggatttttcttcttatgcaactgttactggagctgttaagaatattttagaagctatgacaacatttgggataaatttcaataaattatttcaaaatacaaattttagtatgtctagagttgatgagtctcatggaacaattttaatacaaagacttaactcttcatatgagtcagttttgtgtaagtctgaattttaagtgtaaatttattcaatgacattttgatgtttcttctgacatttgctgaaaattgtggagatcgtacaagaaattgaaagtagcctcatgatttgtatataattttaagtgcctgtttatacattctataactctattttcaacttcaagggaaattttcattttattttatcttcctcattaataattggtccatctgaagttcacgtgaaaataacgttcttttccactgagaatgtgaaatgtaacttgtttctaagcttgtggatattcattttgcaatgtttcagcatttaaatccaaagattctaaaatctttaaagagctctaataattccttgataaatgctttattgcaatgttcatgtgtatgactttattttgtaataatctactaataacgtctacttcctgatgttgccaagcagtttctgtcccaaggttcaggctaaagcgttaatatttgtgtagatgccacagagacggactttggggacaaacagccaggctggcctcacaggggtaccagtgctgcccccctatagagctcctccttccccgcttgtccttggccgctgctaccatacctgctgcttctgctgttgccaatctgtgcccaggcactggcccggccaccttgttgccctgtaattaccagctgaagactccatttcccagtcctgtttgtaactaggtgtggcacaagcatgggctttgggtagccaggctaattatcccacatgcatgctgcctatgtgcccctgatgcacacgctataccatctagtctatccccactgctcacacgcatgatctattacccatcaaacttacctgcaaaatgcaagtttaaggataaagttattaagaattttaaggcagtgacaacagagcattaaaccaaatgctgatcccttctgagagtagggtcctgtgcccctgcagaagtcacccacccatgaaggcagccctgccctcagactttgaagaacaaagaatgtcaaggagggtagtgggatgaaagcttgagagaagtcccctaagaagtcccactggcaggggtctcagcatcccagtacccctcaaacctgaccccttgatcactgtacccatcttccacccacatctctcctgccacacccaccaaagtccatcctgcaggagccactctatagacaagggagccatgactataatgtggcagggactgccggttgtcatcagaatgcactccccgcgtttttcacagtaatggagtttaagatgcctccatgtacccagccaaagactacatttcccagttccctttgtgataggtgcagccatgttactaaggtctctccaacagaatgggagcaagtcattcttctacttcacctccttcaaagagacgtgctgccatgtacttcctctctgtaccattccacaagctggaacacagatacagggctcagccagctgcaaccacacaggtgaagaccatagtctagggattggtgaagcaagaaatagatggagcccaagtctttggataatttcatggggtaagcctgacttggcaaactgaaaagctcaccttggatctcttgcttaacagagaaaaaaaagttttatttaagccactctattttgggatctctattgttatggcagcttagtatttgcataatttgaatctggagagggttcattcccattgttgatctattcattgagcaggtctgaaaataaggtcaagcccctggtatgagagtaaggtccctgggaagaaggtgggtgggttcttcacatcacaatgagaactctgaaagcactttcccacaaaggcattcatttactcacgttagctataaacgtgacagacttcagcaatccagtccagcctagggctgtacctacaacattgctactacgagaaagcagctttcatatctgaaataaccaatttgtaaatataactttgaaatgcagccaatttattagctgaaatcttcctggaattctgtacctacatcatagaactgtagtgaagattaattgagataatatatgttaacaattaagcatagcatctgataccaaatgagctttcaatcaatttgatctttttattattactgacattattaaaccggcatcataatatagtcataattaacataatatagtcataatatgacacattatcatgatatatatgataatataatgtcatatatattgacatcatttaattatttttattttgagacaggatcatgctctgtagcccagcctggagttaagtgggacactctccactcactgcaaactctgcctcccaggctcaagtgatcctcctgcctcagtttcccaagtagttaggactacaggtgtgcatcaccatgcctggttaatttttgtattttttgtagagacagggtttccccatgttgcccaggctggtcttgaactcctgggctcaaacagtccactctccttggcctcccaaagtgctatgatttcaggagtgagccactgcacccggctgacatcatttattttaaggaagtatatggcaacaggcttggggaaacaatccttcctcccctggctgccacacagagagggataagagataaattacttaaatgtttacaaatctcttagtttccacaagaagttttagcaagtcttttcaaaacaaactgcataaaatattacctcaaaaatacatgaggtgttaaaatattactcaaactagtcaattagaagtaatgggttaagaaatcaccaaggaaagaaatgtgcatcagaaagaagaaaccaagaattcagtacatgagagaaacataaaaggaagagctgccaaaagtggagagtgggcatgattcattctggagatcactgtaaggtttccccgaaagacaatagaagaaataagttttgcttttacaggattaactttatagtagataatacgcatagatcagggtaaggcagtttttaaaaactgagaggaaaaatgggcttctactctgaaaaaaattagaagaatagaaagaaaacaataaaactttcttcaaagctatagggaataaaaagagataatggaaaaatcttaagacttaattaggtgtggagaaaaatctgccaagagatgaagccaagaagtcagattgttaattgcttatttatttctagagcattgtcatcagaacgtgaataatgaataagacagtaacaaacaacagaaaagtaagaagtagttgaacatctggggaaagatttcttaaataacctagacttggcagtatttcatccactcagcatttttaaggaagaaaatatcccatgcagggaaacattcaaacaactgaagcttatctacttaagagttgtaaattctttcatgattttattaaaattctgttaaagggaaacctgttctctactttctgaaatgtagtgtgttaattttaaccactttcttaatgctccagggtacttttggtgaacagcaaaaacttctcagccctgcgtggaggctcctggggtgaatttgtccccgtgctaacctgcctaagactttcttgctatttagagtgtgtcgctcttctccacgatgtaatcacagcagtcccgatctctaccagtgcccatatccctgcaccagtaactgtacccctccacatttccaatctatttcccagtaattacagagatctaggaaacccaaaaaagcaaatttttaatgtttttttttaaataaaagtgaacaagctccaaaagagggcctcagggaatctttttttttaatggcataaatgaacatctatttagatcataaccacttttgtttttttgctttttaataattacttatattctgagtaatttgggtagcaatctctggagaagtgaggtgtggccatatattcaaatgactgaattaaaatagaggtacctcatgaaaggagacagttgctatagtggaaagggcacggggttttaccaatggaactgggttcaagcaccagctctgcctcttaccagctgtctctgagtctcaacaccttactctttaaaaagtgaacatacacacccacaatgcagagttattttaaagattaaaagaaatacagtattgtgcctgcctttatacttggcacatatagagcttacgtagacaaactttagtattatttttatatctttgaatatgtatggacatttctatgtatgtctaatatactcacaagtgattaacacaaaccgaaaatttaatctgtaagaaaaaaaatctactttagattattttaggtaaaataagattcattagatttctggaattttacagctagaagagactggcaatcaatcacacagtcctgcttccaatcccagaaatgaggaaaccaatgctggagagtaaacatgacttggccaatgtcataaagctaattagaaactagaggtagaactggaactacgattttctaatgtccaattcagagttaacctagaacagagactgacaaacattttctgtaaagggccagatagtaaattgttagactttgtgatgcatacagtttctgttacaactgttcaactacaccaatgtggagcaaaagcagccataggcaatatgtaagagaatgagtgtggttgtgtttcaatattttattcagaaaaacaggctgcaggctgtctttggctcacaggctatagtttgctgacccctgatccagaagaagttaacagattttttagctagaggaaacatgatggacataattccaaatcaacacatctttctgctttctatcgccagtgcactagaaaagctgtgtgacaatgaaagaactcagaagaatgagacttaaatgttgctattatgactaacatcttaaaatagtgtttaataaacacaaatcttgacctcaagattattttattacttagtagcaattaggataatctaaaaaagaagctctaagaaagcaggaggagactcaaagaattggaattcaaaattatcttggctaaataataacagtgaagagaactaaaatagtagtacacatacaatgaagcaaaaactaaaacagaaaatactatggaaaagataaaagtgttctaacctaaagaaataagtaaatactgccatcaaaatttactgattacaactgaaaacatgtcttatctatccaagtagtacttttacattagaacctatctctccaagagatcatccttaaagtcagaatcaaagagcatgatgttggggccaggcccagtggctcacatctgtaatcctagcattttgggaggcagaggcaggcggattgcctaagctcaggagtttaagacccaccctgggcaacatggcgaaacctcgtctctactaaaatacaaaaaattagccgtgtggtggcagatgcctgtagtcccagctactcgggaggctgaggcctgagaattgcttgaatccaggagacggaggtgagctgagatcgtgccacagcactccatcctgggtgaaagagcaagactctgtctccaaaaaaaaagggggggagcatgatattggaaccaggaataatctaccagaaataagaacacctccaaaaatgtgtctttctggtttgtgtcaggacctcctgataacattggtcccatgatcataatcgtcataatattcttcagacacataaagaaagatctcatggaggaaggtgaccaaatgctttttcctttccactgaggatgaatgtgaagaaatacctatgctgcaatatgaggcagagataaatttcttgttcctaagaagtatgacatattggaacgggttggcaaaggaatagtgttcaagcttcctctagagaggctttgagagagtctaaactttgcatctgtttggcgtgaggtttcctccctaagagaaagggaagtagaagaattttcaacctctgaattttaagggagctgttcaaattgtaatttgacatactcaattgaactaaatgtagtactctattttccctaacacttgtgttgctccctagtagtaaattggttgtttacttttgaacatctaccttggaggcactaaagagtaacaggatgatctatgattggaattgggttcattacattgtaccaacttgctcccaacatctgttctgtttacacaatgacacattcagagtattcagtgcttagtgcaaacaactatgatcttccaatatttgatttctccttgggctttcacacacctcagctttggtttcactgaatgatttttggaagaaaaaagggcataaaataaagctataccaatgaatgagagattgagtgataactatgaaagttttgtgtatacaacttctgcaactcaaagggctctctgatggtgttagcaaaaaaccgtgtaaacacccttgccctctgtcaggacacaataaaagctgtttctttaatatcacagtatcattgtctgtttttaacttttctatttacatagtaaaggaaatttttcacttaatatttaaaggattatataacgatccaatacaatattaaagcacacagaataatgttgttcaaatatataatatatatagatgactttttctacttgtatatgttcacttagaatgcttttaaaatttatagctaaatccagctacaagaaaattttcatttcttcaatatagatcataggcattttatttctgtgcatcaacttttaaaaagacagcttcaactatcacataataatgttgacactttataaatattagtaaaaagtcaataaaaatgaagccactttcatactgttaaaaataacatgttaactaaaaaaaatactgttggaagacatgtatataccacattcattacaatggaaagtagagaaatacctgttagttgtaactaatgttacaaacaaaatttctatagaaagaatactatgaaaattagaactaaagcatatttttaaaagttcaattggcaggatccaaaaaaatacctacccttgaacaagagaaattatatttaatttctttaaaggaaaagtcactttttatgttaaaactcaaaaatctcagaaccacagttttttctcttttattttccaatgtaacatcctccaggctttttcaagcaaccacatggatctaatagacaactcacgtatacgaaccagtacacactcaattttaccaattggtaaaaattgttttctctcacccacagctttgaccaggtcacccctgcccccactgtggcttctctattgttcttatcaaatgcagactcccgggatctcagcttcaaagacctcctctagttttctcagctttcatttcctctgtaaccagtctgtattcttccagccaagaaatccttcattcagccctttgattcaccgtccccaatccttcatccatcctttttcttacacttccaacactggctcagaccacattcaacagtgacttcgcccctgaaatgggattcaacctcaacttattaggttaaatatccaactgcttttgtttgcttctttatatttttaaatctaatgctatttgctctgtacaaaagagattattagataggaccaggccccctgcatcaaatttctcaagtattttagtctttcatgttcaatctgttagacctctaaagggcatagcacagaatgaaagaaaagtatctgtattacatttaaagaccgaaaaaaagagaggcactgtagtatattttatgattgcaggttgtaggaatgtccattgatattgctttagggaccatgacagaagcagaagatagtgggaatgttaagcactagatacaagatgaacaaagacacacacaaccccatatcacaccaccgaagtgataaactggcaacgagaggtgagaaggaggaacagagatggatacaggagggaggggaaactgggaagcaaatgggcacagtattcccagtaggaatacaagtcaccagagttcttcctgccaggcagaacacaagccatctgactatgtgccaagtgctgaaatggacacacaacattagcaacacaaagcactatctcattagacttcgtttccaaaagtctattttctttcctccaataaacattaggattagcctacttattctgttgctcccaacactaattccaatgaaactcccagttaccatgtgaaaggttggattaattcaatgaccctattttcttcattgctaagagcacctttatacattctctcattcaaaaatacattgagtatcaaggttatcttgtcagagaatatcctgaaatgatgagccctagtttcttcatctgtaaaataaggataataattatgtaactattaggtagtaaggaaaattaaatgagacagggtatgtaaaccacttagcagtcattggcatccagcatgcgtgcaataaaagttagctatgattattgtcattgttattactataagaaccttgattttagcagatgacagttgtcattgtaacctaacgtgagctttaaactagaaaatttaatttttagactaaacaatatttatatgccttttctatcttcctatcaaatacaatgaatcccactgtttttcagttttcctgaattcatgcaactcccttccaattctgaattcaacaggttgctggcctgtttcctagtcaacactacagaggaaaaacatgagcgaggaaggaaaagtactaaagcagaagatgtctattccttagtccgtgttgtagttaaaagatgagtctgttgagtcattacccacaactcctatgggtcccaagggaggacagttgtcatcagaactgcttttgcaacctgcccttttaaatgctctgagatatttgtcctctttcttcttgactttttgctttgcacttcacatgccccctccatgagctcattcactcctttgattttagcccaacacatacatgaataactcccaagctcttgtctctgcagctcaagcctctctcctgaatttcagggacctgcaaccaactgatatgccaggaaatttacatctccaaattattctttatcataaacttttctattccttgtggtctctactttggcaagtagtatgacaaacatgtttcaccttttcccaaccaaccacctggtggtcatccttccttctaccttttgctcttcccagtgaaccaccaaattctccatatgtgagtccttgagaacagggattttgccttatttgttcctcaaccccagtgactaaaacaatccccagcacatagcaggctctccgtacatatttgttatataaatgaatagtgcatagttaccgctccataaccatctgctatatgaaggactggatgctttaagctgcattctcacaaaacaggaacaacatacaaattattctcctttacttaaatgtttctaataatttcttcttataaataagaatattaaaccatataatgcagttttgttttctatcagaacaacaagacatcatgtgttttgttacaatgttcaaatgttagtcctctggctgttgagtttcatagctaaacaagaagtttttcagtcttcagactttgtaaaaatctgtaaaaaccctctattcaagttatactcagcaaggggtcttctgaaatgtgcgtggagaaaattggaaacagcttagcaactgaaaagaataatatttcataatatcctatggagtaaaaagtcagatcccgtggggccactcactgggcatgttaggcaatttcagaaaacattttcagaaaattttttcaaatattctatatgctatttggtggacagaagtaacctgtcatatgttgcccacgacttttgagtggttagcctcacttttcatttaaaacgtttttatttgaatcggttgtagtagtataggggtctaaaggacatatgtgcattcttgctagaaagtatgtggcctgccttttactttgtgtctatagtcaaatcaacttgcattgctttgcttcataaaaatagcataaaatgtgctacaaataaataaaaggaaagtacattcatgcctgcatctgtgtttgacttgcaaaacaaaagacttcatgaaataaaaatattttgaggctcttttatttttatcactacttattctgtactgggcagatctgaacactacatgttttcttcaattagaagtcatccaacaggtggacttattttcagtgcaaagtcttagccaagattaagccatatatttcatacatcttgttcaagatgactgagaccaaacctctaaatttctttttctccaggtcaatattcgcagttctaaactaaataaccacttttttttggtactgtgttgagatttattcaaactgccaaccatgaaaagaaaaataggaacattcccaggaaaaagagtggggtacatgcagataactattggttatccatcacaaattataaggttagtgaatagtatttgcttttatatgcaatcatgtgctatttttatatacatctacatagagctatccctacacatctacttcttgtatgagatgaactcatcccttctttcgtgggctgaatgctataggtctacctttaatttatgctattaagtgcctgcaagagatgatttttaaataagtagttttgcatacagaaccaccatttgattccaactttgaatgctattaagctaaatgtacacagaaatcctttttactccttttaagatgtgtacactatgtttatgacagtgaagtcctaggtctttgaaacactaacaggcccagattcaaaggggttcagatcacagctcagtcaagttccacctctatgatcttgagcaaatcacttaatctccctatcagttctgtcatctataaaatgggaagtgcctcagtccattcaggctgctaaaacagactaccacagatggggtggcttaaacaagaaacatttatttttcatagttctggaaggtggaagtccaggatcagggtgcacagtggcattcttagtgagggccctcttcccggtttagtcctcacgtggcctctcttgatgcatgtacagacagagagagagagagagagagcacacaagagcgctctatctcttactcttcttctaggagcacttctaatcccatcatgggggctccacccccataacctcattttttctttttttttttttgagacggagtcttgctctgtcacccaggctagagtgcaatggtgcgatctcagctcactgcaacctccacctcctgggttcaagtgattctcctgcctcagacacccaagtagctgtgattacaggtgtgtgtcaccacaccagttaatttttgtatttttagaagagatggggttttgccatgttggccaggctggtctcgaactcctgacctcaggtgatctgcccgccttggcctcccaaaatgctgggattacaggcgtgagccactgcacccagcccataacctcatctaaacctaattatctcccaaagtctccaccttctaataccatcctcttggggttacggtttcagcatgtaaatttgtgggtgggggatgcaaacacgcagttcatcacaggaagaataaccataatcctcacagtgctgctgggaggagtaaataagaacatgtatctaaagggcttagcacagcacttagtacataataaatgctcagcaagatacatactattatgataacactgttattattaaacactattaggaaaacaccattatttgaattgcaaagtctggccatcgtttcttcattttgtttgttttattctgttactaccttaaccatattcaccagagtgcagcatggcttaaaattaattgattttttattctacaaatctttaatccaaacactatttccacagaccccaccagcttctaacatttagctattccgtcttcacaatttcagcatttttctgagcttagtattcatcacacatactgatgcaatcacttgcatatgagtacatgtattcccatcactcacgttccattttcatccaatgtttgcctgttttcacacataagttatcactggagaagtggaaccaggataatagccaggtctgcttaatcctacaacagccatcttctaactgtggaaggtgtttccttagagatatacaagggctttccaagggtatattacaggcagagatagttttaaaggaatcaatttccacacccttaaatttcctcttttctatcattgcctatctgagggcacatgcaggataacgtcctttcttaccgcccttttcgcaatgttcctttttttcatctgacaaaagaaaggcactttttaaacatttcaaacctgctatggcacatgctcctgggtataaaacatctggagttccaaacacatagacaatttaaaatatcttccatcttgctatcctgcctcctcattctccaaatgttgtcagagaagatattgttcctgaaggaaaatatttgaaggacaaagttaaaagagcacaaataaaccccgaaagcagaggaccagaggctcatttcaggcaacaaacttattttattttgtctgtccatctgtctaccgaaatacgtatcttaaaatttgaagtgaaacgtgggattctaagattctaggtccagttaaaatggagtaaaaatgtcccaccttacctccccctgtgattgtaactaaatgttgtggacagaatacacaaagcaattgtctgtggtatccaaacagtaaagaccagtaagcggactaggaagggaaataaaaacttaaagaaagagtaataaggaggtgagctttctggtgtttttctttttctactcatatttcccaacatagaatgaatgcaacaaaatcatggaactgtgcagcagtcttgaccaagagaaactctctccttggtcagacgaataagcaggaggggccctgcaaaaccaaaggacggggagtcccctgagacatctcttctcctgaccgtcccttggagggggccctagaagctgtgctcatggaagctgtactcatgcaacagtggcagcagcagccaaggttgcctatttgccccagagttggctgcaacagtgcaaaaggctaaaactagagcttttttgacagaggaccagggcaaatggtccctggaagtcagagagtttcagggagatcacagagaagagggagcttgagatgaaagatcccacagagctatgtataaagtcctgcctgggtttatccctcaggtctccatgcatgaaaatgatttgaaatagaataccaaaagctttgagaagtaagcaacaatgtaatccatggcccagatatcagactgatccctgggaaatacactcatggggaggatccagagagcactacaaaggctttgaaaactgaactgacattggaaacaaagcccttagaaggcataatgtgacttgtgaccggaacttaactgggtcaactgactatgaaaagaaacaaacacacaaacaaaattagcattttccagagaattctaacaggacccagaatatcataatattttcaaaatgcccaggatataagttaaaattaattaacatacaaagaagcagggcaaggccaggcacggtggctcatgcctgtaatcccagcactttgggaggccgaggtcaggatcacaaggtcaggaaatcgagaccatcctggctaacacggtgaaaccctgtctctactaaaaatacaaaaaattagccaggcatggtggtgggcgcctgtagtcccacctactagggaggctgaggcaggagaacggcgtgaacctggaagagggagcttgcaatgagctgagatcgcgccacagcactccagcctggacgacagagtgagactccatctcaaaaaaaaaaaaaaaaaaaagaagcagggcattctcagcaacccctaagtgaaaagataattaataggcaccacccctgaagtgacctagatgttgaaattattgaacaaagacttactttaaagcagctgtaataaccatactccatgaagtaagggtcaacaaatttgaagtgaatgaaggatagaagttatcagtaaagaaatagcagctatggaagctcagaactgaaaaataaaataactaaaatatttttaaaagacactgaaattgcagagtgaagatgacaagacagagtaagtgaacttatagctaaattaatagatattatctaatatgaacaaaagagaaaagttttcaaaaaacgaacataacttcaggtacctgctgtatattatcaaaaggtccaatattgatgtcattaaaaatataggaaggaaaggaaggagaatgagatttgtacagaagaaaagtttgaaaatttaatggctgaagttttctaaatcaaaagaaagatataaatttagactcaagaacctaaatctttggaatttttttggaactcaagaatctcaacagaacccagataagataaactaagaaaataaaatcaaaataatcaaatgactggaatttattcaggaatgcaaggctaatgtaacagtcaaaaagtaataaatgtaatctctacattaataagctaaagaaaaactacgtgatcatgccaactcatacagaaaaagcatttgataaaattcaacatctttcataataaaaactcctagaaaatgagatttagtttatgggattacctgattaggtctactgaggatattctacctttcttaaagtcagctgtgccaaataacataatctaattataggagtgactgcaacatcatattcagttcatccccacattcagaggtgaggggattatacagggtgagtgaaccacagaactggaaccctaggaaccatcttagaacaatgtttaccataactagcaatgaacaatgggaactcaatgttttaaaattagtaccttttacaatagctctcaaagtatctaacaaaatacgtgcaagacctatatgagcaaattataaatgccaatagaagaatcaagaaagacctaaataaatgataaaccaagttcatggtttgaaagacttaatatgtttaagatgccaagtctccccaaattgatccacagctttaatacaaatccaatcaagatttttggaacacttttttttttgtagacatagacaagctaattctaacacttacatagaaaggcaaagaactacaactgaaaaataaatgttgagacataacacagtggaaaaactcatactattctttgttaagtcttaatatcaagccatactaatcaaaacaatgtggtttggttaaggaatgagcacataaattaatgaaacagaatgaacagtccagaaatagacccacgagaataaggtcaattaatttttgatggaggtgcaaaagcaatttaataggagaaatataggccttttaacaaatgtgtctggaacaaatggacatccatttggaaaaggaaaaaaataccacttgacctataccttataccttaggcaaaaagtaactcaatgcaggtcatataaaatgaaaactgaaaaagtcttgggagaaattatgaaggaaaatctttatgcagttgagataagtaaatagttcttatatgatacaaaagtatgttgcattaaaaaattggtaaataaaatcatttgttctgtgaaagacactgtgaagagaatgaaaagacaaggtacagagagtgggaaaatattcccaaatcatatattgaacaaaagacttgtacccagaatatataaagaactctcaaaacccaacagtaagaaatcaaacaacatcaaacaaccccccactcctgccataaaatgagcaaaagatacgaacagacacttcataaaggtgatattccgatggcaagtaagcatattaaaagatattcatcattaggcaaatttaaccacagtgagatgcttctacacacctattagagtggtcaaaacagaaacaacaaaagtcaatctgacaataccaagtactggtgaagatgtgaagcaactggaagttgcatacattgttattgatgggtatgcaaaatgatacagccactctggaaaaactgttgacagataccaatctaggtattcatcttagagaaatttgcctataaaaactgtaagtgaatgtttatagcagtaattttcacaattaccaaaaaactggaaacaatcaaattcctttcaatgagcaaataaacaaattgaggtacagccatacaatggaatactagtaagcattaaaaataaccactgatacatgtaacaacatggatgaatattaaaggcattatcgtaagtgaaagaaacaggtttcaaaagggaatatactgtatgattccatgtgtgacattctagaaaagccaaaccagagatgtggagaacagatcagcagtttccagaggtttggagtgtggttttggccataaaggacaagacgaagatgatatatgtaggatgatagaactgttcagtaatctaattttgtggtggttacaaatatctatgcatgtgttaaaactcagaactatatatacacacacatacagtgaatttcattgtatggaaatttaaacataaaaactaaagtcagcctatttctttcagaaagtaactctgatttgatgaataagttttgacattgaagactggcattactagttagataaattttacataaactggatgaacaaaactgacagctccaagttttgataaatatatatttaaagcatgtaataatataaaaagcattttattaaaatattgtattagaaaaaattaattgaaattaaccaatatttccattttttataaatttttctgaatatatagagctaaacaaagtgcctcaaagtgaaagagtaataaacagatatttgataaatcctggcaatattctcagaagtagagaccatgcatggctttactgactgggtaacaaattcatttgcaagtaaggtgctttccaagtctgtgctttcaaaaatggaaggagaatctaatcaagttgtcatctaatcattaaaaataattttaatgataaatcattactatttgctttttgacagtacagtgggaagcttctcaaataattgaatgccattattcaataaaactctttctatgcccatgtgtttaatcatatgagtaagttttcaaagcactaccatctagaagaaaaaagtaggaacacaattgatgccaaactctgatatagtctacacaaaccagtgttcaaagaaaataaactgcatctaatacatcaagatatggaattctaatatgtgtcacatttaaggttagtaattatttataaacatttataatagattgaaagtacaactttttgataaattaatcagaaaataaactgttgacagagtcttatgactgaaggaaagttttttaaagtaataatttccattttatgcacagttttgttctagagatgcatggtagggggataaaaataatctaagcattaaaaagatattacactgtaatgaaattctgtaggtgaaaggaaatagaaatgacttcagagagaaaaaggagcaaagtaaaatttgctgaatgttacaagaggagcttataattttttaatgtttggtgaatgtcaaggcactatgggatttaggtttcactagacacatttaaaatagttatatgtcaattattataatagtctttaaattctattatctgacactatttacattcacagttaaaattttgtagatattaatttaaaattgtacaagggctgtgtactttgtcaaaatcctttgagggtacacagcaaaaatatttggaagaccacatatctaaaacactatgttgcactgcctcctcgataagagcttaactttttgtttaaatgtgtgcagggtttcagacacaaaataaacatatggatagagcaggtgagaatggagacttcaaattgcttcccaattgctgagctcaatggaattgcagttatgaagctcacaatgctatttagcagaatgaagtcacaatttcaaaagagattcatagattttcatgtgatgattctgaatcatgcattattttcagtgggtggcccagagtttagagttcaaactctaggatgtctgaattactagataactgccacattactgttgagaatatcaaaaagaactgattaagcttaaagaataatgttcacctaaaagacatagatagtatcctttcccaggaattttgggaaacaaatacgaaacttagaactaagctaatatttctgctatgtgaaagaaaaaaaaccagcattttgtttttcatttacctggttctgtaaagatctatcagctatgattaaattgaccatgatggggcgtacaaagctgaatacagaactaaaatagatgatgttttgaatagcaaatgagcagcattcttgttagagtaatcagaactgattattgaccaaaatagactcagggatgtgcacttatgatcatacatattaaataatatcagacttttgacttgttgctaaaaatttccatattctactgtaatctgtaagaccacaaatgtggatttctgattgtgattctgaaatgtgattctgatttctgattcagaggcataatattgacaaaatgaagatggtcttggtctccagccactgaacaaaataatattctgtaagaagcccaaggatcaacctatgatcttgagcttctgagctatcaacctgtaagccaagcagctagcttggcaagagagtgagaagaatgaatgcagatgaggaaagaaaacctctatatttctgttttaggaaccactgtgccacttcaagcaaagcaatatttggcagagaatagaaacttaatctcaaatgatctataaacaagaattacggagcccgcagagaacaggtagtatttaggctcaacaagaaaacgattttatctggcactgcttctttatcctgggtatgtggcatagcaaagtcaaaacaagcctgtaattctcccagaaaaacagtggaaactcacaggatgagcatttctcgtggtcacagatcaaaagaagttgttagggacttaaaagtatttttaaagcttcaagttacagcaaaatgaaatgttaaataccagaaaagttgatcatgaagtttcttcataagaattctggcatatccttagctctatcactacccaataatgacagctgtttcttacatagcttctcttcttcatctcatttttgaccactctccctagcatgttctatgtaacagccctacagacagtttctgacagctgattaaaagaactgaggggagatatctggggcaagaacgtcgcagcagatggaacagagtagctacagcctagagagcaaaaacaaaaacattaggagaaaagtcagagacgcaatcagggccagataatgtagagtgggatgtctatgttgcacaactctaggaggcacaaatgatacagacgggaggtggaaatgctgggtagaagagggcggttccccaacaaaggccccacccttaagctggaagacccacagctctaagtgaggacaggcatttctgttttcacacccaaaaagttgccttttggcccaccacacccctcatcctgccctcatataaacccaagaccttagcgcgcacacacacggagcggctgaatatcggaaccagcagatcagtgaaaacggaataacttggcagagaaagagagaagagagaggttcggccacagaggggagttcagcggagaagtctggccgctgggtgctccggctccagggaaagaccaccttcccactccattcccctgcttccggctccccatccacctcgctgagagccacctccaccactcaataaaaccttgcactcatccttggagctcacgtgtgatctaattcttccagtacacactgggcaagaacttggggtacagaaggctgtcacactggctccctgcccttgcgatagggcagagggtccattgagttgattaacacacaagctgtctgcagaaggcaaatttaaaagagcttgcaggccgggcgcggtggctcacgcctgtaatcccagcactttgggaggctgaggcaggcggatcacgaggtcaggagttcgagaccagcctggccaatatggtgaaaccccatctctactaaaaatacaaaaattagccaggcgtggtggcggctgcctgtagtcctagctactcgggaggctgaggcaggagaatcgcatgaacccggaaggcagaggttgcagtgaactgagattgtgccactgcactccagcctgggcgacagagcgagactccatctcaaaaaaaaaaaaaaaaaaaaaaaagagcttgcccacttgggcttcaggagccacagacacccacccccagaccctgcggtggggctggagcccaaaagcactcttgcaggcctctgcacctgcccatctgcatgctccccctaggggtttgagctgcagggtgaccacacaggagacacccctgttgcatgtgctgagaggggaatcagggaactctcccgttttactattcacattgctttctatatgactggtattctcccgcagttgtgcaatgcagcaatactgatgaagtcctgacagttgtaaagaccaagggcttttatactgagtgagagggaaagccttaggaaacttagagagaatagatgtgaaagtttaaaagatccctttctctgctgtgtgcatagggaggtatcaaggaagaggcagtaatagcccaaaggggcagagggaggcagcaaggaagccaataatgaggctggaaggataatccaggcacaaatccaagtgagctgggcccggtggttgtggagatagtgagcactggttggatcacgcatacattttgacagttgaaccactaaaatttacagacaaatcaggtatggagtgaaagagaaaaagaagagtcaaggatgaccccaagtttttaactagaacaactgaaagaactacattgttattgactaaggagggaaaagctgggagaagagaaagtgcatgggcaatatcagattggttttgtatctgtttcgtttgacatgccttttagaaactcaaatagaaacaaatagaaggcaaatttgtgtgtgtgtgtgtctgcatgctgcaagcatacatatgcatgcaggtccagaggtcagaggagggatgtgggctagagatccgcatttgtagttgtcagtgtaccagtggtatttaaagccatgagcctgaattagatcaccaaaaggagagagatccaaggcctgaggcactccagtgtctacaggtgaaatgaggcgaaaacacaaaggagactagactaagtggccaaagaaagaggaaaacccaattggaagtcaggtgaagagtttatcaggtaggagggagtgattaaatgtagcaaatgctggccgggcacggtggctcacgcctgtaaacccagtactttgggaggctgagacaggtggatcacaaggtcaggagttcgagactagcctggccaacatggtgaaaccccatctctaccaataatacaaaaattagctgggtgtggtggcgcacacctgtagtctcagctacttgggaggctgaggcagaagaattgcttgaacccaggaggcggaggttgcagtgagccaagattgcaccactgcactccagcctgggtgacagagcaagactccatctcaaaaaaaaaaaagaaaaaaaattagcaaatgttgttggaggtcaaaaactactgagaactactatgggatatagccacacaggtagagacccttggagatgtggggacaaaggagtttttcttgagaggtgtaagcaaggacagtggaatggaggtttgaagcttagggaagtggaataaaattggggatgatagatagatttaagaatcatcagtgcatatgtggctataagcaaatatgagatttcccagagaaaatatataagatgttgagaaaagaaggttgaaaatagtatcctgtggaatatcaacatttaaggggccagtagacaaaggaaggagactagagggtggccagggcagtgacaggcagatcagaatagaaatgtgctagaaaccaaaggcaaagagtgctacgaatgaagaagaaaccaacagagacaaaagtcttccattgcagggggcagccaagtttatactccctccttcacaaccccacatctcttctcctataggacattgtccttatgggctgtaacagatactgtcagtttcaaagactaaaggaagtgcataccccagctccctcacccctctagtagactaattctaaaccatatgttgtacactagttcccagattttcccatgggattgctccagttgcccactatggtagctggtttagtaatctactcttttttttttttttttgagatggagttttgctccatctcccaggctggagtgcagtggcacgacctcagctcactgcaacctccgcctcccaggctcaagcaattctcctgcctcagcctcttgagggcctgggattacaggcacacgccaccacgcccggcttttttatatttttagtagagacgcggtttcactatgttggccaggctggtctctgaactcttaacctcaagtgatccaccatccttggcctcccaaagtgctgggattacaggtgtgagccaccgcgcctggccagtaatctactctttattggcctgtttcccttcccactcccgtgacccccaccccaccactgtctcgcgtctctcccaaatgtaccatggctcaactccttgtctcaggtctgtgtctgtgcgtcccatgtccatctctccactggcctatgaactctttaaaaatatgcctgtcttcatgccttctccagttcctggtaaactgcctggtacatagaatatacttactacatgtctgttgaattgaaggatttacatttgcacagggcatgtggcttctctcaaataaagaagttatctgaaatacattatcccatttagcccataacacaattctaccacttaggtattattatttctattgtaaagttggagcaatagaggtttaaagggcttgagagacatgctcagcgccttcacgatgctatttgcaaaatatccatataagtacctcatctatctctagcaaaatattgatgtaagtacctcaaagaaatagtattaaattatttcttccaaataaacccacaattcaataggagaaattcggactatgtgttttaccaggatcctgaaactatcattttgctgcttgtgcactgaaatggttgctagcagcaaccggagctaggcagagcaaataaggtgctatgaaaaggaagaggaaaatgaatgaataaataactgaagttctttcatggcagagagatctcttcaggcccacagaaatacgatttaaaatcaactttccatatatgattacagactaggtaaaggattagtcagaaagctcagcatgattgataggtcctgaactttagccccctgagttctcacatctcaactatggaaacacacaaatgtttattttaaaacctctgacgaacagttcccacagcattatcactttagcacattatttactttacaagacctagcatcaacataagatagaaaggataagacaactgtgtgtccttctatatgggaacaaaataccttaggagttatgactgacttaaaggatattaagagaagatgaatcgaatttacagagctaagcattgggaaaagcagctgttacaagttgtgggttttggctcgattcactctggaaagacacgtgagagctcttgtgagaagggggctgtagcggcgggtattaataaggattaataatcaaatctcaagatggtcccaggatggtggactatttgggggaggatggagcctgggggactggatttaaaataagctgggaatgacctcctgaacctcagtttcttaatttataaaataaagatgataataccttggagatttactctgaaagcaaattgaactaacagctgtgaaagcacttcagaaaggagaatggggtacataatgtaaagggagggaattactatttccttgggcaaatgatttcacaagttggaagaagacgattgagacaagagtcaacttttagtcaccattcatttcatcggctaattaggaacctgacacccaacgcaagtccacagtgccgaatatcttcaccagaacaccttcttccgtcccctttgctaagtaggagcctttctcttttaaaatattcaggattcatttatgtaattgacttcactctattccattgacatttaacctgtgtccttttatactttctgtatcacagcatatttacatgtagttattaatgctcttttaacattctgtttcttacacgtgggtatcacagattaggtttaacactccttaaaggtaggaagtatgttaaactattattataattattactgttagaaagtactttgcaaaacatatagccctggaccacggtttctcaaaagcagcactcctaacattttaggccatgtaattttttgttgtgggaggctgtcctgcatgtacattgtaggatgtttggcagcatatcttgcctctacctactaggtgttagtagcaactccccctgttctcacagttgtgacaaccaaaaatgtctacagacattgccaaatgttcccaaatgggggctgcaaaatcacccctagtgaagaaccaatgcgttaaacagatacagattaaaattatggtcatcataattacttttactttttcagagtacctggaatgatacgcagaaaagaaaaagtgctcaatcaatattgaatgaaaaaatgaaagaaaaactacattagttgtatttataaagtggctctatagcataatcccttatatgattaagactgtattatataataaacactttgctggttggcatacaatatattcttacactttttagtaactatgtctgtgtatacaagaaattacattcttatgcatatacaaagattgtagctggcagtgactttctctatagcacacaaactatgaatagtgtctagcatcctgtttacccataaagcaagagacagaatacttattttaaattctaggtaaatattacatcaaacaccaattgtcagatgcatttttggagaattatctctacatgaaaaaaatattacaaccaagaattctaaaaaagattatctgacaagtagaggatctcagatgagtgtacttcggaaatttctgttctatttaaacatacatttttaaatataaatgtttcatcaatctttctaagattttttccaagatcatcaatctcttccaagattagaatatttgcaatatcctctgatattagagagccaatgttttaagtggcattttagtttgttattaaaaaatactaataatgggctgggcatggtggctcatgcctgtaatcccagcactttggaaggccgaggcgggcggatcacgaggtcaggagatcaagaccaccctggctaacacggtgaaaccacgtctctactaaaaatacaaaaaattagccggaagtggtggtgggcacctgtagtcccagctactccggaggctgagacattctcctgagaatgacgtgaacccgggaggcgaagcttgcagtgagcagagatcgcgtcactgcactccagcctgggcgacagagactccagcctgggcgacagagactccatcttaaaaaaaaaaaaaaaaaaaaaaagaggatactaataatgttattttgattttcaagaactgatatgttttgagcaacagtgttacataacactgatgatttttttattttcaagttttctctatgaattcttaaatcccgtatcaatgggttacattttccaaattaccactaatgaagactgtaagcattcttataaaacaggagaaaatgtagttaaaacagaaaagacttaaaggacttctctttcagttttactcactcagccttctagtggcttttagctatatactatcttttggagggaatcctaatttagcagcagacctctactaaacaacgtgtgaaaaagaaaacaaacttccatttctggccatgaggtagtaacttgcagcagatcaatgcccctgtcaagtacaactagaaaagccagataaaacacaagaaacatctgttggaaggcatctgagagctgatgagataattaagatgtgagtggccaaggtcccagagagaagataactatagaacaaagagtctacattcttttttaaagttttattttaagttcaaaagtacatatgcaagtttgttatataggtaaacttgtgtcatgggggtttgttgtacagatcactcacttattaagcctagtacccattaattatttttcctgatcctttttctcctcctaccctccaccttctggtagaccccagtatcagtcgttcccctctatgtgtctatgtattcttatcatttagctaagtgagaacatgccctaagagtctacaatctgtgtatgccttgtccttcatggaacttgccagttcttggcatggtgctacacatgtgaccactgcaaagacaagataagccagcagaacttttggcaattccacaaaggcgaagagacaaaaattagagtttggtgttgctgaagcagccagatactaaggggccaggtgagcagtgaaaggggagacatagagaagcagatctatcacttgggagggttgccttgcaaggcatttgccacagagggcaggagcctaaagaactaagcagaaaacttcagaaaagtagaatggaaattacagaaattatactgctctgagcagaaaataaaataaaatttggaactactcaaggaggaagggaatatagtaagcctaccagtttctcagttgagactactggagaaccacactctcagaatggagaaaaaccagaggtagacggagccttataacaatgaggcaaaatcagcttagtctctgattaaattaaggctatctggccccatatgtgcctagtgatcatatatgtggcacatacgtgtgatcatatatgtgtctggcccatatcacatatacgatctggccatatatgtctacccttcaagaatctattgctacatttgctggcccactgcctttagctgtcagatccttcgggttttgcctcagctgtggaacactgaagagatctgcctcactcagtggcacactcttcccaggaaggaccacatccaatgactgattgaggtggagacacatagactcaactattttggatcaacatgagataactcttgtaggcttaatacattccagaactccccaaggatttagctgaggctttggtgggcctggatcatatttcaactccttctgcccaattctgctttctctccctcccttaacacaaaggctgaagcttaataaatactctgtacaccaaactccatctcagttactatttgcagaaaactcaacttttagcacctagtgtcagacatggtctaagaaagcaggtgataagatatggttattgatctagataacctcacaactacatcagctgtgaaaactagcagccaagcagccactagaaggggcaaaacatgcttggagctctccacaatgccccattaccaaagaattgtcattatttttcttgtctgttagctccctggaaactcagagcaaatgtgattatttgacctgaataagagcttactcagtgcaaaagccttttccccggggtgtttctaaaaaaaaaaattaataatcgattaacactgtaactgtctgaggtggggatatcacttggggcaaacaagaagctaaccagaaaaattaaaagaaaaatgtggggaattcctgtaggaaaatttgaaaagctctaatacattgctgagaatctagaagatcccatgaatgtgcaggactatgcatatacctaagaaggacccagaaaggcccaaatatctcacctgtggcagacattgagaccctgtacaagcagaaatttaaggataaggcagagctgtaaactctgctatagtattgactgctatagcattgactctgctatagtgtcgactctgctacagtactgactatgcaccctaacatgcacagaatcccttggcaaagactaggatatatacctgttaaaggcatttaaggaaattctgtccaaccattagttgaccactaggctgctatctgggcaaaaacttcagtggccagacatgacaaagaacaaacttaacataatttgtttcagggaactcactgaacaaataaataacaataattaaagcaacaagaaacagaaacagcaactaatgttggggggaagaattcaacttgcagagttgaacattatattattttaaatgtccaactttcaacaaaaaattacaagatgtccaaagagactggaacatatgcccatatagagggggaaaaaacagtcaacaaaaactgttcctgaggaagctcagacattgaatttactggacagacttttaaatcagttattttaactcattcaaagaactaaggaacacatttctagagaactaaagggaagtataagagcaatggctcaaaaaatacaaaatattaataaagatatatagattattttaaaatattagaaattatgcagtaaaatatataataactgaaattaaaaatttactagaaagacttaacagcagacttgatcaggcagaagagaaaatccgcaaactttaagataagtaagctgagattatctagtctaaggaacagaaagaaaaaaaagaagaaaaattaaaaggtccttaatgacttggaggatgtaccaacatactcataatgggagtcccagaaagagataaaagaatgagtcagaaagaatgtttgaagatataatagctgaaaacttctcaaatttggagaaaaacatacatctgcataacaaagaagtacaaaaattcaaataaactctaaaggatctacacttagacacattgtaattaatctatcaaaaatcagacacagaaaattttgaaaacactgggagataagcaactcatcagataaaatggagcttcagaaaggttaacatctgacttctcatccaaactgaggagtccaaaaggaagtgggataacatattcaaagtgctgaaaataaaagactgtcaaacagaaattctatgtacagcaaaatatcctttcaaaatgaaagacaaattatgatattcccagataaacaaaagtggagagaatttgctattaacagaaccaccctgtaagaagtactaaaggaagtcctttgggataaaataaaaggacagtatacagcaacttgaatccatatgaagaaataaaaggtattggtagaggtaattaaataggtaaaagtaagataaaagaaatgtattttttctataaatcttttattatcctatctgattcttaaaaacaactgcataaataatttataatcataatcaataaacctatgttgagattatattatataaagatgtaatttgtatacataatggtacaaagaaggaaaaagaaacaaagctatacagaagcaaagtgtagatattgttgaaattcggttaggattcatctgaactagactgttataacttaagacgttaattttaagttccagcacaaccaataagaataactaaaaaaaatagccaagcaacaagaaatttaaaatggcacaccccaatatatctaacacaaaaaaagtcagtaatgaaggatcaagaaatacaaaagtcatagagaaaacaaatttcaaaacagcatatgcaaatacttataattacattaagtgtaaatgaattaaacactacaatcaaaaggcagagatttgtctcatagataaaaatatgagattcaattatatactgtgtgtaaaaggcatactttatattcagaaacacaaataggttgtaagctcaaaaatggaaatttttaggtgcctatgtgtttacacatattttctattgctgggtggagtgtactacagatgtctattagatctcattggtttatcgtgctttgtaagtcttgtatttcccttttaatcttctacctagttctactcattattgacagtggaatattatggttgaattgtctatttttccttcagttctgtcagatttaagtatttctggctctgtgttatgttttcctgacgaattgaccctttatcattaaaaaatccctcctcttttctgataacaattttgttttaaaatctatttgatcaaatattagtatagccattccagctcttttagcaaagattgaatggtatatttacatatgtaatctttatcaaaattatagctgaatttttttcagaaattgacaagttaatcctaaaatttatacagaaaggcaagggacccaggatagctaaagtaatccttaaaaagttaaagtatgcacacttcataatttcaaaatgtattgcaaactgtggtaatcaagaaagatagatagatcaataaaaaataattgaaagtccagaaataaacccatacatctatggccaattgttttttaacaaggggctccaagtccattcagtgggaaagaatagctcttcaacaatacatactaggacaactgaatttccatacgcaaatgaaagaagttggactcctacttcacaacatacagaaaagttaatttaaaatggatcaatgacttaaatataagagctaaatctattaaaatcttaaaagaaaacaaaggaataaataattagtcaccttgtattagccaatttttaaaatacatacactagaagcatacacaacaaaagaaaagacagataaactggacttcctcaaagttaaaaactgttgttaaaatgaaaacagcccccgaagaatgtaggaagatatttgaagattatatagcttaaaaggcacacttgcatccagaatatataaagaacctgacaattcaacaatttaaagaggcaacctaattttaaaatgggcaaagtatttgaatagatatttctcaatataaggcatacaaatggctaacactaacaagcacatgacatgttgctcaacataattagtcattagcaaactgcaaatcaaaaccacaatgggataccacttcacatcaactaggacagctataaacaaaagagacaagtgtggtgaaaatgtggaaacactggagccctcatacattgtttgtaggaatggcatttcctcaaaatgttaaacatagagttaatactagtcacagcaattctactcctaggtatatagctgagagaattaaaacagtatgtccacacaaaaacacaaaatcttatacgcaaatattatacagacagcattattcataacagtccaaaagtgaaaacagtccaaatattcctcaattaatgtatggatttttaatgtggtatattcctacaatggagtatcaattgacaataaaaatgaatgaagtactaataatacatgctacagcatatatgaaccctgaaaatattttgctatgtgaaagaagtcagtcacaagagtcccatactgtatgatttaattcatattaaatgtccaaaatagtcatgtttatagaaacagaaagttaattagtgtttaccaggggctgaggagagggatagcaatttactgctaatgcgtgtaggtttctttctagggtgataaaaacattctgaaattattatagatgattatgatggttgtacaattctgtgtgtatactaaaccacttaataatatactttaaagagatgaattttatagtatgtgaatgatctcagtaaagctggcatttctaaaaggtaactagcataatatgaaaaaataatacatcatcttaatagatatagaaaaaaataataaaattcaaaacccattcaggattttttaaaaagtcttagcaaactacaaatagaaagagcttccttaatctgaccaagagtatcctaaaaacccttcaccaaacatcagaattaaaggtgaaatattgaaaaccttcttcctgacatagaagaaacagaaagcagaatgactgaaaaggaggaaataaattgtcattattttagatgacatgattgtgtacttagaaaattcaaatgaatttacagacaaattataaaaattgttgagtgatttatcaaatttcttggatacataaaaacagaaaataaaggaaatgttttaaaaatatataatttacaataacatcaaaaataccagataccacaaataaatctaaagatgtgcaagatctctatggttaaacctataacacataattgagagaaattttaaaatgcctcattgaaaatacctacttaaatattaccatagtatataattgttatggttggaagactgactgttgtaaagaaattttcctgaatttgatctatatatttaatgcagtcccaatttaaaaacaaaacaaaaacaaaaacagcatttgtggaaattacatagtgattttaaaatttacattaaacgcaaagggccaaaaatagtcaatctttaagaagaacaaagatagaggacatataatattcaatataaagatgctataaaactatagtaatccagatagtgtggtattgtcttaattctattctgtcaattagagggttcaaaaatagatatacatgtaatcattcacttgattgatagcagcagtgatattacagtgcagagggaaaaattgtcttctaaataattaaatggtggtgggtcaattgaatatacacatagaaaaaaattaattcctatcttttacctttcaccatgcacaaaaaataattccagaattatagtagatgtaaaactgaatgtcaaaacaataaagattctagaagaaacataggagaaaaacttctatgtttgggggtgagcaaagatttcttaagacacagaaaaaaaaaacacaaaagaaaagattgatattatggacccattaaaattaagaccttctattccatcatagatgctaataagagtagaaaggcaagccatagggcatgagatctttgcaatacatatatccaacagatgacttgtatccagaattcatacaaaactataaactgaagacaaaaagacagaccatcaaaaaataggcaaaatatttggacagacatttcacaatactcccatcaaaattgttaaaatgaaaaagactgacaatgctaaagattgggaaggatttggagcaactacaacttttataaggagctggtaagagcataaattggtacaaccactttagaaaacttttttgttgaataaatataaccatattcaattaaagacaggcacaagaggctgggaacggtgactcatgtctgtaatccaaacactttgggaggccaaggtgggtggatcacgacataaggagttcaagaccagcctggccaacatggcgaaaccatgtctctactaaaaatacaaaagttagccaggcatgatggcgtgcacctataatcccagctactcgggaggctgaggcaggagaattgctcgaacccgaaaggcagaggttgcagtgagctgagatcatgccactgcactccagcctgggtggcagagcaagtctctgtctccagaaaaaaaaaaaaagacatgcacaagaatagtaatagcatcactgtaatagctgaaaattggatacaatgcaaatgtccatcaacagtgaaatggaaaaatatattttggttcaatcatatattagaatgctgtataacaatgagaatgaatgaaccacaatatgaagatgtaattaatttcttgaacataatgctgagcaaaagaagacaggttttaaaaagttacatattgtatgattccatttatatgaagttcagaagtaagcaaaactaaggtgatagaagtaaggatagaggtttcttttggaagggtgagatatgacaggcagcgggcttgaaggcatttctggggatgttgttaatattctattccttgatctgggttctggttacatggatcttgtcacttggttaaaatttatcagactgtacacttattatttatatccattcctgtataaatggcatactcaaataaaatcttctaaaaatgaaatgaaacacagacacctacattgctttccgttttcctgctgaggtgagaagcaaattctgctgacattgctgctttcagtttggtttctaaactgggagcatctgaggaaatccggccaggagtaattcaccatccccaggactgattcacagccttcttttgcagcctcacagaaggacctacagggcaggagtccatgactaaaaaaaaaaaaagagaaaggtgaaaattagtgtctttacagaataggttttgaaataatagtgaaattaaagttagcccctgtgttgtgatattatcttaatttatacttactatagtcagcaacttaaatttttacattcagtcctatgacagtgattttagctattctatggtcttgattctagaagaaatagctagttccacatcatctaactatttcttgtaggaacatttatcaataatttgtttaatatttactgggctaaaatatatagttgtcagcctaaaagagctctatttaatatcaaaaggggaaaattaacatggaaacgaaggccctcagattgcaaaggaagaagtaggtcaaaaatatgttattcttgtatttttatcttccctttgagaaattcaagtatctctgagtggcagcagagagtaagctgttccattattaacttccccagcctccctggaaaatgaacattatacagatgagtggcaacttggaagaccttgtacagttatttatcttttcagatttctagtctgtcatctgcaaaataaaaaaaaatgcacacaattgtctgttaatagtatgagtaatgatgcccccagagcttatctttattcacttaacatgccatgaaacagtcctagatccatagctctgtggatggagatgggatactaacaaagtcaaggccacggacttgcttccttgcagacccaggtaattgtttctactttacagctgaaggctgcatctctcaccctggctggtcaattgctaaaagcatttcaaatagttttaaggaaactgggaaagaaaatagacatgtcagttaaatcaaagcatacacttcacaaatgtggagccaataagatatcacagaatcgtacaatattagatatgtaacaaaccttaaacaataccttattcaaatccttcaaatgagatagttccagggagattctaggacagacttgaggtcaaatagctcctaatggcagaagcaggaatagaatcctggtgtttcaagtttcaggacacattctacctactctccctgtctcttctcttctaaggacctaatagttgggcttttaaaactccttgatccaacaagcacatttacaataccccattcatacttctacagattacaaaaacataaggggataggccagccgttgagatcaaatgaaactaatagggtctgtaaaataatcttagggcagagatctttgtacataaaaatggaaaaagggaattcaacaattacattcagataaaaatatcttaccttcctctcagaaagtcaccttaaaactgagtatcttttggaatactgatcttcatataattgtctacatacattaatatgtaaccaaattcaacagtgaggatgttgaagaagaggttttgtatttgaaagaattagcttcagcatataaaatatgaattggttcaggcaagtttcttggtataaagaagacacccgaaatatattagatatttctgggactaagaaaggatcacttaaataacactgtttttcattatttcctgcctgtcctgactcttatcccagagaagttagcgaatatactttctcaaataaaactaggatacacagtaaaggaaggtggagaacataaaattactatatgcagttacttatgtttgccaggcactgttcttagtaccacacatgcatcacctcactgatttctcagaacaggatgagtaataggtgttattactaatccccaatatacaaataaggaaagaagcacagacaaataagacatttgtccaagttcactgaggcaatgagagtcagagccgggattagaactcgggcagattgacccaggacctattctatttactactgtactacgagtaagtcctaatttcatgaatgcatgtcttgaaagcacaacgcaaatctttttttttttttcaaatggagtctggctttgttgccctggctagactgcagtggcgccataggctcactgcaggctctgcctcctggtttcaagcgattctcctgccacagcttcccgagtagctgggattacaggcatgcgccacctcgcccggctaattttgtatttttagtagagacagggtttcaacatgttggccaggctggtctcaaactcctgacctcaggtgatctgcccaccttagcctcccaaagtgcagggattacaggcctgagccaccgcacccagccaagagtgcaaatcttgatatgcactttgtgagtggcaccatcatatacgtgatgggtgagatctccattctacaaaagcctacaaatgtgcattgaatcagtatttgtcaaaggggctaagaaacacaaggaaagggtaaatacatttgtgctttcttctctaggtgtgagccagcccacagtaaagctataaaacaagctaggcttgtcgttggtgttcctcctttgccttctagttcttgaccaaggtcccagggtcccaatgcccttgtgatcaccccgatgccagcaccccacctagatggccacctctaccagagtgcttgaaacatattattcccttcctacaatcaaaacagtactcccaattgcagctgatctcaattaagcttttaaataagaaaatagatgaaaaaaacacagaataatgcataataatagatgaacacttaaccctcccagagatttttgcatctttaaaagaagactgctcactggggcaatggaatctctaactgatgaaattccagataccatttaaagggaaaaaaaaacattcaacattttttgaagatgagaaagatgtctgcaaactgaacaacactctggagcccaactctcccaagcagttcctggacctttcctcatttctgaactgagttattttattttattttatttcatttcatttcatttcattttatttatcattctacatcttttcttagaaccttctagggtaacaaaaatgaagtttcatacaggaggccagcagactgttttcaagttctaaagttaagtctttaattcagaaatggaatcattgtcattgactcttacggtggtcatttttctacaggaaagcctcagtctatcaccctgcaactttcacatggccactcctccactgttgaatcttgggcaatagctcactcatgtcaaaactcagtttcctcatttgaaaagtgaaggttttggaagagctggagtttggaccatttttcatagtccttttactactaacattctgtaagtcaaaattcattctttaaggcaatgtttctcagaggagcactgataatcccaccagatttgctaaatttcaaaaggtaacaggcattttcctcaagatttgttctgggaatatatagagacattaaaataccattaggccctccattctaaaaatagggcctaagaaaaatgtctactgtgtttccaaatagttctcttaagaggtgtaaccaactgagacccataagctttaaactgctggaccaggatatgtgaaatagtgatggggtattaataactagcaacactttccaacagtgagcaaaatgtgtagtcattttttcttactttgcataaaattcaactgcctagggaaggttgaagcattttgcttttcatcacatggaacagcgtggtgagataggccacactattttggaatatgtgtctatatccaagcaacaaacagattgatgactttaaaacagctctgcacagggaaggagaccactttagctatctaaaaactattttagaaagggtgattattttaaattgatgtctgaagtgcatttggtgttgtgcaaaagtacctagtacatttcaactaaagttaaagcagaaagcttttatacctcctctataattatttgttcaaacatttgatagctatataaataatactacaatatagtgatagtgaagtttttatggtgttctcactaggaaggctgttataaaattatttatctaccaaaacttgtacagtttatctataaaaatgttagagaatttatcttcaaataattttgttatagtatatatacaaattaatatatagattttatctgcaaaaaacaagttctgataaggacataaagtttaaattatgaaataagtcatagccacaaagcaggcttatatggttaatggatttttaagttttataaatcatttttctcttaacttttgattttgaactactgttaaacttacagaaaagttataaaaatagtacagaaaatttccatatatccttcatccagactccactaaggtaaacatcttacataactgtagcataattattagaaccaggacattagcattgatacaatatctttaacaaaactaaggaccctatttgaattttgccaggatctccatttaggatcccacattgcattcaattgtcactttttacttttggcaaataaactaatctttaaatattattaggagaactcagaatttaaaactcttttttcatgagaaaaaaaaaaacagaatctttgtgacaggtggactttaagatggcccgcaatgatctctgcttcctggtattcatgccctgtttaatcccctcctctggagtgtaggttgcctgagtgatttgctcccaaccaacagaaggtaatggaatgtcaacttcatcattagtctacataagattgtgacttctgcattgctaacagactctctcccttactggctttgatgaagcaacttgtcatattgaggagacccacatggcaaggatctgaaggttgccactggctaatagacagctaggaactaagaccctccaaccaaagcctttaaggaactgaagtttttccaagaatcacatgagcttggaagttgatccttcccaggtcaagccttcagataagaccccaaccctgccaacatctttaattcacctatgtgacagaccctaaagcagaggacctggctgggccactcccagatatccggcccatagcaactgtataataatatatgtgtgttgctttaagctgataggtttatggtagtttgcaatatataactaatacacttttcttgacacatcacattgtcagaggcatgctactgagtttgatgttctattcattgacaagactcacacaatcatctttttaaaaatacattcctaagtttgtctttgttaggctgagctgttcagtgaaaaatgctcacaaaatcatagtcacaggcacctcccagagctgcagaacttacttagtcgtgaagagaatgttaatgctggaaggatcttccaagataatctactcccattttctccttttgcattatgaggaaattgaagcctaaacagattttcatagccaaatactgtgactccagtccagtgctcccaaatatcttgcctatctgacctccttgcacaatctatgagcaacagataacacaggaacataaatcaacagatgacaacactactggaaaacccaaataacaatagatggcttgttctccctatgataagcgaacagcattggtttcctatgtcagcatcttctgcgacctcaagagaccatataagaggttaggcttagcggggtatgagaagcagaaaagaggcttctttggtttctactccactaaacgtggggatggacagcggtgcaagggaatttttacatgtgtcattgtctcccatcagaagataaataatggaagcatttgtggtattttttggtcacattggtctgactctaaaatccaggactgtgtctttctttttcttcatttgtaatagtcatgatcctaccaggaaagaggtgagccactaaagcaggttcactgcagaatgtttaatgaagggctctgatcacctacagaaggaaaaggtacaggcagggtttagataaaccaacaaggcatagtacagtaggctgctgcagggagctgttagcaccctaggtttaagagacaaggggaaaaagaattttctggaacttggagagagttgtatggggaaggctgcttgataggggtcgtggcctcttacagtgagtgggttgcagtcaacccatgtaacctggcagaaaggaaaccaggggatcactacccaaactgtctattctcccacactatgatctcatgctggtggcttccattggctgaacccaacaggaagctagaaagtagccactgttgaagcggcctcccctgggaagagttaggatggaggagagtggaaagtagatatggagaagtaaatgagaaacagccagcacaaagctgcatgccttgcacctagtgaaagttcagcaaatacttgtcaagggatgaaacacagtgatgtgtgagcagacggttaaactatgattagcttgacatctggtgggactgtttacaccacaagaatcagcaaattatgcaaataatggttttgttgttggtttgttttttcttcctcagggatccaatttaccagcacaccactgaataaaagtctaaatcatgtcatctactacagaaggaaagctgttttcatttccactcaaaagaaaattacagccatgaacttcttgaatccacataagaaatgatctcaatattaactccttctccaccacttctaccactcctccttcacatacattattttttcggggagtatagctcaggggtagagcatttgactgcatatacattatgtttttggtggtaataccatctacctaagtctccaagtccaaaagcctttgccttccagtcaacttagacattcatatgcaaataatcactaaatactgccaatattacttcctaaaaatccgtcaaatccattttcccttctctcccattttattttctagaaaaattaagccagctgtactctctctaatatatggtagatctggctgttacttcatctgaattgcctttttaccccaccttgtttacatggcaaatttttcttcttcctccaaaattaatttcagcagttacctcctccctgctagtagccttccctaataatgccagataaaatgaattcctcccctttctctgtgttacctccatgccttgtaaactgatcacattttacagcaatttaattgtgtttatgtctggtcctctattacgctaagtcccttgaagacagtagtatgttttattcatttgcgtaacccagcatctagcagtgtgcctggcacattataggcaccaataagtgtttgctaaaggaataaattgataattttccaggtatctttgttgaataaactgatgccaggagctgagatagagctagttcctagtaagaccctctattcctcccttacgtcaggcccccccacccacactcccaaccttggcaacagtaactgcttgcaggactgatcccatcatgacctcttttcccacttcaatcaattatgacaggatgctcagtatatccggctctccctcacctcccggacttccagatcctcatggatcaaatgtaagcttcgcagtgagttttcctgaacaacactgcctaaaattgcacctcttttcaccatactcccaccctcccaaagctctccattcccctgctttgctattttcattgcacttatcactatccgctaaacgagtatttattatctgtctatttatttgcttactgcctatctctcaccggcataacataagctctgtgaagccagggatatttgtttatttcatctgcagctctatccctcctgtgcacagtcagcactccataattatctgttgaataagtaaatgaatcacacgcagaggtgactcctgcctgagataaagctgtcagtagcaaagttgggaggagaacctaactcccaacttaattgggaatacaaaagctcacactaccctgcccaagaggtgccctccacttcaggtcagcaggttctacatgcactattcaacatttaagtaatgcccacgtaagagttaaatgtcagtaaaactgtcataaatgaaaagcctacagactgagggtcttgtttgctatgccaatagcagtgtgtccctcttaaaatacagaaacttagaaaatactaacagataaacacagtttgaattaagatgggcataaataatgtaaaaatgacacagccactctgaaagagaatataaaagtccatactcttttaaccaacacattcctgattctcattaatatttggcatacttaccagggcccaggggatgagagattaacagatcacaaaagaaatgtgcaattgttgaattattttgcagttgttttgatttttacacattataaaaggatgccatgaatacggatattcaaatgaattgaatcacaagtattatttatacattctagtcagagccacataattatcgggggaaccagcccccaatatttcaatgtaggttctttctattttccctaagagttggccagtctaagaaataaagagagtacaaagagaggaattttactgttgggcctccaggggtgacatcacatattggtagatccgtgatgtccccttgagccgcaaaaccagcaggtttttattaaggactttaaaaggggtgggggtgtacgaacaaggaataggtcacaaagatcacatgctttaaagggcaataaagatcacaaggcaaagggcaaagcaaagatcacaaggtaaagggcaaaattagaattactgatgagggtctgttttcagctgtgcacatattgtcttgttaaacatcttaagcaacagaaaacagggttcgagagcagagaactagtctgacctcaactttaccaggacgcgatcttttccagaccttaataagcctgagggtactgcaggagaccagggcgtatttcagtccttatctcaaccgcatcagacagacaaccccagagtggccgtttatagacctccccccaggaatgcactccttccccagagtattaattattaatattccttgctgggaaaagaattcagtgatatctttcctacttgcacatccgtttataggctctctgcaagaagaaaaatatggctgtattctgcccgaccccgcaggcagtcagaccttatggttatcttcccttgttccctgaaaatcgctgttactctgttttttttcaaggtgcactgatttcatattgttcaaacacacgttttacaatcaatttgtacaatagtggtcctgaggtgatgtacattctcagtttaagaagataacaggattaagagattaaagtaaaaacaggcataagaaattataagagtattatttgggaactgataaatgtccatgaaatcttcacaatttatgtttctctgccacggctccagctggtccctccattcagggtccctcactttcctcaacacataataccgatgaattattgaggagaaaagtactgcacagagcttgatgaaatgtgtgtgcttgtgacactgtcagtaacatgacaaggcatttttagaaatatttgatctgtcatggcctgattctctagctttacatctttgtaaaatgaaagtaattggaattatatgacagtatcttacctatgctttgagctattttggctcataaaatgaaacctcatctatcacttcatattttatgcataatgccaaaaaagcaactaagtcaccagtgttgcctgatgttgaaaagggaactttgctacaaccagctgcctaaacagccaggttgccagaactcatgtggctgactgctgtttccaggttagcagataaattcaggaaagtaagcagcaaatgacttcagaatatttctttggtaacagcaacagtgctcatcttttttgtttgactactgatctatatatattttaaaaaattataaatatgaaagtatttaattccttaatgtttccatttattcccaaatgagatacaatttgggacatatgtaacttaacacctagagcctgaaattctattttctaccatgaactgtttaagcaaagaccaatccatccaatacacagaggggtccaagcagatgacctggctcctccccagggtgatactctttaaatatttgtttaatatttatttagctgagaaactgagatttgcactgaagagaaacaggacttcaggtagcagggacccaatttgcaaactcaacttagtaaaccagaagtcctgcagttaactcagcccattctttctgaaggcagttaggtggccagttgttgctactggatatgatccatcatatgtcaacacaatgccccccaaaaccttcaagtagattctctgattagtattccaaagcaaacataaaagagtttttgagaaaacctatgctaaatttaattttcttcatcttgtttcatgagtttttggagctccttattcatcagtgccatgggccactgtaaacggacctgcctctcaacccagtgaaaaaccaagtaaccttaggatgctggattccttaccctagtgtctccagtaagttctcatcagtcagtttaaatacctccagtaatagcaaactcaccatttcctgagacaacaattctatatttacacaagtttattatccataaaattcttcctttagctaagtaggaatttacttctcaatgactttcaattactagttctattaatatgtttgccctgtggaagaacacagaaaaagtatgctcccccttccatctcatggcccagaaacatctaagaacggccatggtatgccctcaaagtttcacacccccagttccctcaagtattcttcacatgaacagattctcaatcgctattctcatcagtatcctctacatattttattgttgttttctttctgttctttatataaactttaatgctaaaattttcaattagaaagtctttttaactgagtgcatatgagttaatattaagaagaagcacagagctgctaagccagtcttcaggcacaatctagtaattcctcatccattaggtccaggattttaacagtgatggagaagtgagagttaatttagtatctgttagctggttattctgccaaccagatcatcagtgttgcctgattttaaaaagggaagctcaggagcttcagaaggaagctaaattatctctggaaatattatccaagtcgccttaaagtttcaattcccttaatatacacacaaaatttgatttatgcaaaaattttaggaacatataaattatacaaaaagtgtagtacaactatagtcaacatattttgaactctcattaacctagacatttaggagggttccctgattgaagagttcatttattcctttactcagctatttaatgagcacctgctatgtgttgggcagtgttctgaacaatgggtatacaatgatgtacaaagtcaacaagttctctgccactgtggagcttgtaaagtaagagaggcaataaacagacaggcaaaaggggttataactgtgccatggtgaaagataacaggccctattgagggtgatcagagatttgtctgcagagatgtcttctgagaagagggcttagtgtgaggagaaagatactaccaggtaaaaggaacattatacacaaaggaagctagaaagagattggcatttttgagaggtagaaaggaaggtcagtgcaactggagccaggtcaacaacactagagaagcaaaaagggcttcagaaactatggtagggacttacaactggctatgggcagagctatgctttgaatcaaatgtaatctgcccccaaactttcaagcgcattctctgcagttgccagatgaaattctttaatcttcagtgaacacacataatataaaatttgggtaacagtatggtgtttttcaagaagctcatttgaggaaactcatttggttctcactgcaaacctacaaggattaagtacactaaagaaaactgtagtatactatggaaaattgagtacatgacagaaaacatgtagtttccatgcttcaggtgtaatttttaatcttagtcatgtggctaagtaattttttttataaaattgctctagatattaagaatagttgtttaggacctaatggcaaatcaatatgtcagagggaaaaacaaataaccaacacatcaaattcttaaagttaaaatctcacttcaggagcatggaatatctctgcaatgtactggaacatataagcaagctggagataatctgctgggtctcctccatttcaattagcctgttttgcagtacatgatgtgtacatttattaaaagcagacacagtctaaaagagaaactgtgaaagctcattgttataacatatgatatagttgatcaggatctgaggtctcaaaggaatcaagttaaaaactataacatttacacataccattataatatttttaaattaagttttaaatagtattatgtaggtattgtctctaggatgaaatacaagcaaatcttcattatttggttagcaggggaaattagtatgatgaatgatccaaaataatgaaatataaaagaaaaatatatttgactttagaatttttttttataatacattttacttctctgaactcactttgcttattaaatttagcttgcagatcccacacatacactaagtgacagcaagaagcattggtctgaaagtgcaattataaaattaaatataataataaatgcagggccaggagtggtggctcacacctgtaatcccagtactttgggaggctgaggtgggtggatcacttgaggtcagaagttcgagaccagcctggccaatatggtgaaaccccatctccactaaaaatacaaaaattagccaggcgcggtggtgggcgcctgtaatcccagctactcaggaggctgaagcagggagaattgcttgaacctaagaggcagaggttgcagtgagccgagatcacactactacactccagccttagcagcagagcgagaccctgcctcaaaaaataataataataaatgccacaataaaaaataaaataaggccccaaaggatacttgaaaactaatataataatggatatcattatccatgaaaatagaagtaaaaaattaccatattagcacacttatcaggtcaggggaaaaggaaattgtacctaaaagtgccctgaaaactgtaagcagcttaactaaaaatttacagctaacattcaagtagagattgaattataatcaggagaatgattgaaatgagtttacacatatatatacatatatatatgtatatatatatatatatatatatatatacacaaatatacacatatatatatttgagacagagtctcactccatcgtccaggctgaagtgcagtggcacgatctcagctcactgcaagctccacctcccggattcatgccatcctcctgcctcagcctcccgagtagctgggactacaggcgcctgccactatgcctggctaatttttttgtatttttagtagagacggggtttcaccatgttagccagaatggtctcaatctcctgacctcgtgatctgctcgcctggcctcccaaagtgctgggattacaggtgtgagccaccacgcccagcctgaaaaatatattttaaaaacccaatcctgcttacaatagctacaaaaaacactttggaataaacaaggaagtgaaagatctctacacaaataactataaacattgaaaaaaattgaagaaggcacaaataagtggaaagaaatggatgttcatggttggaagaattcatattttcaatgtgtccgtactacccaaagtgatctagagtcaatgcaattcctatcaaaataccaatgacatttttcacagaaacagaaaaaataatccccaagtttgcatggaaacacaaaagacaaaacagccaaaccaagcctattaaaaaaacaaagctggaggcatcacactacctaacttcaaaatatactacaaagcataatgatatggtttagctgtgtccccacccaaatctcatcttaaattgtagtttccataatcctcatttgtcataggaagtactcagtggaaggtaattgaatcataggggcagttacccccatgttgctgttcttgtgatagtgagtgagttctcatgagatctgatggttttataaggggctttccccattttgctccgcacttctccttcctgccatcatgtgaagaaggatgtgtttgcttccctttccaccattataagtttcctgaggtcttcccagccatgcagaactgtgagtcaattaaatctccttcgtttgtaaattacccagtctcatgcagtcctttatagcagtgtgagactggaataataacacatagtaactgaaacagtatggtattggtataaaaacagtcacatagaccaatggaatggaaccaagatccaataaataaatccatgcctttacagtaaactggtttttgacaaggtgccaagaacacacaatggagaaaagacagtcatttcatgcaatggagaaaagacactcaataaatggcattagggaaactgcctatcaacatgcagaagaatgaaattagactcttatcgcataggatatgcaaaaatgaactcaaaatgggttaaagacttaaatgtaagggcccaaactatgaaactactaaaagaaaacatagggggaacctatagcctggttaatgatttttgggaaatgatcccaaaagctcaaacatcaaaagcaaaagtagacaaatgagatttcatcaaactaaaagcttctgcacagcaaaggaaataacagagtgaagagacaacctatggaatgggagaaaatatttgcaagctatacatctaataaagggttaatatccaaaatacataaggaactcaaacacctcagtagcaagaaaacaaatcacctgatgacaaaatgatcaaaaaaacctgaatagacatttctcaaaagaagacatataaatggccaacaggtatatgaaaaaatgttaaacatcactaattatcagggcaatgcaaatcaaaacctcaaatcccaccactgctttatcaaataagttaaggtaatattcaaaatcttttgttgtcatttcagcaatgttcacagcagcttcaccaggaatagacttcatctcaagaaaccactttctttgttcatccataaaaaagctactcctcatccattcaagtttgatcatgagattgtagcaattcagtcacatctttaggctccacttttaattatagttctcttgctattttcacaacctctgcaattactttctccactaaagtcttgaacttctcaaagtcatccacgagtgttggaatcaagttcttccaaattcctgttaatgttaatgttttcacctcctgtcatgaatcacaagcattcttaatggaatctagaatggtaaatcatttcctaaaggttttcaattttctttgcccagatccattagagaaatcacaatctatctatagcagctacagccttatgaaatgtatttctgaaataataagacttgaaagtcaaaattattccctgattaatgggctgcagaatagatattttgttaacaggcaagaaaacaacattcatctcctcttacatctccgtagagctcttgggtgaccaggtgcattgtcagtgagtagtaatattttaaaagaaatctgtttttttctgagcagtaggtgtcaaaaatgggcttcaaaataatcagtaagcagtttctctaatgccatttattgactgtcttttctccattgcatgaaatgactgtcctttctccattgagtgttcttggtgcttttgtcaaaaaccagtttgatgtaaaggcatggatttatttattggatctcgattccattccattggtctatcagtaaacaggtgtgctgtcatccaggcttttctgttacacttatagagtatgagtagagtagatttagcatacttgttaacggccttaggattttgggaatggtaaaagatcattggcttcaacttacagtcatcagctgaattagaccttaacaacagagtcagtctgtcctttgaagttttaaagccaggcactgacttctcttctctagctagcaaagtcctagatggcatcttcttccagtacaaagctgttttgcctaaactgaaaatctgctgtttagtgtagccatctttatcaatgatcttagctaaatcttctagatgacttgctgcagcttctaaatgagcacttgttacgtcatcttgcacatttatgtcatggagatggtttctttccttaaatctcatgaaccaatctctgctagcatcaaacttttcttctccagcttcctcacctcttccagccttcacaaaattgaagagttacaatcttgctctagattaggctttggcttaagagaatgttgtggctgttttgatcttccatccagaccacaaaaactttctccatatcagcaataaggctgttttgccttctaatcatttgtgtgttcacggatgtagcactgtttgttgcctataagaacttttgctttgcattcacaattggctaactgttgggtgcaagaggcctagctttcagcatatcttggctttcaacacgccttcctcactaaacttaatcatctctagcttttcatttaaagtgagagatatgccactcttcccttcacctgaatacttagaggccattgtagggttgttaattagcctaatttgaatattactgtgtctcgcagaataggaaggccccaggcgagggagagagacaatggaacaatagtcaatatatggaatcaacctaagtatccactaaccaatgaatgcataaagaaaatgtgatacacacacacacacacacacacacacacatatacacaatggaatactattcagccataaaaaagaaaaaaatcctgttatttgccacaacatggatcaacctggaggacacttcgttaagtggcgtaagtcaggcacagaaagacaaataccacaggatctcattcatatatagagtatttaaaatttgatctcattgaaatagagaatagaataaaggtgaaaagagactggggaagttcaagggtgaagattggggaaatgttggtcaaatgacacaaaattacagttagctagggggaataagttaaagagatcttttgtatagcatggtgactacagttattgataacatattgtattcttagctggtcatggtggtgtgtgcctacagtactcccagctagctgaggggctgaagcaggaggactgcttgagcctaggagcttgaggccagcctggacaatatagcgacaccccatctctaagtgtgtatatatatacacacaaatatatacatatatacacacatatatatacacatattaatgtatatatacacatgtatacacacatatatgcacacatacatatatgtatgtgtctgtatatatatgtacacacatatgtgtatatttgtatgtatatgtgtatgtgtagtattcttaaaaaatgctaaaatgatggatgtaaagtgttctcaccacaaaaatggtacaatgtgatgtgatgtatttgttaatcagctagatttagccattccatcatgtatgtatacttcaaaacatcatgttgacacagtaaatgcatgcaattttatctgccaatttaacataaataggaattcaaacacacagaaaaaatgcaacttattcttgtattactattctaaaactttgtaacattttaattcagaaaataattgatgttatatgtgaataagtaatacatgctttgaaatttttttaagtgtatacttaatatttcaaaaattccatgatatacttttgattgatgtacttattgaaattatccctgatcctgtttgatattgtgctggatagcctctgtctatctctctgtgtctacactttggccttcttgccctgctctgcctcccagtgttgagtggaagaaccacccaacatctatgtatggttcacacttgctttaaagtataagatttgggacttttgaactgatgagatttagttgagattctggatctcatccaccatgctcacatgaattatgcacccttgtcctctggttgtggatgagttcatttgatgagaggcactggcagatgggagggtgggaggtgagtgaggtcagggtatttatccttccttctctctcactgcaagactgaagggttggcagtggccgtgctcctctgcctagggtcatagcacctggcctgtccaagaccctttacccatagatacaactctctctaactctctctaggtgctactggccattattccccttcaatcttgggtggtggaactgtatccccgtatcatgagaccctggtgcctcccatcacttatttgttctcttaaccctgcccacagctccataaatagtctcttcaagaaactctcttatcacccctttgagtgtgttgtctgtcttatgctggatcctcactagaacagctattatggaattcctctgatagcatcaatctaacattgtgaataattttttcccataaataaaattattccagattttcaaaacatttctattttcaaagaattagaactagccatgactaatgtggctaataacaaccaaaataaaagggagtcatttggataattttttttctcctaggacacttctgctataaccaactcttatcactgaataatctgggttccgaaatacctgtcatcgccatcaatgatgcactcagggaaggcgagggtacagccaaacagcatgatatgttgatagcaactgaggcgatggagatatgtgaaaaacttgaggaacttttccatttccatgtttctgacaactgagaggagaggtgtcagcgtggcgtggtagggcagcatctgacactggctgtgggtgatgttcatacaggcacctgggaagtaaagacatgcacatttaagagtggacacatcagaagtatatgtttgcaaactcatttaatatttgtttataagataaagtatacttatcacaagaaaaaatttagatatgcaatcatacacataggtgcatgtaagtatgtgtatgtgtatgataatgaaatcaagctacaaatatttacagaggaaaagcattcgtgtcctgggaaaatgtgtggaaaatacatactcctcatacatatctagtaggcatataaactggcaatcaccttttcttttggatcacagctgggcagggcaatatgtatccaaaaaaatcttttcaccatgcatattctttgacattatcaagtcatttctagaaacttatcctaaggaaataatcatatttgtgaatgtggatttatctacggggatcttgatctttgcatagtttacaatttttaaaagatagaaatcatctaaatattcagcaaaaagaattgttctttagaatatggaacaaacaatagaatatttaatttaggtacatgaaagatgcttcagaagactatttaatcacaacggatgatgctcataatataataagtaaaagtaggaagtcacaaaacaatttgtatacaatgatcttgtttttaaaacacacaattatgcaaagatttgtaatcccgcctatgtcaacagttcaggagcagctcagagcctctgacattatcttctcccatagttggctcttttgggcgccaccatatccatggcttttccattgccttcatgccagaaatttgcctggttgacccgatataaacaaaaatgttgacatgcattcatatgatgggattttaggaatcgaccacattttcttttttattccttattctcttgtctgtataaagattcattgcttttattgttgctgcttaaacaagattctcttattcacaatcgcctcagtttcaagacccagttacatgaaatcatatctatattatacatgagaaaactcaatttttagaaggctaagaaatttgcctagaggtgcatagccattatgtagaaatttcagatctgaaacctatgtcttctgagtaatttccattacttagagctaatgtagagggttatgttaaaaatagttcttgagataattcttaatggctcatgaaaggaagaggctaaaaagcatataatgacatatctcaaggtctgtatgtatagtaatatgtaatacacctgtatattttgaccacacctttttatcagttttaattacattattttatttaggggttatcagcttttgggcttatgcttttgatggaagcccatatttgaagcaattagaatactaaaaggctcattccctccacccagccaaagaaaccactgaatattaagagatcattttaaaaatgcaagatagaaaacatcctaggggccgggtgcggtggctcactcctgtaatcccagcactttgggaggccgaggcaggcagatcacgaggtcaggagactgagaccatcctggttaacacggtgaaaccccatctctactaaaaatacaaaaaattagccgggcgtggtggcgggcgttgtggggggcgtggtggcgggaggctgaggcaggagaatggtgtgaacccgggaggcggagcttgtagtgagctgagatcgcgccactgcaccccagcctgggcgacagagcgagactccgtcccccaaaaaaaaaaaaaaagaatcctaggaattttcccatattagcatttggagagcttcactgtttcctttactgctgcataacattccactatatgttgtactgggatttatttaagcaatctccctttaataaatatttggactgttttcaactttttgctattatattgctgtaataagtaacctgtacatatgcctgagatgtacaatagattcccagaagtaggattgctgggtaaacggataaatgctttcagaattttggtagctattgtcaaattcccccatcatcgagaagtaccattttgaattctcgccaacaatgtatgaggatgtctgctttctcagtctcaccaacagagaacagtgtcaaacttttggatttttgctaatctgataggtgagaaattatattgtagggtgatttttcatttgcatttaacttgttgccagtgaagttgagcaccttttcatatatttaaggaccatttgcattttgtcttcagtttcatatgcttggaagatttttcctactgacttttaggggtgttttttctacttttacaaactccttattagggagattaatgtactgaaaatattctaacactttttctatagttttgtggttttgaaatcattttaaagaactaacaactatataatcatttaacagatgaatatattttattctactttaatccagccgttgaaatatttaaagggggctttctttgaaaagtagccggttcagaggcagagctcaaaatcgaatctggagtaaggtatgataatatctgacatttcagtacccctttgtagtttacgaaccacttctacccttatcttttaaggttgtattagttaggtttggtttggctgtagtgaaggaaaatggaatataacattgctttaagcagaacaaaatttctctgccccataaaagtctagatgagtggtctaggacaggaattggatcccgtggtgccagaaacataggctctttatgtagccctaacttcatggcccaagatagtgaaatctacagtccagacagaagggtggagaagtagtaaagaggacaaagacacacactcttactatttcttaagaacagtttcagctgctacaagacccttccacatatatcccattatccagaatgtcgtcacatggccacatctagttgcatgagaggctaggattattccagtttgacatgtgcccagataaaaatggggagtgggatcaactacaaacgaaggagaatgaatactggtgttcaaccagaaacctttgccagaaaaacaaatagagaaggcatcattatactcattataaaagaaaacaaaggccgggcgcagtggctcacacctgtaatcccagcactttgggaggctgaggtgggcggatcacctgaggtcaggagttcgagaccaccctggccaacatggtgaaaccccatctctagtaaaaatacaaaaattagccgggtgtgatggtgggcgcctgtaatcccagctactcgggaggctgaggcagaagaattgcttaaactcgggaggcggaggttggcagtgagctgagatcatgtcactgcactccagtctgagcaaaagagcaagactctgtctcaaaaaaaaaaaaaaaaaaaggtacaactattttcctattcaagatgtttgattaagcacatatcctccctcctgacatttcaccaaaaaaagaatagtaaaggggaaaaaggcataaactcataacagcaaagagcatggagaggggcttccatcagaagataaatatttttagcaaatttctgccagccaaaaagagcatgcaagaaattttgaagtttgtggaagaggatgaagtcaatctgcccagcagaacctaggagaggttctgggcttgagttgtcagataaggcagagaagaacaaaaactggaactaaaaaagggagatattaaagatctgtatatgaaacaattgctcctcactccacccacacgcacagaatacaagacagccacaaaattaccaccattaaaaagaaaaaaaaagaaaaatattcatctatctctaaagaaattacacaatggtctgaaaactgagaaagctggtatggctattggtaccacagataaggttaacaataactgaaaatgtcgctctgaaaaaatagaaatagttcaagacagaagagaactttaaaaaaatcatcaataacttcagagtaaagtgcccatgtaatttatcatcctacctgagaaaatttaaagaatgataacaatgagctattaatagctatgccaggaaaataaatataaaccatgactgtctcctatgagccaagatatatagatttaaataggtattgcatccataaatgagaataggatgctaagaaaaagaaaactcagaagagaaaaccttacaatcgacaccacataaatgcaaaggatcataagagattactataaataattatacaccaacaaattagataacctagaagaaatggataaattcctgggcacatacaacttaacaagactgactcatgaaaaatcagaaaatctgaacagcccaataatgagaaaggatattgaacctgtcaggcctctgagcccaagctaagccatcatatcccctgtgacctgcaagtatacatccagatggcctgaagtaactgaagaatcacaaaagaagtgaaaatggcctgttcttgccttaactgatgacattacctttgaaattccttctcctggctcaccccggctcaaaagctcccccactgagcaccttgtgacccccatccctgccctctggagaacaacccctttgactgtaattttccactatccacccaaatcttataaaacggccccacccctgtctcccttcgctaactctcttttcggactcagcccgcctgcacccaggtgaaggaaacagccttgttgctcacacaaagcctgttcggtggtctcttctcacggactcaagtgaaagaaccagtaacaaaaagtcttccatcacagaaaagcccaggacctgacgtcttcactattaattccacaaaacatttaaagaactaatatcaattcctctcaaactcttccaaaaaactgaagaaaagtgaacatttgtaaacacattttacaaagccagcattgccctgataccaaagccagacaaggacactacaagagaagaaaattacaccttaataactttgatgaatatagatacaaaaatcctcaacaaaatgctggcaaaccaaattcaacagcacattaaaaagatcatttaccatgatcaagtggaatttatacctgggatgcaaggatgtttcaacatacacaaattaataaatgtgatacatcaccttaatagaatgaaagacaaaagccatacgaccatctcaaaagacagaaaaaacacttgagaaaattaaacatcctttcatgataagaccttcaacaaattaggtatagaagaaatgtacttcaacacaataaaggccatctacgacaaacccacagctaacaacatatgcaatgggaaaagagaaaagccatcctctaagatcaggaagagaacaaggatgcctgctcttgccactaataatcaacatagcactggaagtcctaaccagagcaattaggcaagagaaagaaataaaaggcaatcaaatcagaaagaaagaagttaaacggtctctgtttgtaacaacatgatcttatatttagaaaaacctaaagattccacaaggaaacctgttagaataagcacattcagaaaagtagtaaaagtagtatgttcaaaatcaacataaaaaatcagttgtttcaatcagaaatggagagaaaaataaacttaaattaaaaataaaaataaaccagttctgcttttatacattaacaacaaactgtacaaaaaagaaatcgagaaaacaatcacatttacaatagctacaaaaaaaatacttaggaataaatttaaccaaggaggtgaaagatcttacactgaaaatgatgaagcattgatgaaagaagtgaaaggaaacacaaataaatagaaaaatatcctgtattcatggtttggaaggattaatctcattaaaatattcatactacccaaagtgatctacagattcagtgcaatccctattataattctaataacatttttcaaagaaatacaaaaaatcctagaattcatatggaaacacacaaaaaacaaagaaccaaaaaaaaattgagcgaaaagaaaactgaaggtttcacactacttgatttccaaatacactataaagctatagtaatcaaaaaagcatgatattggggtataagcataaaaccaatgtaactgaatgaagaatccagaaataaatccacacattgatgaccaattgattttcaacaaagatgccaagaatacacaatggggaaacaacagtctcttcaataaatagtgttgaaaaaactggatataaagatttagaagaatgagattagtcttattttacaccatatacaaaattaactcaaaatgaattaaaaacttacatgtaaaacctaaaactataacactactagaagaatacatagggggaaagctcagtgacattggtctggttaataattttttgaatatgatcccaaaggcaagggcaacaaaagtataaatacacaaatgggattacatcaaactaaaaagcttcttcccaggaaacagtcagcacagcaaagaaataacttacaaaatgggagaaaatatttgcaaaccatacacctgataaggggttaatatccaaaatacaaaaggaattttatttagtagttaggaaacaataactaaatttaaaagtgggaaaaggccctaaatagacatttcacaaaaaaatacatacgaatggccaacaggtatatgaaaaaaagttcaacatctctagccatcagagaaatgcaaattaaaaccataatgagctattacctcatacctgttaggatggctattactaaaacaaaaattaaaaaatgaaaaaacagaaaataacaagtgctggtgaggatgtggagaaaagggagcatttgcacactgttgatagggttgtaaattagtgtagccattatggaagacagtatggacattcctcccaaaaattaaaaatagaattacaaaacgatccaacaaccccaatactagctgtatattccaaggatgtaaaatcagtgttttgaagagaaatctacactcccatgttcactgcagcattattcacaatagcgaagatatggactcaataaaaatgtccatcaatggatgaatggataaagaacatgtagtatatacacacaatgaaatatgatttggcctttaaaaagaaggaaatcttgtcatttatgacaagatggatgaacctagagaacattatgttaagtgaaatcaactaagcacaaaaagacaaaaaccacatgatttcacttatatgtggaatcttaaaaagttgaactcatagaagcagagagtaaaatgatggctaccagggactaggggtataagggtgaggattgcaatatgttggtcaaaggatccaaaatttcagttagacaggagaagtaagatcaagcgacctattgtacagcatggtgactatagttaataataatgccctgtacactttgaaaattgctaagaaagtagattttaagtatactcaccccccaaaattatttgaggttaaaaaataaaaacagatccaagtgatgttacaacaacttttttcatatttcatgtaaataaaggcagcattttgcattgggaaaaaatgggttatgagccctcacagagggaccaactagactggaaatttttggtgcctgttcctggctgtaccaggaagtcaactcaggtcaggactacatcagcagagtggaataatgaaggtcattctctattctagataattcacctaagaagaaacattttgccagaatgatttctgggaaaaatcaatttgaaaggatatcgtgtacttaggaagatctgtaagagggttacagtaagctaagagaaaacataaaactgaagacagggtctctccatgaagatttaagctttcgtttttaacttttattttaagttcaggggtacatgtgcaggtatattacatagataaacttgtgtcatggggggctgtcatacagattatttcgtcacccaagtattaagcctagtacccattagttatttttcctgattctttccctcctcccaccctccaccctctgatagaccccagtgtgaattgtttccctctatgtgtccatgtgttctcatcatttagctcccacttataagtgaaaacatgtggtatttggttttctattcaggtcttaactaactgtaaaccaaacctaaacacagtaactattctacttctcataagagaaaatcaggaaacaaaagatgcattttcttaatgagtgatttacaacatttgtaaaaagtctttacagacatagtgaaggcacagttaagccaatgtcttgctaagttatacaaaaatatgtaagtattttgtgcaatgccacgtaaattatcagagttaagtaaaagctagctattcttgtcaagagaaatacgaggtttgggagtttattttctatataattgtatatattctagactaaacgctttttaatgcaccccgattctcttggtgatgtattttgccaagcttcaagctttcacattacatagatagatagatagatagatagatagatagatagataggtagatagataattgtctctatcttattcctaaacgcaccttcatacttggttttaagatgtttaaatcataagtaaaggctcataacctgttgcaattcattcattcaagaaactacttactgtgacaatgctttaacacagtgaggggtcaaggtagagaaatgagccgtaatataggcctcggccgatgtgtaggaagaggcagatgaagaatattgaggcgccattggcgtgaaggtagcggatttctttgtaaatcaattattcacattccatagaattaagtgagacttaacattgcagctgtagcagcatctgtcaggcattttttataaattttgaaagaactacaccttgccccataaaatcatccatcctagagttatgaatgaatgataacaataattaaaatgtatatagtgtcttcaagtttgttaaacagttttctatacataatatggtggttccacagtctgattcaaaatcctggctactattttatatttctgtggcctttggcaagttattgaactcctctgtttatcagtttcctcatctgtaaaatggaaataataataactgtgtaataggtttattataaggataaaacaatgcttacacaatgtccagcacatagtatgtgataagaagtttttgctattattattatctcatttgtgactcacaaaaactctgtgaactagacaggggagagatttgtatccatgttacataggtaagaaaattgaggcagaaagctttcattctgcttttttcttctggattctataatgtatccatttataaagggaataattattcatttatataggaacaaaattcaaaattgaactacttagttttgcttacttgtacaataaaacaatgctgggagttataatttttttttaaaaaagtaagcattttaaaacattagtcatttaaaaatacgtattgagtctctactatacaaaggcacttagtgctatagaatgtttttaaaaaaagaatttggaattagaccacatttcacatatttagccaaaatttaacacatatagaaattatttgtttttcatgccaacagtggtaaaaataaattctataatgatgagagtataaaaaattacttactggagcaacatgttcaataaggaaaggatttattgtaaaatccactacctcactagtagtttgttttaaatttcaccactcatgaaggtgatgagatctcagtagactttcagccctatgtagtttattgggaatctcatttagtaatagttaagatttgagtacgggagtaatgaattctaggactaacagggcaggtctgcataccaaagcctggattacaccagctgggtattgtggtccttaatgtatttgtaaaaggctcatttaaataacgctctctaattcagaatcctctaaacttaaaatctatcataagtcagaatcaagttgagcaattgtttacctttttactctctgactctgcaaaggaagattttatggagaataagatcgtaaggaaaggcatgttctacatactcaaaaggaaacatttaaaatgaacttctagtctccttaaaatacacataaaacatgtcatttctttcttttaataaatataccttttatattctaataaatataccttctaggtatatttagtatataaatgtatacctaggtatatatatttattaaaaccaggttcattgatttgaaagataaaaggtatatttatcttttatatttattattaattactaaaagataaaaggtatatttattatataccttttggggagacaaacattctgtccataagattgatctataattttcattttcatattgtctttgctttaaatatctagtttctacttgattcaaaactacctatcggcattttctattttctctagaatattttgcatttaatggtgattaattgttccttaaaagtgtgataaaacttgtctataaaattatctgggattttaaaataaatttttaaaagtaagaatgatttttataggtagttttaaaactactgattatgatggcagcggtggcccatctggagatgctgagaagatgccagctgcagtgcgggaggcatggccagggctgcatgctccactggccgaagtcggtgggagccgggaacaggtgggagccccacccccttctcagctggcagggcaggagccctgcactcccgggtgtgaaagtatgtttagttcatattattaaacatggtttctttctgggtaggggaatttggtatgattttttccttcttgctttatgcttccagttttctatattgcttaaattaaatagtagatatataattctgataaataataaaattattatttttaaaagagcttttaaaataaacttaaaaatatgaccatcttctccgccataagtctggcttgtttttggtgagggatgtgggagtcagcacgaaagggaaattgtagtacatgggtcaaagcaaagaggaaaagggagcaagtagactcttcctgacctttctggctagtattttctgagttcttatcatgtgccagactgtaagactagccccattgacaagtcttgcagtggcttcttctataaaagcagcagcaacctcaacaaagaaggaaatcctgccatatgatatggtatgcatgaaacttgaggacattatgctaagtaaaataagccagtcacaaaagggcaaatactgcatgattccacttacctaaagtatcaaacatagtcaaactcatagaagcagaaaagcggaatgatggttgccagaggttgggcagaaggggaaatgaggagttgctaaccaatgggtatagagtttcaggcgtgcaagatgaatgggcacattaacaagtgtaatgtatactcaaaactttgttaagaagttagatttcatgttttctttttaacaataaagaaattagagataggacaagatggctgactagacgcatacaagtggaacagctcccctggagggactgagatgactggcatgcttttttgttgttgtttttttaataattgtctcatttattatctttctttttttttcatatatactttaagttctagggtacatgtgcacaacgtacaggttttttacctatgtatacatgtgccatgttggtgtgctgcacccattaattcttcatttacattaggtatatctcctaatgctatctctcccccctcctcccaccccacgacgggcccccgtgtgtgatgttccccatcctgtgtccaagtgttctcattgttcaattcccacctatgagtgagaacatggggtgtttggttttctgtccttgcgatagtttgctgagaataatggtttccagcttcatccatgtccctacaaagtcatgaactcatccttttttatggctgcatagtgttccatggtgtatatatgccacattttcttaatgactggcatgctttaaacagatcttcagagggaaggtgctgagggtggatggagggaagacacagaagctcagctgaagagggagaaagttggcacctgtagggccaactctactgggaggttgacagcgtttgatgtgtccccaggcattttctgcttcactgcttctcatgattggctgtgatatgactggccagtacccaaactctagaataagctagagaaactctaggaaaaaactttagatttaaggtttccatttctatggatttggggctttgtcttttgttttttggggtttttttgagtcaaggtttcactctgttgcccaggctggagtgcaatggcgagatctcagctcgcttcaacttcaacctcccaggctcaagtgcttctcccatctcagcctcccaagtagctgggggtttttttgagtcaaggtttcactctgttgcccaggctggagtgcaatggcaagatctcggctcacttcaacttcaacctcccaggctcaagtgcttctcccacctcagcctcccgagtagctgggactacaggcactcctcaccatgcccagctatttgtattttttgtagagatagttttgccatgttgcccaggctggtctcaaactcctgaattcaagcaatccacccacctcagcctcccaaagtgctaggattttggggggtttttttgagtcaaggtctcactctgttgcccagactggagtgcaatggtgagatctcggctcacttgaacttcagcctcccaggctcaagttgctgcgtgtggtatgagccaccacacccaaccaggtctccatttctttcccacagcaacctcccatattattcatttaaaaaaatttctcattaactttaaaggacatattatatggtaacatagttactgtggcttaacagccatcaggacatcataaatcagtctcctgaaatgcacattctagaggattatattgagtgcatatctataaacacatagccacaacaaaacagactctctgagcttgagtacttaaaacacaatggaggaatttggaggccattccaatgagaaaattacaaaattttatatctcccacttcctgaggtgataacattcccattaatacctgcaacagcaatgttggccttcccatactctacagacaaaattgaaaactaaagtctctgttcaattgattcaagataattattaaattttaaaatgaagcagtttaatctgtttaaaaatagaagctccaggatagacctttaaattaaaatatatttttgtccttgtaaagaaaactttacaaaaaaagttgtatttattatagaattaaaatggtatgaattagcaatattatattttagaaaaataaaaagaattgaaatcgatcatgtttgtttctgagcctgtcttatagaatttctcactttatttctcaagttgtaagaatatgttcatgttgcaaggcagttagtagacaactggctgcttggggacaggacttctgtcttatccatctttatagtccatagagccaaaacctggagtatgacatccaataaatagctactgattaacaaatggtgcttcacagaatattaacctagattctccaaaatttgagacatctcatacaatttagaaaagtacacaggcatgagaatgggtttacacagcttaatataattacaaacaagtactataccataagtcttattaattcaaacactggccaggcgcggtggctcacgtctgtaatcccagcactttgggaggccgaggcaggcagatcaagacgtcaggagttcaagaccagcctagccaatatggtgaaaccccatctctactaaaaatacaaaaattagctaagcgtggtggcacacacctgttatcccagctactcgggaggctgaggcaggagaatcacttgaactcaggaggtggaggttgcagtgtgccaagatcgcgccattgcactccagcctgggtgacagagcaagactccgtctcaaaaacagaaattcaaacaccacatgtgaatattagattaatgatctggagcagcaaaatagagaataaaatgtgttaacactgaaacacaagaagtggattgcgtcaaattgaaaagatgtaaagcttttggtttggaaaactcattaccttactcatttcagctacaagtgaaaaggcatattttccaaaggcacaagtaacagcaaacagattcccactgatgggttttttgctctcaacacaaaattatacaaatacttaaaacctgagacagtcaacaaattgaataattcaggcaaaagattacatacagtgccaattttctttcagaaccagaggaaaaagtaaattacatagtttgggtttttttggttttttgatttttgttttgactttcatctgagcctttgacttttaaaagatcattttgaccagtattatttttacaatgctgttaacatgctactgttttgcttgttttcctttttttctctctgtgaatcaaaggtattattaggctgttcttcctaaagaggaaattgtgataatgaagctggagagaaaaaatttgagccacaagcccttttgatgtgactgtttgactctcacttgctgtatgtattaatatggcataaacatataagttttgggggcatttgtcacctgggggatattgcaggattcatttaggagagagggtcaggagtcttgccaagacatctttgaaaaaggaaatctaggactgtacccaaaggagagtgaaacagtcactgttccattactgctttcagaagcctagttctgcagatgactgagtttgctctttctgggaggaacccaatacatcctagggaaagaatcatctaaagatggaatgaggaggaagggaaggaaatcagggaaaagagaagaagagaatccattcttatattcgagctacttttctctctctagaattgtgcaagtctttactagaatgctgacaaccaaacaagcatgcaacgattacttaaatgttgcactcattcttgcttagatgttgctgttagccagaagcccatgtctgaatctcataattgttctttcagaataaaggatatgatttaatatatagaggagagaaaccaactggacctgaacaatgggggtctaacactagtgtccaccagagcacatgggaatggcgtctagaggtcatgactacagtgacttttggaatatcactaagaccttgagaagcagcttaggcagacttcagaccctccaaggtaccaacaaaatatttttttcctctacagcaggtgcccataatcagaatccaaagaaccaatggcccctacataaaatttaggctgtctatgaacttgtatggggaaaaaataacatctccatttccaataacacccaactgaaatttagtataattaaattgccaatgtaggcaacaactatagaaaaaattagaaatcagatatttccatcaatatagagttgttacaaacatttcaagatattatttatgctcatccctattataaaataatggttataggtcgagcacagaggctcacgcctgtattcccagcactttgggaggctgaggcaggcggatcactcaaggtcaggagtttgagaccagcctggccaacatccttaacgggtaagagatttaccagatttcagatatctaattagactccctttctcaaactctcctctaagatagttgcctgatgagtagtaatccaggtaaaactccaaggcctgctctgatcctcttagctgcatattcttttttttttcttttttttttttcttttttagatggagttttgctgtttcacccaggctggagtgaagtggtgcgatctcggctcactgcaacctccgcccccaggttcaagtgattctcctgcctcagcctcccgagtagctgggattacatgtgtttgccaccatgcctggataatttttgtatttttagtagagacaaggtttcaccatgttggtcaggctggtcccgaactcttgacctcaggtgatccacctgcctcggcctcccaaagtgctaggattacaggtgtgagccaccgtgcctggccagctgtatattcttgtagagctcatgttaaagctaatgaaaacatctcatgttaaaaacataaaactaagaagaaagaacaacctaagggttttgaattggtgcgtaagctttctacacccagtaacttttgggtatgagtttagggcatttcggtccatgtctagttatcaatgtaaataaatcactgcaatttagacagcatcatggtcatcatccaaatcattttttcttcagaaagaagactatgtagttcactgagggggaaaaagctagatataaagtgaattcccattattggggaaatggttgaaataaattatggtataatgacaacatggaatactatttagtcattataacaatagattagaattaagctattgccttgaagatactaacttgaagtattcttggatgggaaagatattttgtaaaaaaaaaaaagtaataaaaacaatgacccaaatcctctatgtgaatattatcctgtgtacatgtatgtgtatatgttcatataagattgtaagaggatggagaaaactataaaatcatacatatttggctattaggttcttcttaggcagaggaaaggagaagaaatgaaggaatttatgcaaaaatgggaaataaaaacttcaattacaaataacatatatatcataatcacattcatacattatataaaagagaaaaatcaattccccatattgaaggaaatgaaaaagaagaaatcagagtgaataaataaggtaaaaacaattgaggagtaggaaataatcccagaacagcaaagtaagatcctccaaaaatctactcctccacaaaagcagtgaaaacactgggaaaaaaaactgtcaaagttaatttttttttactagagagcatctggaaagatggtgggataggaaacaccagcaatctgtctccccacctagacaacaattgcactggcagaatctgtctgatataactattttggaactctggattctattgaatgtttgaaagtttcagaggtgggacagagcagttaaaggaacagagtttttgtttgttattgaagttaaactggtataaattcaagttagagtgctgtaactttaagatgttaaatatgatgccaatggtaaccataaataaaatagctatcgaatatatatatatcctttgagattttatatatatatatatgacaaaggaaatgaaaaaggaatttaaacgtttcaatattaaaaaaaaaactaaacacaaaagaaggcagtaatccaggaaatgagggatgaaaaaaagctacaaggtatataaaaaacaaatagcaaaatgacagaagtaggtcttcatcagtaattactttaaatattaatggattaaattttttcaatcaaaagacagagattggcagaatgggttaaaaaaaccataatccaactatatgctgtctaccacagactcactttagattcaaagacacaaataggttgtaagtgaaaggatacataaaaatattccctgcaaataataaccaaaagaagagagtgggatgactcacttatgatggtttgacttttataatttttcaactttacaattgtgcaaaagtgacacacatttaatagaaactgtattttgagtactcatataaccattctgtttttcactttcagtaaggtgtacaataaaatacacgagctgtccaatatgttattataaaatagggtttgtattagatggtttgtccaactgtaggctaatgtaaatgttctgagcacatttaaggtgaaggctaagctaagctacaatgttctataggttcgatgtattaaatgtatttttgacttacaatagtttcaacttacaatgggtttataaggatataactccataataagttgaggagaatcagtatccacaaaataggctttaaatcaacaacggtggctgggcgcagtggctaactcctgtgatcccagcactttgggaggccaaggtcaggagatcaagaccatcctagccaacatggtgaaaccgtgtctctagtaaaaatacaaaaattagccaggcatggtggcatgcgcctgtagtcccagctactcaggaggctgaggcaggagaatcgcgtgaacctggaaggcagaggttgcagtgagccgagatcatgccactgcactccagcctgggcaacagagcaagactccatctcaaaaaaagaaaaataaatcaaaaatggttagaagaaataaagaaggacattttatattaataaaaggttcaatataaaaagaagatacaacaattgtaaatatttacacacctaatgacagaccgtcaaaatgtctgacgcaaaaaattgatagaactgaaagaaggccaggcgcagtggctcatgactgtaatctcagcacttcgggaggccaaggtgggcagatcacttgaggtcaggagttcaagaccagcctggccaacgtggcaaaaccctgtctctactaaaaatacaaaaattagccaggcatagtggcgtgtgcttgtaatcccagctactcaggagactgagtcaggagaatcgcctgaacccaggaggcgaaggttgcagtgaactgagatcgtgccactgcactccagcctgggcaacagagcaagactccatctcaagaaaaaaaaaaaaaaagaaagaaagaaaaaaagacaagaaacagacaaatctacaataatagttggagacttgaataccccactctcaataatggatagaacaactagactgaagacaagtaaggaaacagagaaataacacaattccacttctaggtataaacccaagagaaccagaaacgttttcacacaaaaacttgcacgtgaatattcacagaagcattattgataatagttttaaaaaatgtatatgcaatcctaatttccaacaatggatgactggataaagaaaatgtgatagagccatatgaaggaatattactcagcactaaaaagaaatgaaatactgacacatgctatatcacggatgcattctgaaaacatcatgcaaaataaaagaaggcagatacaaaggaccacatattgtctgttgctttttatataaaagtttcagaataagaaaatccatagagattgaaactagattagttttggccaggagctgagggaaaggggaaataagggacagggaatatgccttttttttttgcaatgatgagaatattctaaaattagatagtggtgatggtctgaaatagaagattcaggatccggttatcaaagatgtgataagagaacagaacactttaagctttcagcacatcaatttactctcttgtcactttaactcctcatcagagttactaggttattttattgtgttccatattatcttttacccaaaagatcttggttggcaaaagtttcccctttccttaaagttaaatatatatttaaatagttataaaatacataaggaaaaaatggtgaaaataaaaacccagatatagaatacaacctaaaaaaagtccttgctgaaacatagtatgaacattaactatgggccttttcctttttcacattataatttgttttcaaaatgtaactaatgttaactccagaagtaccagatgtcacataaagcttatttcactttcacaaaacctaactgtactacatagtgtaatatgggggtattctggttaaagctttacaaaatgcaggattctatgtcttggcatgacatgaagaacccccaagaaaaatgtcttagggaaagactatttcttggtattttcctacccaggatatttgggtagaatagaatgaatgtctggccattgtatttttggactgaagtatatttaaatagcttttacatatgccaggaattgaaaataacatcttaatttgagcataataaaagaggaggataaaaataaactctctgctcagtgttaatacagatctaagacattaaatgatattttaagtaaaactggtgaaataaacatcaagtcatagaagtgtgatcaggcacttctagcaaaagtgataaatcatatattaaaatttaaaatgactatagttcatttatttattcattcagctaatattttattacacattgactatacagcaataaaaacaacaacaaaataatctactctttcttctctcccagaacttaaaatttgtttaataatgttacggcaaagaaaacaataagattaaatgatgatgaaaaacttgaaagagcactgatcttggagtcctaagatctgaatcaaaatttcatgtctactaattactaggcaagtgatactggatacatcaactaatttctctaagcctcaaattcacaccgtgaaaaatggggtatgctactacctgtctggtgtatttcatcagttaattataaggatcacagagaaaatattcaaacattccctaaaaactctaaaagttctataatcacaggcttgcattattactgaaatgtatggaaagctatccaatttcttgcaataaataattttagttgatattaacagtatactgagagtctatgtggccagacaggaaagactaatgctaactgtcaagtacattaacaatataaaatgacacatatgctagggttttggcctttctccatttagccattctaatttgacctggatttcctctacatgtcaatttatgctcatattcacaagcaatgttccaatcataggaagagcaaatgagtcagacagacttctatcaaacttccaatctgagcaacaacagccacatgtttctttactcttcaggacatgtatttgtcaatcctgtttgaatcttaacaaataatggaactttcaaaataaagacaaatgcacttagtagaagaaaataacaattactgtaattgcaaccacattaacttgactgagtttttgtttaaattacttctgtacttctatgaaaaacactgttcttaagaataatgaagtgcttaagacatgactgaaaaataaaacctcacaattaaacccatgaggaaaataaatttaacttggcataattctggtttgcaaaaatactgtcaggtaatgaacccaaatccatatgaatcactggtaaacactatgcacaacaaacagttaatacctataggtgctctgtgaaacagtggaatccaaactgtctgtctcttttgggttggagaaatagaataatcctgcttttcctcaaacactggcaaacatatactatgatagctaaaagtcaacttaatccttcctttcctggctcaaaataaaaataaatacgccatctcagacttaagatgtgatatccctttgtgggttttcatgaaagagagagaaacacacaagaaaatgatcatggttggatgggctttgtgtaattttcaatcacataaccttgttttagaaagtagaaatgaagagccaagacaactatggagaaaattctggcagtggctgtactgtgctctgattattttttattagcattggttgtatcacacccaaagcttcttggcattttccatacaaatccactcccaccgagtattctgtattccggaagggcagtaactttatcaaaaggtagagtcacattccagagcatatcatctgtcacctctcaccaactcaccacgccccatgtccacactttctgtcttttctctctcccagctcttctggaataactaacaaatccttccctttgccctcatgcagaagagtttggcacatgccatttttctcaaggtgtgatttttttttttgtcattcaccaacatgtaaaataaattttacagccaataatagcaggtgaaaagggaagcaagatgaaaaaaggacacatgaatgtctcaaaaggaaatagggggctgggtgcagtggctcatgcctgtaatcccagcactttgggaggccgaggcgggtggatcatgaggttaggagttcaagaccagcctgactaacatggtgaaaccctgtctctactaaaaatacaaaaattagccaggcatggtggcgcatgcctgtaatcccagctactcaggcggctgaggcaggagaatcacttgaacccaggaggcagagattgcagtgagctgagattgtgctactgcattccagactaggagacagagagactccatctcaaaaaaaaaaaaaaaaaaaaaggtaaatagggggatagctcccattaaatcactcagcatcctgttattgaattggtcctcctgcaagggaccaaccacaaagtcagtgacttaacttacttattaactcaaaataagtaacttaaaacttcaaaaacttcaaagctgaagcgcaaactttcacagatgaaccactacaaaatcaatgccactatactggggcaagcagcataaattttcagacctcagaaatattgaatggcattgatacgttttcatttcttactcagtcctacctgaacatctgggctaatggcatttcatgtttaagaatagggcactcagcagggcgcggtggctcacgcctgtaatcctggcactttgggaggccgaggcgggcggatcacttgaggtcaggagttcgagaccagcctggccaatatggtgaaaccccatctctaccaaaactacagaaaaaaaaattagctgggcgtggtggcgggcgcctgtaatcccagccactcaagaggctgaggcaggagaattgcttaaacctgggaggcggaggttgcagtgaggtcagattgcaccactgcacttcagcctgggtgacaagagcaaaactccgcctgaaaaacaacaacaacaacaacaacaaacaaaatagggcactcagctacgcttaccaggaaactgagtggagattttcctgtgtgaccggcaagtgattgtgaactaaaagcattggttgccaaacttaaaaacctacctgtgggacattaaaagcctctagcatgtatcacctttggacttacttgtattcctgtgactttggtcccctgggagagaagcatccgtagtccaggctggaacgtgttggtcgggatgtgcagtagacaccacagtgctctggttataaattgtatttgtaagaataacatcggacccttggatttcaccatcagtgaccaaaggttcactcccatttgatttaaaatagaccttttgtaatgttcctgaaagacaaaaacaaacacaaaaaaaacctatctttgaaacattactagaagtgtttattttaaaaaacattaagaaaactctagagctactttccctatgtcattctaaccaggtaaacacaaagacgaagatgaaagccgtaatagtgacctccttcttggggtcaacaaccacaaaaccaagagtttctcttctaccacaaatcacacagccctgtgatgaaacatggctttctcaagagcttacggtttagaaactgggtctcctatcaaggtttcctggtgcttcaaaaatgtagggtaattctacctcacctgagactcaccacacaataaaatgtggtgaatcttacagcattctctttcacttccttagtttcttaatctcaccggtcattgtttgctactcaggacccaggacatgtgctctacctctctctgtatctgtcatcaaaggacacaatggtgcttgccatcagctttatatttcccacattttgcactaatgttcagtaaactatgcatcacacacaaataaaaaataagagggctcatacatttatcaaaacttgtatcataggaaccaaaaaaaaaaaaacctctaaagcacaaactaaaagaagaaactaaattatcttcatcttcgaccagaaaataaaaatgtaattatatgaaataagaaatactcatttaaaaaatttatttccataggttattggggaacaggtggtgtttggtaacgagtaagttccttagtggtgatttgtgagattttggtgcacccatgcaccatgcaaagtttggcacatgccatgagcagtatacactgcacctaacttgtagacttttaccccaactctctttccacactttccccgagtccccaaagttcattgtgtcattcttatgcctttgcatcctcatagcttagctcccacttatgagtgagaacatacgatgtttggttttccatactcattaaactaagattatcaactggccactttctcaaggtatccattcattgacaaaacaaagaaccaaacctaagattattgaaaaccaccttgctttgtctttaggaagaaacatttgaaaactttgaaagagatcgtgtatttttaactcagtcaaaatagacagcagattgtgtttccagaatatcgcactgtacttgagcatgccacgaaaataaatgaatgtgatattgacccatcgatagaaagagccaagggagattttcttttctaaaagcatttacagtgaatgctctaattggctctcacttttctaaatagtcccaaggaccattaaaaataaaagaaacataaataaaatgtttaatatcagtctatggaaacaatttctctacatatgcttgacacttggaaaacattaactacaaataaaaatagaaaagcagctgtttctagctaactgagatcaacagtttcctctgccaaaagattgtaaataaaacattgaagcataaaagctaaatcatgatcatgtaatgcgggtaacatgctctccaaaccatctgtgtgatcatgagtaaaagtcaaatgcagtaggtaaaatgaaggaattcatttaattgttattgattttcaaaatgatttagactttatcctaatcaaaataaatgtgataggtttaattactataggaaatgtatttcacacatacagaataattagtaattaatcaattacctatagttttccttacatccatttgttaattgctctcttccttgcttatttttggcataaagagattttttccataaggtgatatttatgctaatgtggttgtaatgaatatataggcccattaagttgatttacttatcttgctgaatctatgagtaggcatccagttctgtcaacatacttttagcaaatgccaattgttcacggttgtaccctggagtaattcccttaaaattagttccttctcatataaaatatttgaacacttgttcctaactttttggtaataattagccttattaataatctttcctttgtcattttaatatttcctttatcattttaaccaaacagtgtttaaagtgttcataacatctggctgggcacagagactcatgcctgtaatcccagcactttgggaggccgaggcaggtggatcacctgaggtcaggagttctagaccaccctgacccgcgtgaaaccccgtctctactaaaaatacaaaataaaattagctgggcatggtggcgggcacctgtaatctcagctactagggaggctgtggcaggagaattgtttgaacccggcaggcagaggttgcagtgagccgagtttgcaccattgcactccagccagggcaacaagagtgaaattctgtctcaaaaataaataaataaataaataaaaataaagtcttcataacatctgtttatcctaagaagtcctctgaaacattgacatttttaagaaaacactgacttggataacaactttcttttaaaaaggcagcttcattgctcttaagctttatgtattgaaagcaatttggcagaataaaaagaaagataatatttgagaggtactgtagttaatgtttttaaagtatattttgggggaagagaaacagaataaacttaaaggacatgtctttaaaagcctgaactcactggacaacttgttttcaagtatctctggaagctgaccaactcccaacacggttgtctactatgcattttcttttaagcacaagaattagaactcaataaaactaaatgctttcaacctgtatcatgatgagctataaaaatgctaagaggccgggcgcggtggctcacgcctgtaatcccagcactttgggaggctgaggcaggcgcatcatgaggtcaggaaatagagaccgtcctggctaacacagtgaaaccccgtctctactaaaaatacaaaaaaaattagccgggtgtggtggcgggcgcctgtagtcccagctactcgggaggctgaggcaggagaatggcatgaacccgggaggtggaggttgcagtgagctgagatcgcgccactgcactccagcctgggagacagagcgagactccgtctcaaaaaaataataataatactgctaagagatattagcccaaagtagagtatttattcttctaatactgcctcattcttttctacatttctatgtttattgtgctatggttaaaagtacaggtttaaatcccatctctaccacttgccctgaaactttggacaaagtcttaactgccataaaggaaggaaaaataaaatacctcttcatggggctggctgtggtgagacagccaagtaaaaatggctccccggcagaacccccgactggcctgcgcactgggaggagcgtgcactggggtggagcctcaggaggttcacaccgtttgcagaggtgaggagcctggcctctcctgttccggggtggtatttgggactcaacttgtgaggcaggaaactggctagcaggactgtcattttgctgagagtccctgtttcccttttttttccccttttagcccgataaattccagttttctcaccgttcaaagtgtctgtgagcctaatctttcatggctgtgtaacaagagcccagcttttaggtgaactaaggagaaagtcctacaacattgggatcaaatcagtcaatacctatataaacacttcgaatggcttttggcactaagttctccgtaactgttagtcattactacacattgatggtaatgacaataaaattgtcttctttaggactgctaaggtacttttagataaatatcaatttcattttactataagtggatcccagtgtcacaaaatggctaactttcagaagtgaatcacttaacccacatttggagtgagaaaactatggctttttcgtgctaaattattaatagaaagtcacattgtattaagatagtctggctcaaaagtgtttcagctctatagccaaaaaaaatgtaatgatatttaagaaatagtatataattctaataataataatagtcaaactttactgattccttgtaatgaagagattgggcactgtggtagacagaataatgctcccccagagatgccacatcccaattcctagaacctgtgaatattctgctttacatactttacgtggtaaaagggatgttgcagatgtgattgaagtaaaaattttgagatgaagagactatcctggattattcaggtgagcccaatgtaatcacaagggtctttataagcagaagagggagataagagagtatgtgtcagggtcatgaactgtgagaaaaactcaatggaccattgcttgttttgaagatggaaagagccacaagccaaggaatgcaggaagccctagaagctagaaaaagcaagagaatagattgtcccatagagtctgcagaaggaacacctaaattttgcccagtgagacctattttgaacttcttaactctaagataataaatttgtactatctttttaagctaccaagtttgtggtaatttgttacaggagcaataaaaaattaatacaagcaccttgctaagttccctcactataggcatcaactgagttaaccttccaataatcctataaaacagataatataattaatcgtttgacagagttttagagagatggaaactgaagtttatgagagtgaattagcttgctcaagatttgagttgggacatggcaaatagacatatacatatacacacacttttcattctggacaaaacatacaggttttaaaagtcaaccattatgtgcttgcagaatttatcttcctataatgtgattttaaaattaatttcttagctttgtatctttagccatgtgaaacacatttactttgcattttctatgtgccaagaacttcatacttactctgctgagaacacaatatttagtaagaggtccttactatcaagatgtttatagattagttgagggagacgggcaggcaatctaaaaaatattaatataaactatggtacaagtgctttgagaatgatatgcctaggacaatctggtagcaaaaagtagagagatagtcctcattccatttgaaaaagtcaggaaagcctgtttagagacgagtatcctaaatgtgaatcttaaaagatgattagggattttctaggtttaagcaaagtatttgtggggaggagagtggcgtggcaagaggaagtgaaacattttctagataaagccaagggaaaaacatatgaaaaggcccagcagcaagtaatttaaaaacatggctagtacacaggagcctggtaagagaaaagactgaaaagggaagagacaccagacaggataggtcttgtacaaggcttggaatttaccttgtgatagaaaattttagaaaggtcttaaatagggtgaaacatattagaatgatcactttggcagcagggtgacgtttaaaagtttagagggtagttagaaggctattgtaatactccaagtgagaaaagagtaaggccttagccaacgcaaaaaccctatggacaaagggaacattaggagaaagctccaaagatgcaaaatcatatgaacatgagagaaaggtcccttcgaggtctctggtttgaataatgtagtaaacaaacatatccccaactgaattggtgtcatatcgttagtgttgttcatcaaatatttccagttctctctccttctactggggcataagctgagcattgcattctctggcctcttgagtgaggccttgcttcaagttcaaggctataagcaaaactaaaaagtgttgcttctaggcagaagcatttaattgctgatgtaagagccttcagagctctgacacaatcatcacaaaggctcaagatggtggctagttcatcaatttggaccctgaaggacctcgatgagcacaggccccctgccatcttgcaaaggacatgtagtattgtaataaattaactattgttgtttgtaaatcaccagtattgggggatttgctgttgttacatgacagagtctagccaatcttgactaaaacaatagataacagagaatgaaaaatagatttgtagaagcctgttgttgttgttgttgttgttgttacactttattgaatataaagggcctgtgaaacattcaggggggaaaaagcccaaatctgaagcaatctgatgatttcctccagatgcctcaccagactcccccacaatgctgtccctcctttgtgttcccagagcacgcactggttatattgtagcacatatgcactcaagtggaactgtctgtcccatgcatctatacatcaatccccgagcagaacacctagcaccagtgtagggctccataaatattcgttgaacgtatgaatgatgaatggactaatggaaatggctgatattgccaagaggggtatcagtgtaaagtgagaagacagctgaggacagacagctctttttaatgccatttaatggacagttaaagaaaggttagcttaaggaaaatgagaaacagcaggcagagatactgaaggataatcagaggtgacaatatgaaggcatagttgaagagcataatgagatgaaagtagtactcaacactgaggaagatcatatgcgcatagcacatctggggagaagaaagcattgctggcaccaactaacaatgaacattcttaccatgaattgatgtacacagacacagagagaaacataggttcttcatttcaaagtctcgttcaaatacacattggtttccaatgcagcacattggataaaaagacactggtgggcttgctaagtacagatataggagtatgaaaagaagtgaaagagatgatcagaaggggactgatagaggtataggaatcatctggggtggttcttgttagaattcaaattcagcaggtttggagtggggactgagattctggattctgcattttacacaaacttccaagtgatgctgatgctgctcgtccatgggccacacttgagaacaaggctttagactaccatttcaaaaagctttagacataacatataacctcgggcctcagtagttaaagaaaaaaaattgtcatgcttgagaatcctccgctggtgaatctgcaacagaaagccagatttattcaaagaatttgaagtcttaagtaatgtggagtcaggtcatgaaagatcatagagaatcttaaattttgggtgtgaagaaacaagaatttgggaggttttctatttttaagtgatactaagaatacattataagttaggaagttaagattcttttaactccaaattcttgtaaaagccacaaactgctgagaaatttgctaagagaaaactgtatttaaattcaatgatctccagttcatctagcatttttgaggagaaaggtcatttctgaagagaaatatttttatcgaattcaagaaaaatgaatggtttattaaactttctatagtctacataccactataatttttcttttttcctcatttactcaaaaaattaagaagccacacatacattttccatcatattaagaaaactagaaatgtaattttaagctagttttcataagcttatggctaaaataaatttgttttagatatatatggatgagtgaataagcagatgaatatttaaaaccaagtcttcgacaggctgagaaagaaaaagtcaggagaattctaatgagaatttttggaacataacttgggtgaataaattgagatgaagaatagtttgaaaaaactaattcagaccataccccatacatttataggactccctgccacatactcagctgtaaccctttctccatacagctgccaatgacaccttttaaagctgaaacgctttctccatacagctgccaatgacaccttttaaaagtcccaaccaagataatcatttccaagaccttgaaagagcttttttttccgatgttttcttctaggagttttatggtttccagttttatgttttagtctttaatccattttgacttgattttggtatgatggtataagataagggtcccatttcatccttttggatgtggatatgcaattttcctaacaccatttgtcaaagagagtattctttccccctcgtgtactcttcacacctttgttgaagatccaatgaccatatacatgtggatttatttctgggctctatattctgttccattggtctatatgtctgtttctattctagtgctatactgctttgattgctgtagcctcataatatagtttgaaatcagcacatttgatgcctctatctttgtcgtttctgctcaaaatcgctttgggtatttgggatcttttgtggctccaaatgaattttaggattgttttatctgaaaaatgccactgggatttagctagggactgcattgaatctatagatcactctgggtagtatggacattttaacaatattaattcctccagtcaatgaatattaaatgtcttttcatttatttgtgtctgatttaatttcttttatcagcattttatagttttcagtgtaaaaatatttcccttccttagttatgtttattcccaagtacttattcttgttaatcctattaacaaggatttcttagacatgacataaaaagcactggcaacaaagaaaaaaaaaagaccagcagtgttacatcaaactgaaaactttgcacagcaaaacaatcaacagaggttgagtggacctaaaaaatgagagaaattatttgtaaaccacatatttgatcaagagttaatattcaaaatatgtaaaaataagaaactcacaaatcaatagcaaaaaaaaaggtaacctgatttttttaacaggcaacggatctgaatagacatttctccaaagaagacacatacgcagagccagtagccagtaagtatatgagatggtgctcaaatcactagtcattagcgaaatgcaaatcaaaatgataaagagatgtcacatcatggttgttatgatggctattaccaaaaacaaaagataacagatgttggtgataatgtgaagaaattgaaacccttgtacactgttagtaggaatgtaaattgatgcagccactatggaaaacagaatggaaggtccttcaaaaaaattaaaaatagaactatcgcatgatccagcaatcccacttctgggtatacatccaaaaaattgaaatcaggatctcctatctgcactcccatgttccgtgcagcattattcacaatagccaagacatggaagcagcctaaatgtccactgatagatgaataaattttaaaaatgtggcatacacacaatggtatatcatttggccttaaaaaagaagaaaatcttatcacttgtggcaacatggatgaacctgggggccattatgctaaggacaaatactacatgatcacactcatatgagaaatctaaaatagattcatagaagcagaaagcagaatggcgattgccagaggggaagaggaaataaggcgatatccaagggtataaagtttcagtaatataagataaataagttctagagatgactatacaacatagtgactatggttaatacttctttgggtacttaaacatttgttaaaagggcagatcttatgcaaaatgttcttatcatggaaaaaaataataaagatgtgaggaaacttttggaggtgatggatatgtttattgcagaaattgtggtgatgatttcacaggtatatacttgtttccaaactcatcaagttgtgatacattaaatatgtgcagctttttgtatgccaatcatacctcattaaaagggcttaatgaatgaataaataaacaaataaataaataaatgctacaaccagaccctgtcactctcttatatcaacatccttattgtggatttcatgtttaaagtactacttactccctagggaatcttccctcatctcagcccagtttctgtccctgtcgtaagttctcttagcaccttgtctcttcccacatagcagtaaactctgttgtaattacttaatgaagtgatcatttgtttcatgccttcttccctcactgtggagtccctgagggtaggctttattcactgctgtccccaatacctatagcacactgtgttgcatataacagacactcaatacatatttgttaaaggggtgaatagtattacattatagctaattttgtttcttttaaatgtttctcaacatatcaaaataattttactttaaatgttgcatgatgatgtatatttataatatataatataatatataattataatacataatattgtgaatttataatatagtaaataattatatatgtatatgtaaaatttgaggaaggtatcagttcaatctcaaagtactctatggcataaagtgacacttgttgtcacatgaaggcagcacaaaccattgcaggtttagttcttataagaaagaaattagtctctgaaagtaaatctcaggcctaagaataaaaggcctgtcaaacttgccatcacgttacaaatccaactgttggtcaactttatttcttcctagctacttttaggcaattcaaatatcttgcagcaacagcctgattctagggctatggggttatggatcatggggttactatgacaacaggtcatagcacaaaggttttaattcttatggacagagttaatgtgagacaaaatgcatgtttagttaattgttacttgggtataatatgactatttattaaaataattatctgatgataattattcataatcaaataaaacaaattctttactactataatgaacttatcacttataaaaacactttcacaaacatttcatttgacttccataacaattctgtgatacaaaaaagaattatctcatgtagaaaataaagcatcttacctaaactcccatgtctagtaaatggaagagtaaaaccctaaagccagactttctagtgccaagttgcatgctctttcttctttgtcatatggaccatcagtatcagactataactaatgaaataaaaatctacatataatttaactttcttatttttcaatttctctttgaagaacctgagtccttgttttagagtccaaatctttggaaccatatggacaactcagactatctgccgagttgagaaatacaaaactaaacaacctttgtagctctagcttcagtttagtggttgggttgaaaaacaatttactactgctttcttctatagcctgctgctaatacaattatttgacaacccacctctcgtatcttcagaaatcgttttaccatcttgactttttgcatgagggaaaccacaacagacaaaattagagacacgtagtacatctgtgtttgttagcataaggcttttatcttttctaatcaataatcttctcattattatctccttggcttttgaagctagagctcctgttatttatacaccactgatatctcagcatcccttagcaaccctaatgtacacagaaataactacaaaactttgtatgagcacaaagttataaactcaaaccaaacagagcattttttaaagtaagcaatttaatgaggtttttaaaacaaagatataaaatgcttgtattgctcattacaacaacaaacatctcagttacaaaataaggaatatttatttggacagatattacttcaatatggctatattaaatcatctggtacagaatttattaaaagaatgtttttaatttttttctcttttttataaatttcaacttttattttggattcaggtacatgtgcaagttgtaacatgtgtatattatgtgatgctgaggattgggatacaaatgatcccatcacccaagtaatgagcatagtagccaacagtttttcaacccttgccctcctccatagtccccagttgtctattgttcccatctttatgaccatgagactctagtagtagactctagtagtccccagtgtctattgttcccatctttatgaccatgagcactcaatgtttagctccttcttataagtgagaacatgtggtatttggttctctgttcctgtgataatttgcttaagctaatggcctcccgctacatccattttgctgcaaaggacatgatttcattcttttttatggctgcatagtatcccatggggtgtgtgtgtgtgtgtgtgtgtgtgtgtgtgtgtgtgtgtatgtctcccatgttttctttatccaatctaccactgatggacacctaggctgaatccgtgtctttgttattgtgaatagtgctgccatgaatatatgagtgtgtgtgtctttttggtggaatgatttattttcttttggctatatccccagtgatgagactgctgggtcaaatggtagttccatttgaagttctttgagaaatctcaaaagttttttccacagtgactgaagtaatttacatttccaccaacagcataccttttctcaacagcatctgttgttttttgactttttcgtaatagccattctgattggtgtgagatggtatctcactgtggttttgatttgtatctctctgatgattagtgatgttgagcattttttcatatgtttgttggacacttgtatgtttattttgagaagcatctgttcatgtattttgcccactttataatgaggttatttgttttctgcatcttgaattgttaaaagaatgattttgaagatgcgtgggaaaacccccacttcctaaagtttgcctacatataaacaaaatagcatataggagcagttacataagtgacacaaaattccactcttggtatatacccaagagaagtgaaaatgtatgtccccacaaaaacatacacacaaatattcataacaggattatagataatagccaaaaggtggaaataacccaaatgtctatcaattgacaaatggataaactatggtatatccatacaatgaaatattgttcagccattaaaaggaatgaagtattaatatgtgctacaatgtgagtaaaccttaaaaacatatgctaagggaaagaagccagtcacaaaataccacatatggtcatacagaatgtctagaataggtacatctacagtgaaagaaaatagattagtggctgcttggggctaggggtgaggagatggggagagattgcgtggtagctaaagggtacagagttttgttttgagatgacaaaaatgtcctaaaacagactgcagtgatggttacattatctatgaatatactaaaaactactgaattgtagactttaaatggttggattgaatggtatattatattaataagaataaattattaattaactaataattaattaattaaattaataagaataacccacttaaagcaaagcattcctcctttgccctctcctcagaggcctctaagcacagacgtacttaaatgtacttacattttatattagcattagaccctgagaatgaaaggaagtgttcctcaaagcatgtgagccaatgaacatagtctcatgacagactttttaaaatgacagtggtatagctgaggaagctcctaccagacagatctgtccagggataataactataaactctggacaaaacacaaaaagacaactactgaagggcgctggagagggaggagaagcaggccaggtctggaagggtgttgactcttaagaagagagtggcagagacgagtttcaggacggtttactgtcttagcctgagagcaggccacagttgacaccacagagcaagaagcgactaaatctcccacagaaaaccctcagtcttcctgggctggggcactcgttctgtcttcctcttacttggtcaccctctgacctctggcatctgtgaaagccagcatttctgggttcctttccttctctgactattcttcctgtatctctttttccctcctgtttgtcttccccttaaacactagcatcctccagagcattgccctcagcttctgcttaatgcattttctcttcagagttcatcgactcctgctgcttcaactgccactgagactgccgcatgcatggcagacctcccttctcaacctccctcctggatcccctagcttcagtcctatgccaatgacttggaagttaaattttaaagtcagtgctgctctgtcacagaagccaaacatcatatttggtcacaatttctcttgaaactccttaggaaagcaacatgttggatttctcatttttctccatttcttgacctgctttcactgttgaattcaactatgattccattgtatttggttgtcccataagtatctctaatacacaaatcaaccttccaatctttatttcatctgcctgtatcagactcctgcacctttacttcctatgttaacaggtagtatcaaaactaacctggttagatacaggaggcagagcaagaggcctgatagaagtctatagcattggtcccccaccccaaaggaacagcaaattttaacaattaactacacacaaaaggcactaatacaagaatcaaaaatcaggtgagcaatcacaatacctggttttaacttcatatcactgaagaagacagtaaagagggcaagaaagatagtcttgaatgctgacaccatcctctcccatcccccagcagtagccatgcagcttggagaatgtgggcacttgggagagggagagtgcagcaattatgaggctttgcattgagctcagtgctgccctgtcacagcagaaagcagagggaacatttggacaggcccaggccaaagggtaattgcccatcccagtggtgagagcttgagttccagcgagcctcaccactgcaggctggaatgctctgggactttaaatgaacttgagggacagcctaggccacaaggactgcaattcctaggcaagccctagtgctgagctgggttcagagccggtggactgggagacacatgacctactgagacacaagctaggtggctaagggagtgcttgtgccacctctccttcatcctccagcagtgggtgtgtggcatggagaaatcggtgtgcttggtaaagggagagcacagcaactgggggactttacattgaactcagtgctgatctgtcacagcagagacctggcaggagtcagcacttgctgaccaaagagccccatggccctgaatacccaacagcaatacccagagccttgggctctgagatgtgctggcttcagatgtgacctcgcacattcctagctgtggtggctatggtgaaagactctttctattaaaagcaggggaaaaaagtaaaggggactctctctggcacctgaggtgactgcttggcctcggtggggtagggcaccaaccaggctcttagggtccctgagtctaggcctaggctcttggttagcatttctggacctgccctgggccagagaggagtccactgtcctgaagagtgagtcccaggcctggaagcatgcatcattaaccaactgaagggcctttgggctctaagtgaacatcagtggtggcctggcaaaagcccccatgggttggtggttgtggtggccacagggagagactccttggccaatggaaatgggagggaagagtgggaaggactttgtcttgtggttcgagtaccagcttagctgcagtagaatagaacaccagctaaagttctaaggttttttacttcaatccgtggctccaagacagcatctctggacccacctgaggcctgggggagctcactgccctgaagagagggacacaaacctggctggctttgccacctgctgattgtagactctaaagctttgagtgaacttaggtggtagccaagtagtggttatagcaggccttgggtaagactcagtgttgtgctggcttcaagtctcaactagcacagtcccagtggtagtggccatggggatgttgtgttcctgccccagttccagaaggctcagcacagggagagagagagactctgtttgtttgggagaaagtaaggaaaaagaacgagagtctcggcctggcaattcagagaattcttccagactttaaccaggaccaccaaggcagtacctttctctagaagtcttcaagaattgcagcattatagggtcgcaggcccaagtcccttagaagacctgaaacaccttcccaagaaaaatggacacaaatgggcccagactttaaattaatgtaactgaagtagtgaaagatctttataatgaaaactaaaaactgatgaaaaaaactgaagaggacaccaaaaaatggcaagatatttgatgttcatggattggaagaatcaatattgttaacatttccatagtactcaaagcaatctgcagattccatgcaatccctatccaaataccaaagacattcttcatagaaatagaaaaaacaattctaaaatttatatggaaccacaaaagacccagtatagcccaagctatcctatgcaaaaagaatgaaactggaagaatcacattacctgacttcaaataatactacagagctatagtaaacaaaacagcatgatactggcatacaaacagacacacagactgatggaacagaatagagaacccagaaacaaattcacacacctacatagacctcattttcaataaagatgccaagaacatacattgcggaaagaacagtctcttcaataaattgtgcttaaaaaactggatatccacatgcagaagaataaaactagactgctatctctcgctatattcaaaaatcaaatcaaaatggattaaagacttaaatataagacttcaaactatgaaaatgctaaaagaaaacattggggaaactttaggacattggtctgagcaaaaatttcttgagtcataccacacaagcacaggcaaccaaagcaaaaatgaacagctgggatcccatcaagttacaaagctcctgcacagcaaaggaaacagtcaacaaagtgaagagacaacccacagaatgagagaaaatattttcaaactacccatctgacaagagattcataatcagaatttataaggagctcaaacaactttcttttaaaaaatcgaataatcccacttaaaaatgggcaaaagatttgaatagacatttttcaaaataaggcatacaaatggcaaataagcatatgaaaaggggctcaacatcactgaccatcagagaaatgcaaatcaaaactacaatgagatattacctcaccccagctaaaatggtttatatccaaaagacaggcaataacaaatgctggtaaggatatggagaaaagggaagcattgtacactgttgatgggaatgtaaattagtacaaccactataaagaacagtttggacattcctcaaaaaaactaaaattgagctatcatataatccagcaatcccactgctgggtatatgcccaaaagaaaggaaatctgtacatcaaatagatatctgcatttccatgtttgttgcagcactgatcacactcgtcaatatttggaagcaacctaaatgtccatcaacagatgattggataaagaaaatatggtgcatatatacaatggagtactatgcagccataaaaaggattagatactgtcattttgcaacaaaatgaatggaactggaggttattatgttaaatgaaataagtcagacatagaaagacaaacttcacatgttctcacttattttaggggctaaaaatcaaaacaattgaactcatggagacagagaatagatggatggttatcagaggctgaggctgggaaggatggtggggggtggggagggggggggttgttaatgggtacaaaaattatgtatagttagaaagaatgaataagatattatttgattgcacaacaggatgactatagtaaatagaagtttaattgtacatttaaaaataatagagtataattggattataaaaatataagatttttgggaggccgagacgggtggatcacgcggtcaggagatcgagaccatcctgactaacacagtgaaaccctgtttctactaaaaatacaaaagaatagccgggcgtggtggcgggcgcctgtagtcccagctacttggtaggctgaggcaggagaatggcgtgaacccaggaggcagagcttgcagtgagccgagatcgcgccactgcactccagcctgggcaacacagcgagactccatctcaaaaaaaaaaaaaaataataataataataataataatagagtataattggattataaaaaaaatagagtataattggattattgtgacaaagtataaatgcttgaggggatggaaagcccatttttcatgatgtggttattgcttattacatgcctgtaggaaagtatgtaacatacctcataaatatatacacccactatgtacccacaaacattttttttaaaaaacctggttacccaagccagaaatccaggagtcagccttgactcctctctccctcacaccaaaatccaatcagtcttgatttctgttgattttaatgcatccaatgccttatttcaaacactcatcaccttttacttagaccagagtcagagccccgaactggtctccctctgccttcatttctttctgcctccagtactctgtagtgtatccagttctaccgccttttgcaaatgtaaaataatcagagttctcctttcttggaaagatcctccagtggtaatccaccacccatagcagtgttttgtaatcatttttatagcagatcaatgttattttcaaataaatatcataaaaagcctaatatctattaatagatatgagctgaattttattgtggttaacttactttataagatctaagtgtgtaacttctataaaccagtaagaaaataatagggaggtttggcaaaacttaaaaattcaaaatcattggcaatgcaattagatcagcatcgtcttgatatttatttctctgttttatttgattgcacatattttttgaaatcctgattcatatcattaggtagccaccagtgataatagtttattgctttttccaaaaagttcacttttcaaactttaagtatcattcacttagaaaaagatagcaagatgcaactaatgagctaactaatgagttaacctgtcagcacatattacttggtttctggtttttacttggttaaaaatgtggtatgtaatatttagtttgagtgtgtttttaagatttttttttttaatgaaagtcaaagcaaacatttgtgcaatccttaagtctcctccttagaaccttgttaccatggaatagagtttgaaaaccagtgatctaaaagctaaagcccaaattccttagtatttagtatgaaaatgtaagatgctgtttaatttggactttattgatctagctgcatttcccaccactgccaaattttcacccagttttctaaatctatgttcatctttcaaggggttatagttttgcagtagttattttctctgccaaatgtgactcctgaactactgtcttctaacctaaatttctattaacttaattccgaagttaacacattaactctccatgatgctttctttgaatgtgcccatgggaccttgtctatacacttctatcttaaacacgtgttgccttgtgtgataatcatcacttcctctcaactgtgagctcctaagaaaggactaatttaaccatcctggagttctcaggaactttcaaaatgcctgcaacctagtaatcattccttaaatgttttaaattcataaactcattcattaatattaataataataaccagtagagtggttacagtagctgaaactgcagatttgcataacgtcatcaaaagataatcctctcattgactgacactttgggttaaataagtactaagtagaaatcactcttctagatcatgctaattttcactttaacttcatttttatttaataatggcctcacccaccaacataggaaagcaggatcaccagcaagagaacgagagcacagatacatggaatcaggaccagcaataggaaccggaggaggttagcagtcgccagcttctgagagcagccattgcccatgttattgtcatcagctctcaagacctaaagtaaaagaggaaaatgcaacatggttttagttttacaatacatggtatgaaattttaggttacagctatccatttagaacagcacattccaaaaagattttacagtttgtggtttagggtatgaaatgagcttagtcaacaaatcatgccaataaaggaacagataactgtacatctacattcagggaagagcaaactatctatttctgaaacatttttcggaagtacataggcttttaacaatatcccattttgcttttttaaaacatatttgtcaatttggtatgattccaaagggctatgaatgaccatggcaaaaccttaccctggcccaaagctatgacagaagtgaaggctgcctaatacagtgataaaaaattggtaagtaggtgtagacagaatattatccagacttcattcttttttgtctcattagtctaaaccaaatgtgaatgaatctggataaaataagtttttggccattaataattcagccaggctcactgttactgaccatgcatttagtgacaagttgaaatataaggaggagcctgcctgattgccaattaaacgctaacaactctgaggacatcctcggctgcccatgctacccctgcagcccatcctgtgtgagaggatgtcaaagtgcaacaacgacggttcagataaagttcttgtcttcaaatgcttcaaattttgcttagttcaatctcttgccagaaatgatatctggaaattcatttattacagatggctagcttaaagcagtgacttcaaaaaaacatctgagatggtactaaaagggctttgaataactacaagaaactctccgagtctccttaatgaaggcatttctcatgattctctcttggacttctgactgcattttctcctctgacagtttcagaacttgaactataacctcagtgtaactacctcctgaatctctcttgcatcctgtactcctttcagagttacactacatatttccaatgcctggtgggtagcagcgtctctttttaacaagtccaaaattaagacgaaccttctctctctctatcttcaaactagttcttctcctgactttcatatttatgtttacagaaattcctccattccaatatggggagtggagtccaaagactccccatttcatcatccccctatgccgtacatcaccaggttttgttggttcttcctcttaataaataccaaactttttttaaaaaaatgaatgacctttgagaaagagccttataataatcaagaagttgttctaacacaatggccctgtaatattctcaggacttcctgacgagtatttgattatttcccgtggatgcaaaggcaattttgaagggttcttctgaattgcaaggcatatgtgattcccatttctgctttattctctctataagggaatataggttcactaacccatattgcaagcagtgttcactacataatatgatgacaccttctgtaattttaagaattctccatgagagacattatttgaagtaacttgtgttgttaacttgagaagaacttcatttcctaggttaatgtcttactgatccattgtacctggattaagctaccagccaatgtgttataatttatagttaatttacaactgatcttcaagaagacaattgatcttcaagaagataagtgtacaacacttacctacaaaaaaatcaatcaataaataaaagtgtgggactacaggccaacaaagttagtggcagaaacaagttgatacttgtttattttacttagttattgaatacctactaattataataatagtgatggatacgacaatgacttcaaaccactgtctctcaaaagctcacagtcttgtaggagagatgaaatgtacatgactatattgcaaggtagcaaatgataagcaccatgacacttatagctaaagtgatataagaattcaaaagatagaaatacgatttcttgctggaagatcacgtaagacattgtagagagagcaaccctgaatcagccataattctgagaaaagtacccctgaacaagtctgttacgagttaaaaaaagttgcaaagtatttaacttctacaacagtgaagaagcttccttgctaaggtgatcacagaagcattataggaataaccttggctcattgccatctggactcctggagccagatacatctcatttagcatttataagtaaagagtcagtggagaaaatgctagaggcccattttaatatgtcatctaagtagatatcaagtactggacctccaaaaacaatattcatgattagaccaaatattttcttcagtgacaagagaattgattgcttttttttttttttttttttttttttgagatagagtctcgttctgttgcccaggctggagtgcagtggcacaatcttggctcactgcaacctccgccttccaggttcatgcgattctcctacctcagcctcctgaatagctgagattataggcacacaccaccactcccggctaattttttgtgcatttttaatagagacagagtttcactatgttggccagactggtctcgaactcctgaccccgtgatccacccgcctcggcctcctaaagtgctgggatcacaggtgtaagccaccacgcccagccagagaattgattgcttttttcaaagggagaggaggaagaaataggtaggagaaattcaatacttcaacactttcttcttgaataacttgcataactttcctcttgcactcatggccacttaggactgttgcaaatgctacattatgcacaggcccttggaggttcctctgaacacaaggcaactctcagacttcactgttgagtaaatgccaggtgaaataaacaaccagaatcatccttaagctttgtttcaatggactctaaacaatcctcccttcaaatggcatccctcttccacaagcaccttcctcagccttgaaactaagctgagcacaggcacagcattccatggcaagggtagggaacgatgcatctgattggacctgcacatatttgtaaagcatgtcattcttttgtgttttgtttgttgttgtttttatttttggttttggttttgggcttttgtttgtttgtttgtttttggtgttttgttttgttttgagacagggtctcactctgtcgcccaggctggagtgcagtggcatgatctcggctcattgcaacctctgcctcctgggctcaagtgattctcctgcctcagtcttctgagtgactgggacaacaggtatgcaccaaacatcacgcccagctaatttttttgtagagacaggatttcaccatggtgctctggctgatctcaaacttctgggctcaagtgatccacccacctcaagcttccaaatgttcttatgttttactaatcttgttactgaaaatgtgtttcttctatcttaagaactacatttattttaaaaactgtcatgttgttttatataatgtacactggcacagtgtaccattgtaccacaagtgtatgctatcttggtatcatttgagaggtcaaaatttcagatagccagttcctccttcttgaagcactttcttcctttggcttctctttctcctacctctctggtcattccttctctttctgtaggctcaattctcacattcactcgctccccaggcaatgtcacccacacatttaacttcaattagcagccctccataggtgactcgcatctttaaataacaaccatagatctttcctctgatctccagaggaagattgcattatatgcaactgaccacttgacatctcctcattggaggttgtaaaagtagctcaaactcaacaagtctggaaccaaataaacaattttcatccccatatctggtattcttccagggtttgtgatctcaaaaaaggtaattgcacaactatcatgtgtcaggcattgtttgggcacttgggatatattaatatgcaaaacgaaactctctagtctcatagatgctacattatagtaaaaataaacatatctctcctgaaatactgcaaatacctcctcctatctggtttacctatatttatccatgcactccctaacctgttctccacactatagccagagtaagaaagaggctgtattatctttgcatgatgagaaaaaacaacgtgaaaaatgaccccaaagctgaactaattcaagaatgcagagcctggaaccagagctgatcatgagaaccatgcacccagaggttctggggagggctttggatttacattagggtgtacgaggttttgagtccattttatcaagtttgcaaaggtcaaggagattatagttgacatttcaagtacataagtctttaccctcttttaccttcaggcagcatttgactttgtcaacacatggtgcattcctgagggcacatccacatctgcgaatggcagacaatatttgagagcttgtttggaggttctagctggggggtgcacctacttgaatacccctgaccaaaggtgagtcctcatctatcagggatggttgtcctttcaaatattcctgcctcctaaagtgctgagatcacaggcttgagccaccgcgcccagccgaggattattttctaattggttggattaccttttgggataaattttacatcttaaatatatagaacagggatcagaaaactagtctatggaccaaactcagcacacctagtatttttgtacatacagttttattggatacagccatgttcatttgtttatattctgtctatactgctctgctgctactacaacaacattgagtagttgcaacagagatcatatggtactcaaagcctaaaatctttactatctgatactttatagaaaaagtatgtgagcccctgatgtagtgtatcagtgtatatctgcatatatgtgtatttttaaatttgcatgtttaatttgataatcaaactaaaatataaattcttttaagaaaattgtattttaatctcttcatcagggcttttaatgaaatatgatataattgtacagggggtaaattagcagacaaaactatttgttgctgtagtgcaaagttactccagaaaaggttgaaagataaaaataatcttcaaagtagaaaaaaaattatcaacactatatatgtggctgggcacaatggctcatacctataacaccagcactttgggaggctgaggcaggaggattatttgagcccaggagttcaaggtcaaactggacaatatagtgagacctcattctctacaaaaagaaaaaaaattaatgttagccaagcatggtggttgttgcctgtagtcccagctacttaggaagctgaggtgggaggactgcttgaacccatgagactgaggttgcagtgagccaagatcgtaccactgcactgcagcctgggagacagaacgagaccctgggtccaataaataaataaataaatactatatgcactacattaggagaaaggaaagcactagtttcagaaacattcaagctgaaagagtaccacaacatgcatcatagactataggaaccaacaaatactcataagattttagagctagaaagtacaaatttattcctgcttctttaaaaacacaatcatagcagaagtcataccaattcagtctatttcttgctatatatgcaaatattgcccttttctcatcagtgaatgctctgtatctagaacagtacctgaacacggtcaggagttagtggataaacacttactgaataaatgaattaattaaatttcctaaataaaaattactttgtacataattatgcaaataactacttcttacagagtctattcctaaatcatccaaaaatccttcaagtagaaaatgtatttggcaagaagtaaaaatataaataataaccacaattgcatactaatatgatgtgtacacctgttgactaccgcacaactccttacaccttggaatcagatcagacaccaccacccctcattgcctgctccacatggattctttcatagcacaacttttgcatagcaaccgccaagaacccagctttgtggagacaggacaatatcaaaaggaatatagcacaatctaatgttgaaactgtgagctacctcaagctagtatttcatgtgatgaccaataaatgtcaagtatcgctgcatttgcctcaaaaactaaaaatatccagcaaagtcccttgagtcactgcagcaacctggaatacaacagcacacagtttggaaaccatagtccaagtccttgcttatttatttctcccaatacctaatttaaaaacaaacaaaacaaaacctatcccttgaccattccaaggttttgccaaacatatgctgtctttagctctgaaagcaataatatgcactcagagaaattgtctacaaagagattaacatcagcctgctatttcttaaggtacagcatcagacatagagatatgttgatatttttattttaaacaagatttgtttaattgccatcaaagatcaggcaaacttgaggcagaatttaaactgtttctgataagcagaatattttgaaatgtgaagattaattctgtctgcctaatgtgacattataccatggattttattaaataccaaaattattcttaccaaaattaaataccaaaatgttcttaaataaactatgtagacttagttaatacatgatggttagtcaacacagtctgtgaactttatttagatgtacaaacagtacttgctagaggttatcctaattcatatgccaatctggtggatttagctaaaattctatttattgtttgaagtttctgatattaccaagccaaaatgtcaaactgttctcaaaccaaaatgagaatgttcattttaatagatgggattgtatgcaaaattatggcagaattcaatgaccatttgtcttatcacaaaatatttgcttacaatgttaaaaacaaacaactaaaaagaaaaaaatcatccaaaatcaacactatgtattggcttgagacaaatttagtaccttaattctttaggtaggaagatgataaactgcaaatatactcttccatttcagcaaagcaaggaccagcctcaaggataataaagtgactcctactggtgtgtcctaaacaggacacagaagctccctctaaacactgtgggggcattacagtgtcacatattaatatactcacgaatctaaagaaatgcagacactgagactctacttgcggctagatattcaacttggaactttgtcctgcacaatcattatgccaaaatgtgatttgtgttcttttttcagtcatagagatggagtttttccaacccatctccactctgtccgtagagcaaaaattagtcaattgttaccccctcatttaagatgaaaaatggacagtgctagatgcttcccactctgttcttaagaaattatgaaagtgaccttcacatgaattaaaagtagatttgttgagtaacagattaataatgtggatagttctcaagccaggcatctgcaattctctgcaataatagctctcactcaaccaacaagcaaaatgcctccaaaatcatcatgtcttttggtgtgatgtttgtttttaatatcccaggaagcataaagaacacgcatctggttttcagtaagtcttttcatcccattttctggcatgtagttgaagcatatgaagtttaaataactcatgcagtctctcaaaatgaaattactcagttcataccagaacacatggtactgcaagccaactctgcccacattttccctttgaaagttaacaaaataacagcaccagatagtcctctcccaaatttcagaatcacatatcccagaatgtagattcaatatggagactaaataccaacaaaatatgtatcctatcaaggagactagataataataacccagtacgcaggcaccatataacattagtgtttctgttttgaggatacattgtttagctgaagtctgaactgtgagagacgagattggaatgtttcaaaggcaacttgtacaatactttctcagccactgaaaatctacgtaaccttataaagtcatcttccattcttaaccgtatctccgtatctgcaaataaggcataaaaaggtctttctccaaccacaaataccccaaaagtaaagtgaaattagtaaagcaaaagaaaaatgaaaaaaaaatgtttctttcaagttcagaaagctcaagagtcctgatttttttttaacacatagttcagagcttgctcaatttagtttccctggaggaaagttattatctttatttaaatgaggagatatcttcagaggcaacaggagaatagtttagccttttaggtaaatcctattttcttcagagcactgtaggagggtcatatttctgtaatagttatagaagatgattttgggaagaaacagtaggctctcattatccagacaagatagataaataggatcctgtgtcctttttggagatgactttgccctcaatctcaaacttgccaatactatcattttatgaaagacacaaagtttaaagtaataaagtttccttttaggtatatacaatatcagaactctttctgcatatattggagagtcttaaaggtcagtttttcagcctatattttttaaaacaatagagaatacggggggaaagagagttgggttatccatttcttgggaaattaaatatttgatatttattgataaaaatgttctaaatttcacatcttgattattcgttactacatctctaagaaagctatggcaaaatccaaaggagtcaaacagttaacataaagccaaacccacatttcatttagcgctaaggaggctcctgaatttgtgcaaatcttagaaacttaattgactcactaatcctataacaatggaaatgttgtgacttttaaaaattgaaacagattgtcaaagtgagtagcgaattaaaagattgactttctacagctgaaaataatcagggaaagcatagaagacaaagtggattttatgctctacaacaattcatttcaggcatttcaatgcaaagtaaaacataaacagatgttgaaaacaattaacctactgaacctacctgctgaaaaggaatcctgcagtgaaaaaatacaagtaatgatgttatgcattagatgaagcagcaatttctttctgaatacctaaagcaaaagatgaattccaaacttaacattcatcatatgttttgctatagttccatgaatattctagttgaaaaatgagaaattctgtgttgaggtttccattacaaaacacgtctatgtgacatgttaaaatcccagtaatttggtttattccacaaatgcttatgtaacatctattctgtgttatagggctataaagatgaagaaaacatagtccctgtcctcaaggagttaacagcctacctccaagaagatatacagcttcacaggtgacttcaataccctatgactagggtaatgcagacatgtaaaaagtacaacaacaaatcaaccataggtgcagtgtgaacttttgcactgaaacaacagtatttcttgagcgtttattccaatgagcctcaaagcacatgtctgttggttgaaggaggaggggggccaaagagaagcaatgtaattgatattccgagaaggacaatttttcactgatggactctctcacatattgcaggatatttggcatccctggccaccacctaataaatgccagccatagcacaagcacacacacacgtgcacacacacacacacactcacacactcattgtgaccaacaaatagctcctactttatttccaaatgttctttagagtactgccttccctagttgagaaccacttgggccattcagcaatcatctattgagcaatacggtgtggtcagcttgactctctggatacaaggcacagccctaagtaagcaaactgttacccttcctataggcattaataaacactagctctttaggtaagtactaaatcttatgccttttttccacagaggtatgggacatttaaaaaataataatcattatgtctcttaattgtgtgtgatcatcaccctacctggaacacaaagaacacagaatttgaatgtcaacatcaatcgaatatcaatcaaaaagaagtggcagaatgtattaagtcctttaaaacatatactactaactatatatatataacaaaatatatatatatataatatataactaacatatactactcttgaaccaggagtcttgagagagtatggagtggtactagggtagaacaacacacatggagtgattatttcttgatctggcacagcatgaggctttaagccttggtggacccataccaaacatggtccatgtaggactttagactttggacagtctctgcagcctatgccagttcccagtgtttcagctgtggctgaggtaggatcaagtttttagcttctggaggtgaacaggacaaaaggtgctgcctggaaactacaaaacagctgagattctttggttctcaagaagtagatgtgagcttctagttttgactatttgtgccagtcttaaaataagtattaaactgaagaaaggctgccccaaattctattcctccttatgttgttttaagctacattcagggccatggaaagaaacagagaaggggagatctcaatccttaagatgcacagaatttgttcacaggttctagccaccctctatcacatgatcctaagttcactctggatttgttaaacaaataatctctgacccggtctctagatttcatagacctaattcatggattcagctgtagatttacccttctacagctggtagatttacccttctacagctggtagatttcatttgaaaacaaaaatatacaaggctttatcatcatgtattccttcttcttggggtgaagtaggaacacaactcaataaaacttttgcaaatgcaaaggctaaaaaggcaattcaaaggcctgtgcattaaacatcctgtctctacagaatgtttatctcaggaggtcaaaaaatatctggaatggtttgaaaaacatagttcagtcttactttcagaaaaagtgttgactaaactactaaattagaggaagacataagtttccttaagagaagggttgagttttgagcaggtaggctgagcagataagaaggaaaaagtgagactctgaaggtctgtgtggatagatatagacgagcaaggagttgcacccaggtctaatacgcttaaagagtttattggaaagagagagatgcttctgataactactagacaataaagtatggctggaacccaaagaaatcaaacagaggaagaaagacaagttctcagaaaacaaatgaattgtctgtccccaaaaggtcaaggatgtgataaattactaaaaggcagttttttaaaagctgcagatagacatttgattgtaaaaacaactgaggaaccatgcctaaaagattggacaactggtcagacaaggtggctcacacctgtaatcccagcactttgggaggccaaggaatgtggatcacttgagctcaggagttttcaagactaccctgggcaacatggcaaaaactcgtctctaacaaaaatgcaaaaattagccagacgtggtggtgcactcctgtggtcccagctacctgggaggctgaggtgggaggatcactggagcccaggaagtcaaggctgcagtgaaatgtaatcataccactgcactccagcctaagtgacagagaaagattctgtcaaaaacagaaaaaaaaaaaaaaaaaagattggacaactatgccaagcagcttttgaaaatctggatatattgaacagggtaagatctggaaaatcaacataaaattatccaataattcttacgtatcaagtttcagcctgacacagttattataggtgagtacataagtactgtgtgtgtaatataatagaaaatttatggaattaggaaaaagagaagacatagcaaaaatgaaaaatatttaaaagggagctgggcaacccataatagattgagtccaagcctaggttagatgcggatttgagaggagaacaccttctgggtaggaattagccaactcaggaggataatggtagacaagatttacttgaacatgaaagcattcagcagacccaaaatctactcatatttctcactatgggagacttcacaaaggaagtctagaagagcaagttggcaaagatcatggccagaagacaaagagaaactaaaagcaaactgagcaaaaattactgaacctacagaaaatatagataggaaatgactaaattaagaaggaagttaaactcttgcaaactcaacagggccttcctagaggaagaggggacagagacaaaaatagccagggaaagacaatctctttacgaggagtaataaaggctaatatgaggaaccaaccattcctatgcaaaaaagcaggagacagaagcagcgagagacatgaagggaatcagagtctcccaaaaatgggaaggataacgggagaggagaaatgatcccattagccttaactggataagggtttcacaagatcctgattcagaatcagagatcagaggcatcctgcatctcatctgtgtaccttgatgcccataattccattaattcccaccagccttctacctccaaattctacctccaaattctagtccctgctttcctgcccttaggatctgtgagacatcaaataagccaaagataaaatccccttcgtcagtttagccagttctaagaggttttcataacctataatcatcagaatgctaccaaatacagaatgctcccaataattttatagaccatccagggggatcctaattgaaactgctattacaatcctgaagccagacaagcagccccatctcccagggtttgggaaatgtccggagtataaaagtgcctgactccggaaagtgtcactttcctcccctcccgacacattcttctttcaaatggaaccatccatggtttcaactattgttcatgccagtttaaatacatagtggcagtcaaaagaaagagagaggaatttctaggagcaagaaaagaaagggaaactgaaagccagaacagtaaaagttgaggctaagacatcctggaaattagggttagagggaaataatgagggtgaggggagaaattttcttggacgtcagactaggagcttgggtctggggtttgaatgccaagaaagagacctgagaaaaggcctaggttaggagctggaaatgagaacctcaaataaatccaggactttcacaatgctacactgtcagtgaaaaggaagttagaaagctccacttagcccaaggaaaggactaaaaaagagcatccctgtaaaagtgaaaacaataaaaagctcttatgagaaatgaaaaatttgctgtacaaatttacattgtacagcaagtgtagaattcccaagctgtgaaattaatataaaagtagatctcagactggtaattctactagggtgcctatcagaagcaaaccaaaaccactctgcacttccgaaactgccccctgcccgaaaaatgagctcacaataaaaaatgtaaaacacatgagaaagtgatctgataaactgtgctaagaggtagaaatagaatatagacaagtcagtagtccctgtccttatggaatacacgaactatcaagggaaaaatagagtcaattgttacacaaatattcatttaattactattgtgattaatgctatagattgagtcatactttttatgattaaaaaatgctatagaaagtacagcataaataatttatggcaatgtgaaaaatgaactcatggctgggtgtggtggctcacgcctgtcatcccagctctttgggaggatgaggcaggcggatcatgaggttaggagttcaagcccagcctggccaatatggtgaaatcccgtctctgctaaaaatacaaaaattagccagatgtggtgacgtgtgcttgtagtaccagctgctcgggaggctgaggcagaagaatcgcttgaacccgggaggcagaggtttcagtgagccaagatcatgccactgcactccagcctagacgacagagcgagaccccatctcaaaaaaaaaacaaaatgaacttacaaactgacctcaacctttttattaaaatatgttcaatttaactacaacagagagcagtctcatgttgaaaatacttcaatgattaggaatattaattaatatttattataggtacttatatatatataatattagaattattatttcagtcataatcaaataatttaccttccccgcttctttccactgatggttttaaatattttaaataatatgttaatacatacttataaaaaaaactgtctgaatgtttaatatttatgatcggagttcaaggtattaagaattatgtaacattttctaaaattataagaagttgataaaaagaaaagaaggcttttgagagtgtagatcccattgttccatccatcacatttttaaattttgttttgacgtctttccacagttggtattcccaagcaagaaaatattttttaaatgattgtctcatttcttcccagcgctaaagttatctgtactttgagacaaaaccaaacatagaaatgataaatgttttaaactatgtatattatagatgcacctaatttgcttatgaaaagacaaacctccagatccaaatgagaacagactaaactaatttaaaagagttctataaatgtttaatacttgcctagctttcatgtatcaacttttatccttttcaaaggaaacacaattaagaattgtggatgtgaattaagggattataaataatcctattttcaattgaagaagttaggggaaagatatttcatttaagattaagttgtatattaacagtatactaaattgttcactactttcaaaaagaaaaaatgtccatgactacaaataaagtttgtcttagggtagattttttaaaaatgcaaaagtgaaatatctcctgaaattattaaacaaaatgtatttacttttttcctttttaaaaaatttaaaacacacatgtttacagaagagttgaaggtacagtataaggaactgacccattttcttctgacttttcttctgacccgtttgatactcagttgctaaccagatgcctcactgctccagaatatattaatggatatttcctataaacaaggacattctcctgcctaaacacaacacagccattaaaatgagaagattacattgatatattgcaaccacctaattctcagaccccactggtttttccattagtctcaataataccccttctaccaaaaggatctaatttagaatcacaattacatttggttttcacgtctctttagtcttcttcagtcttctcttatcttttatgactttcacagttttgtaaattacaggccagttgttttgtagaatgttcctcagttgtggtttaggattaaattcagacatctttgggagaaataacacaaaagtgatgttgcatttttctcattgaatcctatcaatttgtccttttattgatgacagtcatatccaacacatgatactgttgggatgggtcaagcctccccattgtaacattattttgtggagaggtactttgaaaccatgttaatataccatctcttcaaactttccatttcttttttttttttttgagagggagtctcgctctgatgccaggctggagtgcagtggtgcgatatcggctcactgcaacctccacctcccgggttcaagcgattctcctgtctcagcctcccaagtacctgggactacaggcgcgtgccaacatgcccggctaatttctgtatttttagtagagacgggcttcaccatattggccaggatggtctcaatctcttgacctcatgatctgtccgcctcggcctcccaaagtgctgggattacaggcgtgagccaccgtacccggccccatttctttttttattcgcttacataagcatggactactgttttcctatttcattcaatggtttataatttgttactatcataatttacttagatcctcaatttgccctccatttggccaatggaagttcattaaagctggctgctgtgtccttgtgacatgccccatcattctttgagcacttccttgctttttggaacaagatgctttgaattcatctgctactagccttgcatcacccttggaatcagccatttctccaaggatcctggttcctttttgtagaaaatgacatttaaaaaacaagatctgagggccccttggtatgcatatgatgtgctcattgttcctggggtggtgttgttcccagtttctctcagcagaaagagctatatggaaaaatgtatttatattgtgtgtgcattcacatatgtacacatacacataggcctctgtatttatttctatatctatctttacacattgaaaaccagatatttatacacatatctccagtttcaatcccatatcacagaggtccagatctactatactttctatacttttaaccccttttccaacagggagaaagctggtttattgttaatacatttaattgcttgatcaatcccccagtctgtaactaatttcccatgtcccagccccagctgccatgtgggcgccatgctcaccctgtcccagacgccgtgctcattctgccctggctctcctatgcatggacaccttcctcctcctactcagaccctgaaccccatcttaggttgacctccacacacaccatccttaccctgcttaggcaccaacatactctgctggccacctgtccttgttgatgtggctgacgtgctgctgtccctccccacactttagaacccaccttactctgtccactgaaccattcaggactcagttgttcaccaaggagcaaggaataggaaaatccaaagttttgaaatctatggaaagcaatcaatgctattccttttttttttttttttactccttttttctcctaaagcatatataaaggagaataacaatacaagagcatttttaggagtggctgacatgaaatgatttgagaatattgttaggaatatatgtttcttattcaaagagcatttttgttcctcttatttgcattcagttaatagaggtagtgttaaacaacaacagaaaaaaaaaaaaaaaaatacacacacagtgctaccaggaggccaaacaggtaagctgagcttgtcataaaacaactcggaccactgaccaaggcacacccaggtgagatcttgcaggtcctttgttggggccacttcacgttctcaccaggatgccttaggaaaagcttttctttctttctttttttgctttgtagagacagagtctcagtatgttgcccaggctggtcttaaactcctggcctcaagcaatcctctcccttcagcctcccaaagtgctgggattacagccatgagccaccatgccccaggttcaccttctttgttttaatttcaaacaggatggaaactcaattctattgttatgattctattgttctgcagaagagggcagaataaaaagcaccacaggccagattagagctgtgtatccaagtctagattttgaattcaaaaaaccacaaaggccaaggggaaagagaacgctaaactctcaagtttgtcctaacctctttagggaatgaaactggacacagccagacagtccttcagtcattcctagcttgaaagatccctccccactctgccttgcttacccaacgtgggcagctgagtgtgacagctttgaggggcctccccagggctatttttaacctggtgttatctgcttacagactttccaccagggcagccgcaggtccagggagtcactccacctgggaaatgtgagcacaccgctggcctgtggcaaatgaggtatttttaactgagacttgagaagctcagaattgtcatctgcttcaggcctcagggtgcgagacacaaaacagagccaagcaagagaggctgtgtgcggactctccagttccttagcaaccaattgctgggcttgttgctggaggagggctctgtaagtgtccggatcagcgatggaaagccagcctcagagtctttcctggcaattatgtggccccctccccatagaagtgaggcctgggagtcccccttgcaggcgaggtattctgccgggctttcccacaccacacctatctgcggctaattagcatcacctgggacttgttagacacatgaattcttgggtctcaacccagacctgttaaattagaaactgacaatgggacccagcgatccatgttggatcagaccctccaggtaattctcatgcacactaaagttctaggatcactggcctaatcacacattcgctaacattcatagataaagacgtaagagtaacacttgaatcccaccaagcccacattgcagtaattcttttaaatgaataacttttagaacatttttacacttaccagaaaaaaaaagtgagcagatagtaaaaatcaccagtaactttttcaaaccactgcttttttttttttttttttttttagatggagtctcactctgtcacccaggctggagtgcagtggcgtgatctcggctcactgcaacctctgcctcccaggctcaaatgattctgctgcctcagcctgccaactagcttactagattacaggtgcccaccaccatgtctggtcaatttttgtatttttagtagagacagggattcaccgtgttgtccggactggtctcgaactcctgacctcagcaatctgccagcctcatcctcccaaagtgctaggattacaggtgtgagccactgaatccagccaaccattgcttttttctgctgctcactgtaccctaataagaaaacctccttcctctgttcgtccttaaaggcagtgataagacaccaactgagtttttgccatcaaaggcggcaattgggtcagagaaagaaatagaccccagcgctaagggaagatagcagtaatgcacaaaaaccctaggaatgactgcaaatgcctaccccagcacaagctgagatgaacaactgtgattgtctaagactctgcagccagggcaacaccttcacaaaacacgcttggaaatgatgtgaatatttgtgtatcagttatatagttgtttcttcttgctgctgtaacaaattaccatacacttagtagtttaaagcaacacaaatttattgtctcacagttctggaggttggaagtctgaaatcagtttcactggactaaagtcaaggtgttatcaaggctgcttccttctgaaggctctcaggggaaaatctgtgtctttttcagcttatagtggctgtgtctattccctggcttgtggccccttcctgtatcttcaaagcacatttctcctcccatctctacatccaccatcactaattgtcacatgtgattctgacctttctgcctctctaagggctttgtgatcacatcaggacctcccacataattcaagataatctccccatctcaaaatcctttatttaattacatttgcaaagtcccttttgacatagaaaataatattcacaggtctcaggcattagtatgtgggtttatctagggggtcattgttcggaacatctcgctccataaagccctgtaccctctaatgccatagacactcgctatgtgttgtcattgagcacctgcaatgcagctcatttgaactgagaaatgctataagggtagtgaaatttaaagacttgttatgaaaaaaaggtaaaagatttcattaataatttttatgttgattacatattaaaattataaaatcttggatatattgagttaaataagctatcttattaagattaaattcatctgtttctttttgctttttcaagtgcagctactagacaattttaaattacatctgtggctaacattatatttctattggagcagtcctactacagaccataaaggaggcagggtgacattaactttcagttgttttatttttgccttacttataagagagcccagactttggaagcaacatttcttctttctctagagagagccactaaattcctgcaattaagatgtcaattcaagagagatattttattagggatatgcacaactagataagcgtaacaataaaaaaaatacatttatccagcaacatgcattctaataaagcattttcattaatacattctttcattaagtcctcattacagccttgtaagagatgtattattccaacttttcagagaagaaaatggagcctaagggaaattaacttgctggaggagcacccagtcagtaagtgataagctagaacttgagcccatgtctatgcacctctgcacccaaggctgcctgactgatttcctggtttgggtttagtggtttaatcaggctcactctacttcctgagtggttttactttccaccctcctaaatttcagagatctcaggattttccctttctaccttaaagttctgctcttttgctattctgagcacatttttattatgtttttttaaaaattatttcttaactttgaaggcataggggcatatttcccacccagttatttaaagaagattttctcctgtgtcacacttcctcagcacccagaggcacacctggcacccagcttgatcctgggccatctggtggaagagccctgataccaatgactgtctctcctcgttctgttcaccacccatagctgcatacataggtaagatgttcggatctgacctctagccagagtagataccctcagagaaaccagagctatggtagtttaaactgcctcccagctttcctctgatcagtcttttggggttgaacaggcaatttttcactttggcagagggtcactgtaagaagaattagcaaatgcccactaagagggaagtggacactaaggtcatgtaggatgccccttacccaggcagcactcctatggcataatcagaagtatgtgtttgttttttttcccaattcctgacacaggactccttaaatcccttggaatatcctgagtgataagagtgataagagcaccttttgttctaacttttgttctaacgaggtgattcttggattcttgaaaactcctagctagcttcaggataggggctggtctccagaaaaaccaaactttgattagaagcctagagttttcagccctactccccaacctcctgggaggagagagggctagacattgaattaataaccacatactcatgcctgtgtgatgaacaaaatctccataaaaacccctaagtgtcagggcttagagtttctgaattggtgaacacatctacattctgggagcactccaactccatggggacagaagctcctgcactttctaagggcattgtgatcacatcaggacctcccagataatccaagataatctccccatctcaaaatccttaatttaattacatttgcaaagtcccttttgacaattttgacatataaaataatattcacaggtctcagggattaagatgtgggtttattccaggggtcattgttcagaccatctcacaccatataaccctgtattctctcataccgcagacatttgctacatgtcgttattgagcatgtgcagtgtagctcatttgaatggagaaatgctgtaagggtagtgaaatttaaagacttgttatgaaaaaaaaaggtaggcccggcgcggtggctcatgcctgtaatctcagcactttgggaggccgaggcggacggatcacgaggtcaggagatcgagaccatcttggctaacacggtgaaaccccgtctccactaaaaatacaaaaaattagccgggcatggtggtgggcgcctgtagtcccagctactcaggaggctgaggcaggagaatagcgtgaacccgggaggcggagcttgcagtgagccgagatcgcgccactgcactccagcctgggtgacagggcgagactccgtctcaaaaaaaaaaaaaaaaaaaaaaaaaaaaggtgaaatatttcattaatttttatgttgattacatattaaaattatgaaatcttggatacattgagttaagctatcttattaagttcaaatttatctgtttctttttgctttttcagtgcagctactagacaatctaaaattacatctgtggctaacattatatttctactggggcaggacccttctggaccttctggaccttctggaccttggcctaggcacctcttcatctggctgttcattcgtatcctttatcataaaccagtgaatgtgagttaagtgttgtcctgagttctgtgagccatcagggcaaattatcaaacctgaagagggagggagttatgggaacccctgattcatggccaatcagtcagaagtgcaggtggcccagaacttgcaactgtcatctaaagtgggggcagtcttgtgggatctggcactaactccaggtagatagtgtcagaattgagttgaattattggacacccagttggtgtcagagagttgcagcagtggtgtcaggaaagataccatgcatctggtgtcaggaaggaaaaaacacaccacttgtcagctatcagaaagggaagagagaaacaataaagtaaaatgggacagtgtcctgctcattttctgctgccacataaaaattatagcctttagattgaaaaaggccctgaaagagtaaatagtccaactacctcattttacacaagtaaaccaggatctaaaaggttaactgacttctgtaaaatctcagcaacctaataccaacttcttattgaactcccctttctgatgatgcttgacttggacaaaactgttttaaaggatgacagagaaatagtaaataaaacaatatagctttgatttccaaaccacactacagagaagtagcatcttgctcccagaataaggctctaaaataggcacatgaagatgaaaatcatgtactgtcaaactaatccctgaaaagccttaagagagtgtcacattggagaccaatgtaacttccaacaataaatcccacatggtgtttgttttttttttgtttcagagctggaacaggctcatcggttgagtaccagattaattaattggcttgaggttagggaataaaatggcacaatctttaaacccaggatcacacgtggaactgcaaaaaggatacacataaaaggcaccaggttctgaaactaatggcagattcctttctctcatcttttgctcttactccaggacactgaatagaatgactcatattaattaaacattcatctctcctccctgcactcatggtttagggtttattgcttagttagaaaccaagcttcacaagtgcatgaatccctgttttgttcatagatgtctcctaagtgcctaataatatacctgtcacataaatgtttgttaaataaggagatgaatgtattctttttgtccagcctgtatagttgaattctcatacattaaagctatttaggtctagctatggctttcacttcttgggaagttgtggtgctattaccagaaaaattcaaacagaactatgcataaaaagatttttcaccattcaggaggttcttggagtctcagattaagatttcctggtactgtcaatctctatctatgacacttcagcagaatgacacttttgtggcttcagagacactgacacctactttcatagctgcataggactttaaaactcccccaaagtgctacaaacaaaaagtactcttcaagtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaaggtgagtcatcccatgtgttccacacccaggtagaaagcgctcattagcagaacataatctcccaacctgcatgatgatcgtctgtccatgagaataataaacattacagattgtgcttgcactaaagcagatttagtaaagcctcaggaacagaatatacttcatggggtaagaaatccagctagggaaaagactgacctatctatgcatctgtaatgggttgaatagtgtctccaaaatatatgttcaccgagaacctcaaaatgtgtccttcctttgcatatagggtctttgcagttgaagttagttaggacaaggtcatactggattagggtgaagcctaaatccaatatgactgatgttcttataataagagaacacacagaaacacacaccaggaaggccatggaagtaaaatatatagtttgtcaaatgaggatgagttcaagaaggggtcctacgtagtgaggtggagtattagtttttaagcctgattaaattaaacacttggtggatctttcccccaaacattgtacttagtattatagtgctttcattcttgtaaaaaatggtacaacatgtaggagtacatatggagggagaagagcctccttctgttgtattagtttctgctgtaaaaccaggaaaatcatcggccataaagctcatagggagggaaaagaacaatacataagcaaaatcatcaaggctgaaggggagaactcagaggattatgtgactaatactcacttgtcagtgatttatacatcaatctggccatttactattcaacaaatgcctaggccacgtaagagacctcaacaaacggaagtgattctgctataggaaaccacttcttaaaagaaaaagaagcaaatagaggtgctttacaggaaaactttttcttttcttttctttctttctttcttttcttttctttttttttttttttttgagatggagtctcgctctatcacccaggccggagtgcactgggatgatctcggctcactgcagcctctgcctcccggatttaagcaattctcttgcctcagcctcccaagtagctgggactacaggcaggtgccatcacgccctggtaatttttttgtatttttagtagagatggtgttttgccatgttggccaagctggtctcgaactcctgacctcaggtgatccatctggctcagcctccagtaatcccagtgagccactgtgccttggcctaggaaaatttttatcatcctaaaatcttatatcatcactcaagcaaaagaaagctctagaactgcctgagagaacagcctgcaacgaaggagatcatgtatctgtgctgcccaatacagttgccaccagctttataaaataactgagcacttaaaatgtgcccaaggagactgaagaaataaatttttaatttgatttaatgttgattaaatttaaacaaccacaattggctaagagctactccattgcatcacatggctctagagtcacagaaagctgcctgtggaaaaagtcttgagacatttctcaccaagtctaggatgagactggatcctcaagtaaaaacagattaggaaacaaatcaccaaagcaattacgagcaagaaaaaaaaaagctagaggtatcatacgtcatgatttcaaaatatattacaaagctacactaatcaaaacagtatggtactcatatgaaaacagccatatggccaaacagaagagagatcccagaaataaactcatacatacatagttgacaaggatgccaagaatatacaatggaggaaagatatgtcttcaacaaatggtgctgggaaaactggctacacatatgcaaaagaataacattggaactttatctcatgccatgcacaaaaatcaagttaaaatggattaaagacttaaccataagacctgaaactgtaaaatttctgaaagaaaacataaaggaaaatcttgacattgatctcggcgataatttcttggatacgacaccaaaagcataggcaaaaaaaaaaaaaaaaaagcaataataaccaaataagattatgctaaactaaaaagcttctgcatagcaaacgatatgatcaacaaaatgaaaaggcaatctataaagtgggagaaaatatttgcgaatcatatatctgataaaggattaatatccaacatatataaggaactccttcaattcagtagccaaaaagctaatagcctgattttaaaatgggaaaaagacctaaatagacattactccaaagaagacataaaaatggccagtaagtatatgaaagatgctcaacatcaccaatcaacagagaattacaaatcaaaaccacaaagagatttcagccctttgccactgttaatgtgatcaaaaaacaaaagataacaagtgttggatgccaagaaaatgcatctcttgtatatggttcatgggaatgtaaattggtgcaaccattatgggaaagagtatggaagttcctcaaaaaaattaaaaatagaactatcatatgatccagcatatgataccagcatacagtatagaactaacatatgatcccatttctagatatgtaaccaaagaatttaaaattgggatcttgaaaagacatctgcattcccatgtgcattgcagcattattcacaatagcaaaaacataggagcagcctaatgtccactgatagatgaatggataaagaaaaatggggtatatataaacagtatgtatatatacatacagtacaatattactcagccttaacaaagaaacaaatcctaccatttctgacagcagagatgaacctagaggacactatgctaagtgaaataagccagacacagaaggacaaatactacatgatcccacttaattgaggaatcttaaaacagtcaaactcatagaagcagagagtggaatggtggtttcccagaggaggaggaaatggggaggtattggaccaagggtataaagtttcagtaatgcaagataaataagtcctagaaatctactacacagcatggcttctgtagttaagaatactatattctatacttaaaaatttgctaggtgggtagatcttatgttaagtgtccttataacaaaataataataacaataataaagatggcagaagggaacttttgaagatgatggataggtttgtgacattaattgtggtgacggttttatagatgtatacttgtttccaaacctatcacattgtttacattaaatatatacaggtttttgctcgccaatacttcaataaagtagttttttaaaaaaaggttagggaaccttcaccagaatataccactattacataaagtacttctagtacgtattccacagtctgcagtgtccttaccagtggtcagtagtaccatctacattttctgaccaaggaaactgaggcccagcaagattatttgacttgcccagagccttgcggttcttaaggggcagagtcagaggtctgacaccaaagctcctactcttcccaccaaggcaggtcatctacagcaccttctactcttaaggggtctgccatttccaccctctctgaacagacataaaacaaacaagtgtattatgtctgtgtgtgtctttatgtgagtgtgtagactctgaggaacaggtaagtcttggaatcccttgagtgtttagtgtgaacctagtatgtttagccagccagtatcaggtcagtaccctttagccagccagcctcattttccatttggtccagcaaaatggaatgccaagaatagtgatggggctaacaggatgcatgaatccatacttgttgaataacttattaggtagaagtagcaggtcaaacaaacctttccccctcagatacgctcagcaacaattcagtgttgcggctctcctgctcctcagagagctcttattaccccagcagtggggacactcagaaaccctaagaccacaagtctttgtgttgaaagaggctacaagtgcggaaaagaggaaaaataaggaaaggagtacctcattaacagtatggagatttgaaagtacaggcttttgaaagtgactctctgaagctcctgggccactcagcttctcctctaacttcctgtctgcccccaacagtgggggaggtcaacagaggggctggccagtcaatagaactagcaactgctgaaatccacatgaagctatggtggagaatgtgacccttccaaaaggaaaccacagctggttgtggaatgcaagatgcggaagcactgatgcctgccttctatgctgttgctattgtgatttctgcagcattatgaggaaggtttctgatggaatgaattttgcatcttttaagaaagtgtctctgtacctggatatgtgcttgataaggttaatagagcaattcttggtgtgtctttttaacccacaggaaggttaacagaggctttcatcgttggtcctgtaagcctaccctgaaaggaactttctggaaagagtcccctcccccttaaaaaatgccttatagaatcttggggttttgaggttgatgtgtttccacacccaaataaccccaaaatagttcatcctattgaaattcttggtgtcctggaaagcattctatggaaaacctgcctggtcagccaagcccacacgtgagtctatgcagacatctcctctaacctcgcaagccccaggaacctcctctaacctctcaagtcccaggatctgaggaccaatttttagcacaatctcacacaacaaacctattgggcacctaataatagaaacaagctaatgaatgttttgactgtgacaaaaaaaaatggtttaataactttttataaatgcattgtttcttctcattgtctcagggttatgccaaaattaatttcaaaactatctgcttaaatgtgtccttggacaataatcaccagtaagtcctgacttcaccccctttctggtagcggtctgacgttcctttgcagagtttcgcttccatcgataagttactttaaataaaaagttaaaataaaaactagaagccacaattgtgcctatgtcagtcatcgaagtcttgtacaggagtccgtcttcgcagcgcatcgttctcagaagtttcccgcgggaggaaagctccactttatgaattactcgaacagcttccctgggaatgcccagccccgaagcttccctgctgaattcaaagtcagagctcccagggctcggtcccaggaaccgggagccgtgcaaaaagcgcgtacactgccatccactggccccgagcaggtagtagcaggagtgaggcgcctgccacgggagctcaggaactgggtcccagtaagatccgacaagacaccacctcccttccgcccgcacagcctgccctctctgcctgcagctagcgtcaccggtcggtccccgattcggagcagctgggaccctcgcggtagcaagcggattccggggccctaatgacaccgaaggagaggggcagccgcaaattagaccttcttcctgggggctcaggccagtagggactgtccgtggtgcccttccctttctttctcctcctgaacgagagccaacgctgccccttcccaggactggatctgagccaaccaaatcctacagcgcagagcctgcgcccccggcggccagccctcctgtgcctaggcaggttcacgccggagaaagtttgcacgcagggacctacaagttcccagcactctgcaagagggccagttctgggatgccagcacttaggacgggcgagtgatccccaggcaccaactgggggccggggaaccaagcgcgagcccgggctgtggagggaccgacacccaggcgctcgcagctggggaagggggcttacgtctggggcaggcaagactgctgcacagtccctccagccacccggcgcccgagacgccggcgcagacaggaagctgtagatccccgaggggctggctccgacagctccacctgcagcctcccctgccgccagtgtgcagccaagtccactagatgcttggagggcaccgtgcggaggagggactctgcaggaaaggtggcatcacccccggcatggagaccggggtctccggatcgagccgactcgaacactgaaggaaaccctgcccatgaccctgggagggtctcggacgccgggcgaccggggtggtggtcgggaccagggccgtgcgcctgggaactgggtgcagggcgctgagcgcggaactgtcagagcgggagctcaccggcggctggggaaggaggtggcatcgggcggaggagaggacgggggcgggaggggctgaccctgaattcaccgggactaagaggccatcacacctggctgcggtaggacagcgaatcatcgatcttaccggctttggggacccggctctgcggcagcgctcttccggagcgagggcaggagactgtttcatggataaaaagtctcgcttattcttctgtccacttttatcttggtcgcttttctctcctctacgtgtcccccggggaggcactacggatgattt

SEQ ID NO: 1426 - DNA, 225661 bp, Homo sapiens
attaataactgatatatatctttttattatgcacagataaaagatttaaaactgtggttatcaaaactatacatctaagcatcttcacaaaatagctgacacactgaacagagaaaagaatacaacaggggtgttcaaactggccacagggattttaagggtactcgttttaccctcatagatgatgaaaaccagcaacaaaatcaggctcattcaggaaaaaccagaagagagaagtattgtatttggaaactgataatagtcctttttagaaaaacatctgtcagtttcatgaacaacccccagataaaacaaacatgaaaaaaatcacataggactcacccaacaaaatgtgctctgttaacacaaccagcagtacaatcatcattcaaaccatgaggtagttacagtacaaaaagactggcacgcgtgtgagcaccccacacacactcacaatcatgcccactaagaacacaagcaggaaatggatttacaatcttattacaaggcaaagaaaaaaaccattttttttgtttagaaaatgctatagaaacagtttagacagaagaaatctctggctttttaaaatacagagtaacagctggtaaacaccacatggtgaaaagctatagcgtattatacagacaatctgccttggagtttggggcattttaacaacagcttcagcatcaaacaaacaacaaaatggcctctgcaaattaagggtgtagcctgcagaaataacaaaagactgcagatacaagagttcagctgaaatacaacaatacttttaaagaaacttgtagtacacgttataaaagtagagcttgtactttgtattaaaactgtaaagtgtgaagcaattagaaatactgtaatgagaagctagggagaaaataccttatttttttcatgttcattttttagaaacatttcagaaatacttaacgacattcactctccaatatgagattaggttttatcgacacagatttcttgatctgaataataattctgacaatgagacccaaacaaataaaaggtgatttttttcctctctctctcttttaaaaagatcttttggtttgcatctataaatttgtaaattaattttaaattatttataaaatcattggcaatgtagcatctctcttaaaaatatatatttaaatatattacagaaggttttaaccctgtccttctaagacatcaatcttttaatatctcctaatagctaattttctttttaacacgatggaaaagattttttaaaaaagcaaaggactgatcgaaagaattcacagtagctgaaattaaacatttcatatggagtaacttaaatttatctaaaacacttaaatatatctttatacacaaattttgtagtaaaatatagctataagtgacttaaagactctagtcttctttgaagacatctttaaacttttttatacatagaatatgctgaaacaatacattccaccgaaggttaggcaaagcgcaatattttcaaacacaggtagcgtaatctaggtcctccactctgatacccttctgttaaaaaaaaattaaaggaaaaaaattctctaaactcatgtcttcttcgtttgtatatggaaatctagaaatttttcagtagatcaatgtagatagcctggaaatctcagccctaaagtaatgttttagttaaaatgttccttattgaaaaaaaaaaatgttccttattgaatgtgtatatctatcaggtaagtcatattattactcaacgatttggtaaaaatgattgtcaatttccacatacttgtttcccatgtagacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcctgattttggtcattttcaatttctgtaggcctgtaagaaatacaaaatttgcattaagacattttgcagtggtgtatgcaagtatgggaagaaacaggaagctgataaggtcatcagcattggttttggcccagggcacaagaaaggaatgttgccttaacacttgtcagggtgcagtccctgagggcagcacccatcaagggacacatcagaccccacaggttgtggcagcaaggtcagaagtgtgcatccagacaaaggtgcaaattagacaggaggatcgcttagaaagcctcaaagcatttcttgttttacatcttggttcagatataaagaatctttggccgcatctcctcactggttctactatctggctattaaccctttaccaactccttgagtctgggtaaaactcagggccccaaattatggatgttctcacctggacaaagcagcattttaaaaactggcatgtgtttcacattgaaaacccccaagcctgtgaggggctggtggagaagaccaccattttagctttctcacatgaattctagtgtggtacagaagcccagggtcatgtttatactagccctgggtgtggggtgaatacaacgggtgatctttatactgaaattcactctgtctttacaagggaaccaaaatccagccctctgagtctggacacgaggctcagccattggtcctgcccttggcagtagctgagctgagctgggctgggctgggttgggccgggttgggctgggttgggctaggccgtgctgctgctggagcaaggcgtgctctgcgtgctgccgatgctgtgggcagcactgctgttttccgaggctggcggggaggtggggacttgctgccttcctgctgtctcccctgcagttaataaagaaaaggcagagtcagagaaagacgcatattatgtatgtgcattcctgaaaagatcatttattccgcatttgccattttaactgatatttttctcaaccagggcagaagcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttcaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccacttttcattacacaccccactgcattttagctaaagccattcatcgtgccaaatgtgcagtgctttggagaggaaggaaacctcaagtcacacacatggtttgcatttaacagtgcaaaaggccctagagttagtcttctcttcggcaaaaccggcctcagtgcaaccctcaaaaaatggctctaggtagggaaaagcgatcagggctctccaataaaaaacactgcatttactttgaaaagtcagagcataaacttcataaacttcttgtaagcagcatcccctccttcaatgtgggaaaccccagagggccaggcctgtttatgaatgagcctcctctttcctgtcatgctgaaatacacatctatcagccggagataagcaacccttccagctgcttcattaaaacaaaacactcgaggaaaggccctgccctccagtgcaggaacttggccccattacttccattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgtgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgacttttttggaaacctatgttttggaccctccccagcactgccctctactcttcatgtgtgtgtataattaaggctggggaaattagcctccatggcaataactttctgccaaaaattcactttccccagagtaggagctttatttctagaagggaatcaaatctcttaactattctgaggtcaaaacaaaaacaacctccagagacccaaacaactctagatatactttaagaatttgactcccttacaaaccacatgttggtccatacccagctggatcctcacataatcaatcagaaggactaatgtggctatgcatgaaccacattttaaaaatattttttcctattttaataaggatacatctgaaaagcaggaggccaactccatctttttcttttttggctcacctgggctttgtttgctcagcccaacagcaggtaaaagagaaggccttgcttcatcaagcaatagggagcaagtgtgctcctccaggatctgccctgtgcttgattattcacattcaggaaaagtgccaggactatgccctgcccaggaagcctgaatatctgctttccgatgtctatttgccaaatataatttgttgccatgtcagtttattttcatccgtgcccattaaagagacctttcaacttcccgagttttgggaactcttgttctggtaatgcaaaacacttcaaaacaaaaccccaaacaaaacaaagaagcctccgcactcaagactgcaggatgcatctcaccagctggataagtcaagttaacctaatattatattgactttgatccaataatgggccaaggtgagtctctgtctgagaatctgctgggaaatattgaaagtcccctcttcagaccatcctttccagttctgtggctattttcacatgtaagatgcaaggtttctcaatataaccatgttttaaaaataactcttaccttttgacagattaagttttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttgcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttaggaggctgaagggggaggatctcctgaggccaggagttagagactgcagtgagctatgatctcacctgtgaagagcctctgcactccaacctgggcaacagagagagaccctgtctctaccagggggaagaagaaaaaaagaagcaaaaacaaacaaacaaaaaacatttcttaatggagaatgttttatttctttagcatggcatggagttgcccagatctgacttcctgctacctctttggcgtctatattacaactgtattcttatttctaagtctttcaccatggcaggtcctggggaagaaactattcaagaaagatgtgaatagcatgggaggactctgtggggaaacaagagaagagttaaaaagaaaggtgagggcaagcttggtatttaggccaaaggagactattgcaaatactctccatgaggattattacaaataggagcagacagctgttctttatctccctggagggcagaacatgaggaaatgagtttaaatggcaggactagggatttagatcagatagaaaagaacttgctgattatgaggattggttagttatagagggaatttatggaatctccttctcaggagatatttaagcacaggattgaaaaccatatacctggggacactttagatttaatattccttgatgctagaaagaaaataaagatattttcttctagatctacgtgttggatgcgattttctatcaattaatgtctcagtttcttgatctcctaactgtaattaattcacaagctcactctttaagcagagtgaacgatactacctttaatttagagaagtcttcaatcactttttatcattttcaaatttcattcctccccagcctccacacaaaagactcttcttttgcagcaaaattctccaggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggacttgaagctctggtttgttcaatggctagacttgctaccttagtaggtatattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaacacaccatgtgttcttaaagcaaaagtcaagcgcatacccaaaagtccacccaagtcaggtaagaggttttcattagaagtagctcgggaggtgccaatgtgttcagaggcctgaggtttctccaggttcccaagtgtagcccgatgaaaagagaaacagcaagcagacagactaaggtgtgataaggtaggaggcaagagaccaagtcccagggatcagacagatgcagctggaacagacggaaaccccaatgtgactgtaaagaaggcaggctccactctcttttcactcaaatgcccatatcattattttataaaaccattaaacacagaggttaagatgaatgccttcggctttcctggtgtctattggtgtgtctttttctctcaaaaaacaaagcacctcccggagcatctggccattcatacccttcccccttcttctcaccctcccctcagtttccataaaaggttaatagaaaacttaattcttcagattagaaacacttcttctttctccagtgagacttcccttgtcagttctccatttttctgacacagttcatcaggtcattgctttcctaaaggttggcatgtgtgcctgtagctgggtttctgcctgagccaatctgcttataatcagtctgtttggttattctcttcctctgaatatatgggaactccacgacagcaaggactttctgttgctcatggctattttaccagtgcctagaatagcgttggcatttaacaatagcttaaaaaatccattgaataagttgagtgaaagaacgaatacatgagtgaacaaaccaaaaaaatttagctgacactaaacagaggcaaaaagaaaaaccgaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaacaccaggcacatttgagggcaagagtaccacattcaaaagggggggattcggcaaacatatattaatacgtattttggctcacctgggcttcttttgctcagcctaaaaggagataaagccagatggccttgcctcatctagcaacagtgaaactctgaatcaagaaagtagggttccagtcctactttgtaacaaatttgtctcctgcagaatttgccatgcgcttcactatttgcattcgggaaaagcgccaggattataccctggccgggaagtctggatatttgctttccggtgtctatttgccaaatataatttgttgccatgtcagtttatttttatcagtgcccattataatggtctttcaacagccagtcctatacctttcaagcaggaggcaaaaaaacatattttatggaagcctgaagagctaaagaggaaagatccaatgatgaggtatcagggattcatcaataaaatggcccagtcagatcatcttaaagaagttcacaatcaatacatcccacccacagcttagaatttcctcattctttttttttcctcattcttaaataatcctatattaatattctcagatgatactgcacccatgaaacaagaatagaactttttttaaaagaaaagaaattcacaggaaaaaagttattagaattaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacatacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcaggagatacatgacacaggacatccacaactcaaaagagaagtgaagggaatgcacagaatggtagcgaagaagatcataggaagacagcagtgtccagaaatggagggaaccggttcagacaggagcaggtcagaggctccaggaaagagctgaagaaaaggaatcagtagaacattccatatgtctcaatgtattaaaaggagattgagacagctggcagggtcagcagaagaattaatgataaatacatagaaaattaagctgatgactgaggaaggagaatggcaggaacctgagaggcggagcttgcagtgagccaagattgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggtgtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggaccttcatggactagaagttagggacccctgaactaggtagggttcctaggagcatgaacattctatggttccagcaccatttcagcccccaagcacccctcctctctacagcatcttaggagagaatgtaagttttaggaatggagttttccaaacagaattaatccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagtcagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaatacatgccataccaccaagttttgctttttatcaggtttgtgtgcttggctgtgggtaacagtctggattattggggggatttcagtggggcatgttccagtagtgagtattatctggttgccctatattctgcctggacctggcttcctggcccaagattagctatgagagtgcagctgtgtgaccaaggccagtcagtggctgagcaggcacatggtaaacatctgtgggtgacccagtcttcttggaggactttcaaactcactcccaacagccaacacaggctgccaacagccctagaacctctcagccaggcaggaggttggaaaagttgcaaagaactgttagcttgagatctgaacatgtcggtattcctgcgacaaaattacttactttaaaatgctgctctgctaaattctgtctttctggtccttttataaactgttcatgagggagaatcctcctaaactgattcacagatggttatataatactccagaatcatgacactggagtcttatttattttgagacaacttctctctctgtcgcccaggctggagtgcagtggcaccatcacagctcacttcagcctcaacctcccaggttcaagcgatccccacctcagccagctgggacaagagatgcacaccaccacgccatgctagtttttgtgtttttttgtagagacatggtttcactatgttgcccaggctggtcttgaactcctgggctcaagtgatcctcccgcccctgcctcccaaaatgctaggattatgagaagtcattttttaatctttcacgtaaacatactttactcaaagtatcctgactaggaacaagcatttgaggactcaaagtctctctattcaagtcttctacatttttgccaagaggttgccttttgggtgaatgtcccatgctaggcatgaaagagtccattcctctccttctggcgtaatctaaaatacctcaggcaggagatgtagtatttaaagtgaaaattctgatttgaatctgacacttttaactatcagaggatcactgtgtcatgcttttattctcaacagcttgacgttttgtctagcaatcaagagggtaaagatatgactctccaaaatatccttcagtacttccttcctctttaaatcagccatcctttcagcttggcccaaggggaagccaaagatcatggcattcattggtttaatggacaattaatgaaattataaacagagaagctgggcctgccacttgcctctgacggatcaatctagcacagtttatctaggttcacagtataaaactacaaggatccaagaacaaacaagaacaagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaaccttaaactctaacaacaaagtagctttattagcggctaaatttcaccaacatcacaatcgcaattagcacagtttaaaccttccttttctttccactgtttatggcaaattatacttttgtgaaacccaatttataccaaatatgtaaatgtaaaaatagtaggaatgaactttctctttcattcgttatttcatccaacaaaacactgagtgtctattgtgtggcaggaacacaagctgttcaccaactcttactcaacagtcacactaacctgtgtgagaatagatgtaccacaaggcccccgtcaggagtgctccgatcacaaaggctgcaaacgcaatgcccatcacggttagggtgtccagaccatggaaaattgctataaaggagagaaaccgatacacacaactttttggttagtctgcatcatgcattgcaattttatatttgtttcacaagcactgtcataaaggttgagcactaataaaatcggagaatgcaatgaagattccaataaaatacactgtattttgtaacttgcaaatttttttcaaaggttaaatgaaattatcaggtttccaaagtattctcagtttgcaatttattttgatcaacaaactaactaaaaaatcagatttgcaaactcagtaaaatcttgtctgtcatctcattgtctcactctaaggacctactatttgaatggagggtagcttgaaaattcacaggttaagatgctttggaaaataaagtgaacttccatgatcaaaatctggcttactgctgcttattcactgaacatctccaaaaatgacacactgcacagaaaacacacaccttagaatactttatacacatatttttgtgaacatttacaagtatgaaagataacagaaagaaaggagaatatagaataaaaataaactattcctgtggattataacatttcaccgatctcctcatattaaactcttaatcttaacagcttcatattgtatcatttaaaacaacctactttttaacacttttccaaccatgatctttctataaggggaacggaaatacttcccagtggggagtgatgtcagttttatggtcagcaaaacatataaatagaaccaattgtttctccatttggcaaaggtttttatatttgaaattaattccaggccccagaaatagaacatttcctttcatttaagagaactaccttctttgagtcacttataaaaagttaaaattggtttccaagggggaggagttttaggtagaatacaatttctaaggtctctgggttttgaatataagtgggaaatacaggatctccccactattatcatattatttctactttctgctccagtcagaagcaactccagtgatctctgtataaattaaatccctgcctttcaactcacttcagtgtaaagaaagctattttttttttacattgaagactgccatacactcctgtgacctttgggcagcccagcactccaaaggctcggggaaagtatgctgtggtggaacaagtctggaaggatccgaactcccaagttctggtccccactcttctagacctgtgctctttggtgtgttcatttaccttctgaaaaatgcggatagctttagtcacctgctgaagtcaggtggaggaagaggtgggaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccacggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagagcagacataagcatgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccatcccaagacaccctcctccccagacctgctttgttggcattttctctgggggacctttgctgagtctcccactgttccatctccatcccagcagagctagtctctcccacccttgctcattccatccctcctctgttacacttgggccacaatacctcctagttctctctctctttttctctttcttttgctttttttttttttttttttttttgctgtgagggcaaggtctagttctcagtcatctgtatatccccaagggctcagactggcatagaataggtcttccagaaatgtttggtgaaggatgattaaaatgttaatgtactttttgcaaatggaggccacagaggaaaccagcaatcagactatgaagacgttcatatgcagtttgcaccagtgccatgaagaaggcagaaaaaaattttgtatcactgttttggaaatgagcagcctgagactctgatatcgtgtgactagagcccaaggtcacagctggaaagcatcagggcagaagttgaatcagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgcttatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaattgatgtctataaaaataaagaagctagacaggataaaagaaaacagaattgtaaattctcaggattaaccatctccgatgggtgggtcaacattctggccacatgagttatcaatgtctggctctaggggaaggaatgctactggatgaatcagagccaccacaattgaatggtgccccctggagttgtgcaacatagtggccctggaatgaggatatatgcaaaagtatacttaaatacaattactaagaaaataaaaatgattgtatgtttttaagaaaatctaattcagtatgcagaacacacactaattacgctaactacagaatgcactaccctgggagctgggtcccatcagcctcattggcaccaataacaacaatgatgccttacatttgtacatttgtatggtgttttgcaatagacaaaaagccttcggccttcacttatattgtctcattttaaactcccaagaactctatgaaggaagagtatctacccacaaacttctcctttcaagacgtagtatttgattccctgaactaagttcaaaggcatttaaaggttgctacaagatgcatcatgtaagaaatatacacacttctgggaataattccatccaatcaaccacccatggttaaactttctcactcagaatccccaagcggttgaaaaattatgactctctcctaaggagacctcccatgtaagagtttaagttttatagtaaggcctgtgtgatggatggcattgttttaaaattcttaatggatttctgttatgatctaatcctttacccccaccccaaataggagccttctcacagagctaaacagaaacagttgttgttcatttcccctgggtgaagtctcttcgtgatttctgagcacaaacaataacaagcagaagctgcagaactgaggttaaagaattctatcctcgaacttttctcttcccgaatccctaagaacccctgagtataactaaaatggcttgatctccaccggaaccctaccatcgagttggcatgctgagaggaaaagagtggactcaacaatatttacttttggtttaaggataagattaagattataagaaaggaatcttagctattgctgtaaagagaactgtaacaataaagatttctttacagaaaggacaaactataatcaatgttctgaattaaatcttttcatatacgctgagcaaattttggtctacctctagaaccaaaattcccctcttcagattgttcagcatggttttcataaacgggatatttctggggttatgcatgagtaactgaccacagcttttggcctttagtgctcaatttggtactaggcaccataggacggagtgggcccacagtgaaacaagacgtccaactggtacccacatctattggcatttggcaaagagaagaatggggagaggaagattcctcctggagactcaggaggtctttgtgcaggccccatttaagacagagtttttactaacttaacgtcactgtaactgaaccctttttctggattctttcaatatttatgatattcattgcaattacttgttcacttatctgtatcctgccactagaccagtgtgtctcacgtggtgggtgatttttattccaggggacatttggaaacgtctagagacattttgaatggttacaactgggctggtggtgggagggtgttgctactagcatgtagtgggtagagaccagggacactgcttaacatcctgtaacacacaggcagccccccaactacaaagggtattccagcccaaacactgattgtactgagattgagaaactttgcactaggctgtaaaggccttaaagacaagataatttgtccactatacacctaccatatttttttgaataaataaccacaaatatcacgtatattttattcttgagtactttccccagcaatgcaaccttcacaccattttcagagtagccttcctaaatgacctaatcgccgggcgcggtggctcacacctgtaatcccagcactttgggaggccgagacgggcggatcacaaggtcaggagatcaagaccatcctggctaacactgtgaaaccccgtctctactaaaaatacaaaaaataaaataaaataaaataaaaataaatgacctaatcatcagtttcctgcttgagatcttctgatggttcttaacttttagaggtacatactggaatatgtatggatgaaattaaattaaatgtctgggtttccttcaaaacaatccagtggatgacagaaagtgataaaacaagattcaccataaattggcaattgttgagacttattctatttttgtatatatttgaaatttttcaaaataaaaaggttttaaaatgtaaaatactggccgggagcggtggctcaggcctgtaatcccagcactttgggaagccgatgcaggcagatcacctgaggtcaggagtttgagacaagcctggccaacatggtgaaaccctgtatctattaaaaatacaaaaattagctgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaatttcagaaaatagggtaggatggcaccacctcaactattttaaatgttttgtcataaaccataatatgcataaactatttatgttctctgggctttctgagttactactgaaaatcacagaacttctcctgaactttaatactctgctaaacaggttacacatttcccaacatcttaatcctttgggtgaacagacatttttcctaaaatccttcatcttccttttagttcataatcattagggtatttggggtgttaccttgaatactaatgtgatatggtatgaaaagggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaaaaaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctcaacaaatgttagatcatcatcctcatctccatcactatcatcaccatcagctttaaactttcatctattgttaaaaatttaaatggtaaaagaacgctaacccaacactgattcccaagggacttagagatcaaaagtggcaaagatgtgctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctgacaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcaaatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaattgtgattactctgcaacacaatttatattcttatttctttctcctgaacccaataaaaaggaactatttggaccatccatttatataaagactgggtctattataactttcaaatggttgaaaaccaatcaataaaagtaaaacaaacaacaacaaaaatgttgccgagaacatctcatgtacacttcacaacaactttaggacggccagaaaaatgaattaaagattattttgcttcttcaaacagcatagttgagtattacaactgaaaggaccttttggaagtcacccagtccaaacctctcctttccagatagagaaaatgaaacccaaagagctggtggtaggggggttctccaatgtcccacagccagttagcagagaaagctaaaagcagtgccttaggctcccagctccaatccagtgtgcctgccacctatactcttctgccattttgagggagcacattcattcataggaagggggcagatgccaccaccagatacacaattggaatggcacagctgttttcacagaggttagtcaaccaataagacactagacagtacctgcatgcctctgttctggtaggttctgcccactgtccaggggtcacccctgctgcctagtcttgccaaatcccaatccaacatgctcagatcaggaatgccatcccagggccacaccaaaccctagatctggtgtcagcaccacccagcaggccttccagctaataccctgaaactggagccagacagtgtgctggcttttgtcaaggcccttggtgcccaggctcctctgtgcccctcagagtggcgagaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatttgcaattttgataaagcaatacaataggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagcttctatggtaagaagacatattaatacagccatcattttaagtctatagcaggcatcccaaaaagctaatcaagttccatcttttccaaacacaaaagagcaaagactttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccgggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtatatgaggaaatacaggctctaaggggtccagagactggcttaaagtcccattggtggcagcagagcttccttctcagtcccaggctctttccatgttatcttaccttgggggtaaagggcgacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgcctacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataacactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtgtttttggcctgcaaactatctgaaaagcaaagataaagccagaaatctccctccatggaaaagcgtcttgatttatcactcgtaaggtactactaagtagcacgcatggaaaaaagaaactcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggaaagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacattgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataaacttaaacacttgtagaaacagctagtccttacccatagaccaacagccgcagaatcatttcaaaagacatggagatagaaacagactttccacgctgagatacccaggggaaacccctgacatcacatggggctttgaatccgcagcactgttgtgaaagattcctacgtggtggttaactgcaggacactcaacagtgaaaatgctaatgaagaggattctgataatgtcactgtggtgacattctgtaaatactaacacttcagtatttttgcaatacttctgaaaaacaagatattctatcttggaaaggtggcaaattacatatgtgctattactaaaaactgccgtttaacatgaactcagaaaccacatgccaaaatgtgtaacagagggactgcaaatctcttctctaatctcaaaagaaagtatgtagcggcagaatgtctaaggtatcccaaaaagggatacctttgtagcagagggaaaaaatatatattattttttaatatattttatgtatatatagtttatatatataaattatcagcaaatcttttactaaaaaggattttacttttagaccagaagtgagtaggagaaggactacgggctttgtagtgagacgagctcataaaaattacatgctctcctgctcacgtgctgggcaccgagactcagtttactcacctacagaatgagaacacgaatacccacaagatatcataattgtgaaaactagcaaagtaaaagttacatgcaaacaacacagttcccagagtgtcaataaatgctacctattagtaatagtagtattctagatttaaaattttgggttattaacaactgggtttgtaaattccccaagacaaatgaaccaaaagaaaactgccattatgtgaccaacagtcacctggagatgaccaatgaacaggtggcaacactgttaacttggattatgaaagggactgtatggtgtagagggaatagaggataaactatgagaaatataggtgatatatgaaaaggtataaatgggaaaacaagaatggaaaaaaaaaactaccaataacacacttcaagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaagagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagcgaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgattattaacattatatataggaaatagtttaaataagtttatacagatactcagatcatgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagattaatgacagtcatatgaaggatgaaggccctgtagcttcatgagctttggcttttaacatctgattttattttcagatagtccctaactaaagccaacaaaatagacagcattttccacaaaccccctactgataacaaacacataccaccacgatttcaggtcgggtgaacagggaagcatctccttcatccatatctcccggaaatccattatcacctgactccagatcttcataaccatctggccaaccactactgtccccaagggctggaacctgtatcacaatctaaaaggcaaagaaagcacagccaatgttataaaaacaccaaaccatgtgtgtttggttctgcctcacacaaacactcatgtaatcattctgatgcaaattgaaaatctgactttaagacaaaataataaaataacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaagctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatatattcccggaatctatcttgacataggttgaaattatgattcctggattatttctaaataggatgagaaaattcacccaagggtcatgacgccataaatgaaatcctaatttcttttgcttcacatgcttggattctgaacatgatgcaaaatagaaatatatagtaagtctgaaaattactacaaacaattataattggtgagaacagctaaaacagtctccaaagggagtaggatgggaagaaaattaaaaaaaaaaaacaaactgcctttctctctgtaccaggtcctccaaagaaagtactgacgccaattaaaggaagcatctaggatattgctaaactcaaagatcataataaagaaaagaaaaatatgtgagaaaaaaaggaactttaagggatcattacatgcctttctctcctgaagcaactgacttttttttttttttattttttcttaacagacatattactgtagccacttttggtgttaacttggaccccagttttaaaatgccataatcaagtatttcagtaatatatgacattcattatatctgtagacactggataactgaacgaaaattcatgctgcaattatcaggaggtcaaaggttaataaattaattatttgagtaacaaaaggagattagcagggcctagcctggtgtctaggaaagattagtggacaagaggtcaggaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttatccttataagggccagttgagcttgggcactgagagaagtcataatcaccttgacagtgcagcctttgtcatcaggagacggaaacggggggtgagaaaacaggccttccaattcccaaagactcaccaataaaacaaataaaaccaaagagctcagggtcaaagtacatccattttgttgagaactgacacttggctttcttcaggcctggggtgaaaaccctcttcatcttcaaagaaatgttaagactaactttaagggagcacacagccaggctctggcaaagggcaaagctttgttctggaaaacactcacggagttatagtagaccacaccatcaagggctgaccaccggggccgagtaccgcagccattcagaggagactccaaaacaaagtgtgtgccattcatcttggccttgcaggtaggatccaacagggtgacgtccatccccgagtagccactggcctaaaacaacaaccaccaaagacatggttggaggcccacaggcagttctgttgtataattgacacaattgacaattgcctggtcttccaaggacaggcgatgagaggcctgcatcgtgccccttccccaagtatctcttcccagctgcccacctctcaacagctcaagggtagtatctgttggccttggaaattcaatagcaaaatattgacacacaaggatctggaacccccaccccctgtcactgagaacaacaggaaccaggtgagaatcacagccaaggggaagtaggcccatccaactgagaaaacagtatcaagcctccggagttcaaaaatgaaagagatagggagaaattacagatgcagactagggccagatgggaaaggaggtagcctctcttccctcctgtaatcagctgcaccgacctgaaaagaatctttttctacagccacgatcatcttctcattgtcacatttgacagacagggcaatatccacgctcccttgcacctcttctggctctctgagaccaggaaacagttgtatgctgggaatgacagggtcctttggccgagggagcccatcttctccctcttcattccagactctcctggaaatatctgggaaaggaaacggaaggcctccattttggccttcccctccccggatgggcgggttctgcagggcaggcagggcaccagggtccagcaggatccgtagctcaggaggaatagtgtggacttcctcatctcccatctcctctgctggtgaaagaagaaggcaaaacatcagcagtgtttgatgccaggccacaaccaacatcattacaggcagaacaggaggaattagcatagaatgggcaggtgtaaaatgacttttaataagcagtgcataaaggtcattagaagtctagaagcctgaattctagtcctggtgttctctctaactagctcagtggctttaggcaagcggcttgcttctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaacagacagtttctaaggctgtccaagctagaaaaatctgtgatttaagttacatgatgcaatattattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaataatattctttggaaaggacgctagagctgtaagggtccaaaataagtcatagctttgtagggtttttaatttgtactttcacgaaaaccttcacaacaaccctgtaaggtctgtcctattattttccccttattactgaagaaaaatctgtggctcagaggtgaagcaacttctccccaaacagtgactaaatggtagagctggggcttgaacctgtactcctaatccttattctattggcatttcactcagtggtggtaccatgagctgaggaacaggtctagggatcacaaaactagggtttcaagtcatgctagctagaagactccagaaaacctcaagaatttgttgaccctctgctttccaccccattcagctggggtagtaactcctgccatcctctgggtatgaacactcaagtatgagtcctcgtgactattttcctaaaagatacagccttttaccatgaacttctttcctgcagtcttaactcttctgtattctcagccataagtggtcattaggtgtctcggagagaagaacctaatgtaatcacactaaagataacctataacaaagttctctgaatatgcattcaactctatgtcactgaaaatctgtattacagtttcctcaaaatctctgtctaggtaattttaagccttctgataaaaagtagtcaaattattaaaatgtacaagagaaaaacagcaacatataagctgaaatgacagttcctcactggaaaagcttcatttggggggtattttttacataacttaaaaaacttctaacttaccattattttcaagccgaagatgaaatctattagccacaggagccattgtgtatgaagttattggactatagccattgtccaaagcccacttcaccagattcccttgggttgaaggaatgtcatctcttattgatttggtcattgtcatagatctttcactctcttttccaaagccaatactgttaggagcctgaagatatagcaaaaaaatcactcatgagtctaaaattaaacagtactttagataataaaaattaaatatcttaaataagtagattctatattgtatatgagggaattatttattcttttgacccctgttttccttgggctaagaacgatgatgtgaaaaacctttaatagccgactaaaagacatctacgtatgctgcttgatcatactatttgtattgcctatgctgataaaaaaaatcatccaatgacatgtaagtagttacatactaagtatgcctagtctataactgtacagttagtctaatgtttaaattattaacacacacagtacatatgtataataaactttcccttttttttacttaaaatgacatataaagtatacaaacagacatgttatattgccctcaaattcccatgcttccacttcctattcccctagatttcaatgaaagatagcacaatcacttacagccacttaacaatggagatatgtcctgagaaatgcatcattaggtgatttagtcattgtgtgagcatcatagagtgcacttacacaaacctacatggtagagcctactacacacctaggctatatggtacagcctactgctcctaggctacaaacctgcacagcatgttactgcactgaatactgtaggcagtagtaacatgatggtcagtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactagctttcactggataatcaattacaaaattaaaatgacagaaatatttttgggaaaggatataaatggactctactcaaccaggttattcaacaaggacatggaaggtaaatttatacatcagttgctgactcctgtggcagtgctcttctcagagggtgagagagctaaatgctgcagaggggaccccaaagggaaggtaccatattttcaacaactgcaccaacagggctggaaagcccttccagcatgcagattacaccattttcgtgctgtataaaaatcactttaatttccatgcccagtgattttctcctgcatgcatgcagcatttttcctaaattcctcatttgtttcccattctgtttgcccctaacatgactaaatattaatcctttcccactgtaaaaccctaaaagattcacaggctctaagttctcttggcctatgtggttgtgggatattggctgaagccacatatatttcaactcaaatcttaaaggatctcattcagtatatttttctattacctaaagtgcttatgtgtgggaatactgccagactcaccagtcacaaattctatatgcaaaggaaccagacagaactttaaccaacttctgcggccatttgtaaactcagtttaatagattcagaatattttagctcttactccaattcagaaaaaaactccttagggtaaagaagggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcaccaatgtggaatgagctgtttgcacctttccagattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataaggagttaagtctaagtgcctccacactcccccatatttacatctggactgatggtataggggagggaggactaaggaagggaatggccagagagcgtagtgcatatgcccactgagatttttaaaaatgtattctctaagaacaagctgcccatcatcaaccctgaagtcctgaggccacatgaaataatataagaggaaacctctaacaggtttcctccatctatttttttatgttttagaggttcttcctaccataaaagtgattatgcatggtccacacaggacctgagaaaagagccagagctggacaaggcaatgtagacacctccaatgttcccattcttgcccactgcctggctctttgcacctcttttgaccattttgccatctggaggacacattctgcccatgccccacccccgacacacacatgcataagacatccatatttaatggtgctcttctttaaattactccatcagactccttacaattcccttagtagacatctttctttcttttcaccttgtatagagaagtgccctaattgttcctatagacactctgaaagagttatttatggaaggaagatgaaccccctttttatggcaggcactctgctaggcatatattatcttatttctcttccaaaatataaggagataggcattaccattcctgttagagaaggagaacctaagactcacagaagcaacacatgtagctgagaacttacatgcgcaggccctgtgtccagtgctttaggtgaaatatcctataggcccttaacaagtatttggcaaataaatgaacaaacaaatgaactcagctaatgaaccacaaactcaaggtgagtactatcatcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaactggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagagaaggcaatcaaaacatctctgacttcagatcatggctaggctttgggcttgacaacaaattaatgtatcaccattacatatgatggctcactgggatcctagcaaagttataaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggacttgccaaaggtcacagtgggattacctggactcagacctgggtccgtcttaatccaaggccatgtttgaacaaccgcacctattttataggagcatgctattttgcaaagtgaaaaataattgacagagcttagagagtccaaagaggcaggaactttaaaaataacacttataaagtacagcttaaattgttgtcatttatctaaacaaaacaaaagacatgctccaccaacttacaataattttcaggcttcccttaacatcaaaagatttgatcacccagttgacagactttttgcacttcaagatcaggatgagatttttgaccacttcaagatcctcttgagaaggtcttatatcaattgttatatccacctggaaagcactgtgaatggaagacaaaggcaaagttaagacctacatgccagaaagttgcaactatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgatgtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaattgatgaacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagcattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaacctgtacctagatcatgactccttttctgagcagttgacttatactgtcatctgtctaccaagcatctcctatctaaaaatccaatacttatgtatttcatggtcagcgtatttaacattcaatccattctatccccaaatgcactcctccttggatatttgttatttcaactatcaggagaagcaaccacctaattaatcctccgacaccccatgtagaattaatctttccctcatatgtattcctcacagcactttatactctgaagatgaaaggtaggaatttgggggaaataaagaaggcagactttcactctttctcacaatctgaacacagacaactcaagtttatatggcactttacagtttacaaagtgctttcgcaaacattatctcactgtgctgagagttgctcaccacctccacccgggaaagtgatgcaagtaccagaatctgaagacactcccacaacggcacatgccatttacacagcacggcggctgatgggatttccatccacgggcttaaatatttcaacagaacttgaaagaaactgctggcagtgtgacagctgggaccagtgtcaaggaagttctaggtgtagcatgcttttttcagaagggataattaatcagaggcctggcactactataaaacagacttctgccttttccattttgaggacaggatgccagggttcaagtccacatggaagtctcactttggagtaaggaatccaaccagggggtcccaagactgggttgatactgtccctccccctccccacttgtgcaacctcccttgtgctgaggtccgcagcacacactggggcatcatggctctggccaccacagcacccccagcaccaccccagaacaaaggggaccaaagcctctgtttgtcggctcgttgcgagagagcattgggtttgcactctgcagtctcctctaattcccctccccctcagagagaaaagctcaaggctccactgactcaggctgctagagcagcctccctccacatctgctgagggttttgccagatgagcaaatgaggtatgcacaccgtgcagctgcagccctgcggatgcctcccccacatcacaggatggaaaatgatattggaacggcaaggttgaaatttaattaagaaagagcgtctatgggccagggacaggacagtctggaactcaagagactagggccctcctgggattgtggccggcatatccagttcataggtgtgcctggcttgtatctggcacatagtgggcatatggtataggtttcctgaattaacaaacaatgatgtgagatttgagacaaataacaaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgataaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagtccaacattctaaatgttattataacaaattttcttattctaacaaattccaaggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcgttaaactcaagagtcaggaagcctgggtttgtgttctggctttgtcacttgttagtaacttggatgtgagcaggttcacttagccctccactaagccctctgtaaaacggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgatttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacctagaggaaagagaattgcgtatttaacatggtgcagtcaccggagctgaatcataattagagaaagtacttctcaaatcgaagtgcttgtaaatcgaacctcttccctttgttatacaagcagatcagcgtttttaagcagcggattcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaatcgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatcatcatcttgttgctgtgctataatcaaatttagttgctggtgaaaatatgtatgccatttttgttggctagcatttataaaataactgattttttcaatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcaattaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaaccaaagctactcacaacagctaccactgactgcacacttactacgtatcagtgctgtcaagtgtagtcacgatcatttctgaatgtcctgatgccagttataaacaaaaccagaggggaacatgtagctctaaccttgttttgacgtcgcctgaataagaaaaaaatcctaggtcattttcctgccaaaaaataaccatgcccacctaagtgtaacttctctgaggcttagctactcatcaacactgaacttccaacaatgtttatctaattttttgacttttgcactgtagtaaaatcttcctttcacttgtactaaaaaggcatttttatcaaggctgtcaccaaaacccacaacagtccagaggcctttgtcccactgccagcacagttctgaatgtttagacgagaaaccctggatgttctgcttcttgtttctcattcatgttgtggccataaactacagcaaccctatatacattatacacagagtacgtttttcagagcggaaagcgggatgtcacactggtgcattccagaggcaagaaagcaaacagcacaaatacagaagatatcaacggcaactccgaattgtgtcctgaagtaattaaagagcgatgccgtgatgaagctggtgatggggctgattcgtggaggaggaacaactccctctgctccctccaggcattgttgtcctcacgggccagcagcaataagcttcatacactcagggctgaggaatttggaactggagttaactgccactcctcaggcacattccaataagaagaaagcaaagctgcagtgaggtgtccctgactgcaggtcagtggaaattttcagcttcagcaaggagtgagctagcactcccctcctgactgccagctctcctgaccctgacaaggctacagctgagttttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctactagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctccatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgccatgtgtaagtgcctgcacctgcttcatcttcctccataagtaaaagcatcctgaggtctccccagaggcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctaataagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcattagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaaggctgaagtctgtgactcatacgtacactcccacactaacctgagcacattagcagtccttgctggggttccaggttgttcagccaactaccaagggacctcacagaaccttcctcatctttgtaagggcatcatgctacaacccaccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctacatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccaccacatccggctaatttttgtattattagtaaagacgggtttcaccatgttggcaaggctggtctcaaactcctgacctcaggtgatccacccacctcggcctcccaaagtgctgggattacaggtgtaagccaccacacccagctgggattacaatttttttttttttttagatggagtctcgctctgtcgcccaggctggagtgcaatggcatgatcttggctcattgcaacctccacctcacgggttcaattgattctcctgcctcagcctcccaagtagctgggattacaggcgtccaccatcaggcccggctaatttttgtatttttagtagagacagggtttcaccaggttgtccaggctggtcttgaactcctgacctcaggtgatccacctgcctcagccttccaaagtgctgggattataggcctgagccactgtgcccggtcacaggattactatttaacatgagatttgggcagggacatagacccaaatcatatcatttgctgaaatgaagacaagatatttccaggtcattcctctagtctaccagtccatgctccagacactgcattaattttcatggcatagcacccttatcagagtctggcttgtagaagaacataggatataaagagaatagcaaaacacataagaaatgtagggaaaataattttgtctaatatgagaaagggttgcaatcatcactgcaaggaagataactgcaagagtgtataggagaaaaacaacctatttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagtttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttctaacctctaatcacatggttggttcccttggcaaccagcccccatccagaggctatccaggagccccagccaccagtcatctcaccagcatacaaaaaggtacttaacacttcagagatgatgagggttggaggagctgtgtgccagaggaggagactatttattccatgccccatcttccaccttatccctggaggcttgccacaacactgtcccattttgggtccttataatctcaaccaaactgttgcagtaactttctaccctcccagccgctattcctgttccttctacccctcctccacactgtcacctgggtaatccttctaaaaagtaaacacatgataaagcggaatggcacctaagcatcttaacatggcgcatgactgaagtgcctctgcccgccctcatctcatgccaccctcccacatacccaagaactactcacagttgtagaacacatcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagggccaagaaaaaaccttgttcattctgaatcccttgggcctggcatagtgctgggcatgaagcaaggacccaataattgcttgttgaatgaaagctcaatgttgttacctacaggaaaagatacaccataattgattcattcccattacccaaactcattgcttcccttactgcccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgaggtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgattttcccaaactcactttacattttatttctacagtacttgtcaccttctaaaatgccatataatatgcttattgcccaactccttccactagaaggttccttcagaggctgggatcttagtgtgcattgtccatgggtataccccaagtgttgggtacaaaaaagatacttgttaagtatttgtttgataaataaaacaaatcttgatgtccaattaactggcagtgcctgcctaaggttctgtgctgagaaggattctgaggtcatattcaggagcagtggagaaatgggaacaaatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttactttttaaatgcaccaatagaagacttaaaattacatatattgttggcattatatttctattggacagtgcttctctagagcctcctccaatttgaccctaagaaaggaacatgtttatgaactgatcatgtccatccatctgcttcttggtctggtctcaacataaatcaatgtcaagaaaacatctcaagcccaacgcttcccaaagtctgatcctcagacagaagtacgttaaaatgcagactccagggtggtgggaggtagaaatgtaggaaactacattataatcctccctctaccactcatgattctgacgcatacttgaggaacattgttctaggccatagatatgaatattatttaaactccaataatctttataaagctcgaatgagattgtttgaagaacgagcaagaatctctcctctgcactgatgataaaaagccaagagggagagtgtaaagccaagtcatggatggagtcatctccttgcacatctcaaaaggaagaaatgggccttgtgaaataagagaaaccatagctccccaatgataatgaaaaagcctgttgagatctcagaggaaatctgttccaggaatctcaaacgcacgcgtacacacacacacacacatcccctacaactcagctgtggtccatttggaacttgagttatcagctgggtgagtgcctgctattcaggttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcagttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctctgaagccatgtgatgtgaaatgcaatccgaaacatgttttctattaacatatatcatgactcaatgccttttaaaaaagcttcatttcaaagaaataataacttccatgcctgtgaacctaggttcataatttgcaaagctacatattcatgagccatgtgatgatggtatctgccaatcatgcattcatgaaacacaaatccatgcagccatttaaaaattcttgggtgattttatttagtaccccaaaccagattactttcttccaataaaatgacttaaaacatatttgactattactttttctcaaaacattcatgatgatcatcctgttcttaatttttgctgaaatataaaaaaaacctaaatgactgaaaccgccccatgttcttaacaccctgcatgtttacacacgtccaagaggaaagctctgagatgctgccctccaaacacaaacatgcacaaacttgaacatgagccagtacaaaagcaatactctcatctcccatggaaacgttatcagaacaacagtacatgtgagtgtgtatatacacaaagagaagcaaaagatgtctttccatctaaaaaacaaactaagtccccacaagttaccaaactgatgaagcacaagctgctttctaatatagttttccaaagtagagtcccaggccacacaggaatcctgtccagctttacaaaaaattcttcagactcctaactttacccttcctcatctgccaatgttagcctgatggaagagcttacccccaaattcaaagtgcatttcaatctaaatgatgtttttcacgaaaaaaaataaaatgttggtatcattactattacttgccatattcctttatctaattttgtcctccaaatgtgctcctggagaaccccacaggagggaagactctctttttttttcttctaagttacatccaatcagccaagtcaagttcaagagcaaaaactgatttttacaaatgcctggctccaaacatgttcctagaattctctttatagagttttttttttcatcaaggctgataatctcaactccattttacagagaaggaaattgaagctgacagaagctaaaggatctacccaaggcacacagctggcagacaacagggttgacaatagaaccaaagacctggtttctcactctagagctctttctattccatcgctgtggaagagtcagctaccaggctcagaaatcagtagtgtagggtagacacgcacatccctcagcctcatgttaataaaacactaggaaatatgatattaatcacaaaagctcaggctgcacacttcctaagtgcatgtcacatggattctgaatcctcatatctgatagtggaaacaactggggctctgagcaattagataaagtgccagattacacacctttagcaagaaatgagtgcagattcaaactgtctgctggactccaaaaatgatgctctttccactgtgggaaggtggacactctgcctggaaaggtcatctcccgttggtgagggaactgactggctcacaggtcagcaaagacctgggtgtcttagggcaagctttctaccaagtctgggtaggcaaatacagaggaacattctccaggcttagaggagagtgaaaaggaaaagcagtgaggcaaagcagggggctcccacccttcactgctgcttgcagagattctcctggtgggttatttccctctctgtcccctcttccccagcaatctcaggagctgtgctggtcagagtggagaggaacggaatggaagggacagacagaaatagaaatgaaacagttaaagcaacgaaataattacttggctagaagtcaagttagagtaaacaacaacaaattgctcaaggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctgcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctcctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctataggttcaattctgaagccctgttcttggaacagtcatgagtggctccagactggaggccagagttagagataaaatcatagtcatgccctcgagtcagcagtgtgactgttcccaatgaggtccccatttaccattctggaaagtattattattattattattattattattattgctaacatttactgagtacttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactatggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggaagaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaaccttccttaacaaaacagtcactttttctaccgaacagctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgcgtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactgaccctagttcatgagaggatcaagacccatataattaaggcccttaaggacaagccacaaaaccaacagatgagcagactccggaataaaaatgcatggtacacaaccacttggaatatcccacaggacacaatgagtcattccacaagagacatttaaaaaaagaagaagaaccaccagcaatcttgaaacatttagttatttaatctcccttcaagagagaatttatctggggaaagacctcactgcaaaacacaaactggtatatccgggtccctggaatacaggggtaatgcttctggccgagccaagagctgtgtttgtgtctgcaaccttgacccatttgccacatgctgttctccagagccaacctcatgcaggaagctgccttgattgcatttggaagaagagaattctcattttctccaatttctactattctcatcttctccaattttcactattatttagcgtaatagtacttagcacactaaactgcaattcccaatttttcaatcagctctcccacacaatgggaagctccctgacgacaggcaattcaccccagttttccctagatcctccacagctagcacagttcacagtcaggcactaaaaactgtgtgttggatgaatgaacaagcacatacataaaccatcatacccggtatgctaattctgtgtttttttctaaacatgggggtgggggaactgccaaagaagggaaagaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccagttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaatagcatagagtttagtttctgtcatttattgcaactgccctgccttgatatttacttggatttgctgaagaggcaatgctcaatttgccagtttctgttccaaattaaattgggatataacatctagcagtcgtactatcaaagaatcacagagtttaaaagctgggaggaactttagagatgagctagtacgatcccctcattttagaaatgaggaaacgaggtctgagtagttaagtgattttttttcccgatgatgtatataactagttagtggcagagccaagactagtactcaggcctcctaacacccaggccagggtgttaactggaaacaaaaacctgaattacctccgagtagagctgcccaataaagtacaggacacccagttaaagttgaatttcaggtaaacaatgaatactttttcagtatatgttatgtcccatatactacatgggcacactaacaaaatgatttgttatttatctgaaattcaactttaattgggcatcctctatttttatatgccagctccagcaattgtacctcaaagaccaaaatccccttctatgccccatcccccactcaaacatacacacattcacatacatttgctctctgattttaatgataaatggctagaaaaaaatagatcacagcacagtaatatcgagagtgaatgaggttggaagaagctgcttatttcttgaaacttctaatcttagatacccttttttccttatgagcatgcaaagtgactaagcctgacataagtaagctggccaaggcctctggactaggtattttaggttattaaaagccaggcactagggtctcatcttgaaaacgtctgcttgtcctagggctccaagtctacagaccttgcaggagagaatgctcaagtttggaatacaaataaagcaagattaaaaaaaaaaaattagaggccgggcatagtggctcacacctgtaatcccagtactttgggaggccaaggcaggtggacggcttcagcccaagagtttaagaccagcctgggcaacaaagtgaaaccccatctttacaaaaaaaaaagtcaaaaattagctgggtgtgggggtacatgcctgtaatcccagctactcgggaggctgaggtgagaggatggtttgagcccaggcagcagaggttacagtgagccgagatcatgccactgaactctagcttgggctacagagccagaccctctctcaaaaaaaaaaagaaaaaaagaaaaaaaaatcaggtacatggaataaagtaaaaagatacatttaaaaacctagtccctgcccagcactgtggctcgcgcctataaacccagcactttgggaggccaaagtgggtgcatcacttgagaccaggagtttgagattagcctggacaatatggcaaaaccctatctctacaaaaaataccaaaaaaaatcagctggtcatgttggcatgcacctgtagtcccagctactcgggaggctgaggcaggaggatcgcttgagcccagaaggttgaggctacagtgaggcatgtttgcaccactgcactccagcctgagtaagggagtgagactctgtcctcaaaaaaaaaaaaaaaaaaaaaaaaaaaagtgctgcagcaagtttttactagttttatgaaatacagtccacataccataatattcagccttttaaactgtacaattcagtgtttctgtgtgtattcacaaggtgtggtatattcaccactatgtaattatagaacatttttgtcacctcccaaaagaaatctcgtatcattagtagtcattccccattttcccctcccatcagcccctggcaattactaatctactttctgtttctatagatttgcccattctggacattttatataaattggaatcatacaacttgtgacaattagcatctggcttctttcacttagtataatgttttcaagacccatctatgttgtggtatgtatcagaacttcaatcctttttatggctaatattccattatatggatatagcactgttttcatccactcatctgttggtagacatttgggttgtttccactttttggttactgtgaataatgatgctttggacatttgtggacaagttcttggggacatgtgttttgctcagttttccacagaaccattttacattcccaccagcaatgtatgcgtgttccaatttccctacagctttcacaacccttgttatcgccttttttattaaagccatcctagtgtgaagtggcatctcactgtggttttcattagcatgtccctaatgactcatgatattgagcatcttttcatgtgttttttggccatttgtgtcttttctctagaaaccgtgtatttaaattgtagtatgtccttaaagacaacttcatactgtggctctcattttagcaaattcaggttgaaggttcaggcatcatcacccagttaagttatcttactttttttttcagtgtagaaatgaatgcataaataaaaacaggcttatgtgatccttctaagagattatttgcagtttcaacatggcacactgagagggtaagatgatttttatttctgattgttctctgggccacccatacaccctgcaaaaggaaaactataagattattacaacttcatcacgtgtgtgtgtgactcacactcaaagattcactacttgaaactcagcctgaaagcatcactcttcatcccactcatatttcctaggtaaccagaataaccagataaaggagctgcacctgcagagaaaaccaaatcccactttctccctgcctgacacgttcccttcttgcctgtgctgtgagggggtgagaaggactgaaatgatttgacagaaaaagacagatgcctttattactagtattaaagtatgttttcagtcaccctcaagggtggctgcgatgtcctgggtaacataaggccctcctaactaattatgaaagttttccttttttaatttgggcagtcataacaacacagacatgtccatttaaataaaaaggtcaccctgataaatgagtagatgctattacttgaacttttctcattgccctatttaaaaaaaaacagttaaaagttctgtaactctacgtacacagtagacagctctgagacagaaatgcaaaccatccagcagcatatcaggaaacaggcaaggatacatgcatcgtggactgagagtcaagagacccattcgctttccacagctcctttaggctccctgggtaacctcggagaagacagtgatgaaaacggtgaagcctgaatttccagagatcccgtgggccctctgaagtgtttgatgaacactttatataaaataatttagttatcttatccccaaactttaactcttaactatacaaatggataaagagaacacactactggatttctattgatcaccagaccctctgtggcaaaggctatcaaggagatgaggagaaactaaaattcatttcaggccacagagaggaagggaaaagcctgcccaaggagagtggcccagcttgtgcaaggacttgcatcactcgttgtctgctgatgtgagaacgtgaatgaacaacagatgttccatcgtctcttccaggccaagaagaaatgtgcagacgggaaaaaaaccgttttccctaaaggaagcctgctggacaacaaagcagagttcaggtgtcctggaatttaaatccttgacttctcctgatgctgcctcccacgtgttggtaattttaggctcattacttgatctgcaatctccttacatgggattgatccaaatggggctgacgttcaattgtttactaaagcggccaccttctttcattgttagtgtctaaactgatgaccaagaagcagtttttacagattttaagcaaaattaaagcaaattaataactaagagtaagacactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatccggcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactgacagtgattatgagtacgaaggcagacagtttagcataacagcttgtagaatgggtcccatctaggtttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatgtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaattataatttatttatataaaatacaatccactgtccccctaatgtcttttatagcagctgccccactccctacccaacaggatccagctcaggatcacatgtgtcttgtctttttgtctcctctaatctggaatggctccccagcctttctctgtctttcatgactgatacttttgaagattataggccagttatcttatagaatgtcgttcaatttggttttgtcagcgtttcttcatgattagattcaggttatatgcatttctggcaaaaataccacaaaagtgatgctgtgttctctctcatttataggcacacagcgtccatctgccccacattgctgatatgaattttaatcacctggttaaggtatcatgggatatccccaaggtatatagtcactattttttatgtgtaattaataagtaatttgtatgaaagatattttaagaatatctaaatatactacttcctgaactccctccatctctgctagatttagcatctgttgataattcttgcctggtcaacttttattatgatggttgcaaaatgatcattttctaactcctttgctccttctagattttctagttggcattttactataaagatgagcttttccttttctcccttttattcatttatgtacttattataataattgtattgactatggattcttacattattcaacaagaacctttgagtttttagaagtactcttcaaacacaggggaaagaaactacagatctggattgagagacattaactgggcaaagtttattcatgaggcaagaggaaaactattaactggggactccacttgttttggatgcttgtgggcaagagaggtttaaggcctcaggcaccgcagttaggacattagcctgcagctctcgtaatagacaatgtgagttacaactaccaagttgcagtgctgctcatcatcagacatgatatcacaccaaaaaaattccatccaaacaacccatcgatttctccacaactagcacacttgaatgttctggcaaactcaaagggacatgatttacaaatagtaggtaatatttggatctttcgacaagagctgagttccagcttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcaggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtggactgaggagatgggattcaggtgaagtgtgacctaggaagcaacagaaagagggcagaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccttggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagagtgaactcatcaaacataaccataaagtaataagggagggacaggacaaaaaaggacttaggctagaaagacacagactgaatgatgcactgggaataatagtacatctcagctagaatcctcatgaggatgacatggtctagatccacgatctgtgtctatacaaccatcagggatacagcactaaatgctggactatttcacattttcccaatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagcttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgacttatcacagcaaattcatatatttatatgttacctaaaggggaaaaaaaggttcaaaggaatttagctggctaatttgcaaaaaaatacaaaaataagcaatactccaactgtcatgagctatttctgcacacagctaggatcatttttatatctggcataagcatagcactaaatcaaagtactagatgaacagtgatgtcaagtacagctacagcaaagtaatgtgctccttggttgtaaagactctacctcacagcacactttggagatgctgtccgcatctagaaataaacagattgatagccactgagaagaagagatgctatagaaatagcagaagcaaagattcaaactgtactgaacaaagagacacacacacactatggagaatgaaggagggatgaaatcatcatttgttccagtgtacctgaaaactgcaaagcaacactctttcactaatagcatgtatcagtaaaaggtttctctatttatttattcaagactatttactgagtaccataatgatgcaaagactagtaatgtatatctgcaggggctgcatcaacccttcttctgaagattttctttgcagtcctcaggcatacaattcttcttagagctcatagatatgcagaagtttcggtcaaaatatatactacaaaatactagtaagtatgtatttcaaatgaacaagaattttttataaaagctcatgaaatgagaagaaaaagatctatgagacagatattggtgctcaggtccaaaattttccagatggtcaaaagtgctgaggcctggctcatacaatcaagggaagatttctaggagccacagctctctgagctttcctggaaacagctccctcttcaatatgtggcagtgtctggccaagatgaatctctgactctggcacacagggtccaggcagagccccaaaagccatttggcaaagaagaattcacactacaattgggaaattcaaagaaaaatacccaatagtttctttaaaagatcatttggcagggacaatgagtcctgcaagtgcctgctcacctaatccctcagcaacctgtcttttctatgcttcccccgcttgagtaaatcttgctgaagggaagataaaggacaaccaaaacagctaacaaaagaaccatggtataaaagcttccagaaatgtagagagaacacacagcaatatctcaaagaattcctggctaagttgctcaatttctcccaggcttgggggaaaaaaaaaaagacaaaagaaaagaaaaagaaaatcctccttaggatcaattatagctcagggtagactacagttacaaatataagaatatcctgaagctttttgtggttacactctccagtgctcatggtctaaaggccgagctgaggcagactacagcaaataaatatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccctaaatggaaaagagttaattggtctaacctgttctacaacatctattcatactaggtcttctgcagttacctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtagattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatctgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattccctcaaaatatttttagagaactgggtgtggagctttaaaatttttcctttttatttttatatttctctgaatttctagaagaatattaatcagttggtgctgaattcaagaaatcttgacatacacacacattcccccccacacacacccagggtccccatcctgacctggggcactcaactaaccattctccttggtcaaatggtatcaagctctttcccaatggttttgtcttgaaaccacttaaagtgctgagaggggcactgtcagtctatttcaaaactaatctcccttccccccaacaaggacatgattcaggattccctgagagcctctgaaaatcatctaatataaccacaaaagagacaaaaaaaaaaaaaaaaaaaaaacctaaaatgaaagtctgaaacgggatgcagaaataagctctgctccatattttgtatgccctggaaaaatactgggaactaaatttgggttgggggttgaggggcaagagctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcatttctgcatccttaggcctagcacagggcaggacatctagtaggcagtccacaagttctctgaaagaaggaataaaagaaggaacgaacaaaagttattaatgaaatgtgactaggataataattacagagtcatattgacctgtttttctggccagaacaagggggttggggtgtatatagtaaacagaacattaacacacagtcaagataagcagattccagctactgaaacaaatgacggagatgcttcctggaaggtatgctggacagcatgccaaggccactcccaggctttgtaggacaagccaccctgatcatcatcctctctgtgtgtaagacagcgtagaatggcacttgggccatccatgggaaccataaaaggcaaagaaaagaaaatagaaaatgtttgttatcttaaacagttacgcaaataaaaacacataaaatgtaaaaaacctttggagcgtgttttcttccttagggatagataacaaagataaaatattttgagcaaatattccactatcttttagaggcatagaattttacacgggtttgcatgtaggcaattaagtgtgttagaatgattagaaattaaaattttagacaaactgaagaaactcaatatttgcaaattgattaaaatggagggaaagtttgctttttatatatatatattccctgtcacatttaataaatacatccattcagatcactttttgtttttaacactaatatgtaaccaaagccccatataactatgtgctatacaaacgtatttcctctcaagttctcctttttttgagacaagatctcactctgtcgcccaggctggagtgcagttgcacaatcagagctcaccgtaaccttcaactcctcaagtaatctcctgtcttggcctcccaagtagctatggccacaggcataaaccaccataaccagctaagtttgttttctttttttttttttttttttgtagagacagggtcttgctatgttgtccaagctgatctcaaatcctggtctcaagcaatcctcccacctcagcctctcaaaatgctgggattacaggtgtgagccacacagtacctagcctaatttctacattttataatgggcttcaaattagctttgctacatacctgtttagtaagccagtatgctcacatgtatatgtctttaccaacaacagaatgttagaatggcctgtgcatcagtactgtgatgtatcaaactgcataataaagagaatcactagagtgatcattagaagctgatttacaaaataagcatagcaggaactcaattcccacaaaatctgagtactggagtaatcattccacctgctacgtgcagtcagagattgaagctgtcctcactgggttaacaagaattccggacagaaaatataattaagcattaacatgctgctctttgacctagtttcttgtaaccaagtcacatagcactagattctcaccatttgcatccccattgctcctatagatagataggatgtctgatgttagaatcctaagggttttgtttgagagttgcatgagcagatcctgaattccaacgggacagctgacaccaaccagtttaaagactcccacaaaggaaccaccaaatcagcatgagaacacagtttcttcatccccctgtcccacgactttaccctgcactcttcgacccatcaacaatctccatatttcagcccacccaaaacccttaaaaactccaaccccaaactcctgtgggagatggatttgagttttcccccagttcagcagctgtacaattaaacctctgtctctgctgcaacctggtatctcagtgtattgacttgccacgcacgttggacaatgaacctattatggctgtaagatctcaataaggatttctgtttaagcagcatcttaaagttagttaatttgtaatagcaaaaacaaacaaacaaaaccccacaaaatgcagttgtagtcaggtagcgatttaagatgctctcagcagcaaaggatggcatttggattcccctgggctaaagtacaatcttagaaagtatattaacctgaagctggtaaggaattctttaggagtacagtgttaccttgctagcagaaatcagaaatccagagaggagtaattactaagacatgaacattcaaaaacaccgcacttggattattgttaaaaatcatggtggcagcagtagtaataaccatcatcatcatcatctcctaaggaaagacaataggtagatccatggctcctgttgagatttgctgctctcatcaaaaggaagtgctctgcgtaatatctaattactcccatcttaaaggtaaagaaattggtgttcttgccaaagtcatatggctagaaaatgacagtgctggaagtagaatgaatgtctctccctgtctgtctgtctgtctctccccctacctacccacccccatctttaatcttgggtgttagtcttgggacatagaggagaatgggaagctgctctatagcagtaagaggcaggaactattttactcctggaaactatatacaaactcagcaaagtaacttctcaattctttctggaaggagggataaatgcattaattactgttttgtattttcacattggatcacagaaaaaaaaaaaaaaagccatgctctttaagatgactttgtgttggccgggtgcagtgactcatgcctgtaatcccagcactttgggaggccaaggcaggaggatcacctgaggtcgggagttcaagaccagcctggccaacatggagaaaccccgtctctattaaaaatacaaaattagccgggtgtggtggcgcatgcctgtaattccagctactcaggaggctgaggcaggagaatcccttaaacccaggaggcggaagttgagttgagccgagatcatgccattgcactccagcctgggcaacaagagcgaaactccatctcaaaaaaaaaaaaaaaatagaagactttgtgtccagaggatattactgacctatgtcctgttgacccatctcttacagcatccagaatctgctgccttgtattaactttgtacatataaactatctcagagcatggggtgggacttgtatttttatcaccttagaaccttgtccagtatctagcacttacaggaattacattaatatttggtaacgaatgaatgactgaatgaagaaattgataggttttggatctgtgtccccacccaaatctcatgttgaactgtaatccccaatgttggaggtggggcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcgggtatttctttatggcaatgtgagaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaatctgtcatttgtcgaaagcacttagaacagtgactggcatctggtaagcactctctaagtgttagctattattacttctacccactaaaaccacagctgctattctccattcccttggttcctatggaaggaagctcttgtctataccatcctccattgaggcttcaagtcaaaacgggtttcctcatagtcctctaaacatcaagctgctggcatccttggactcggcccacattctcctcctaaaccaacttctctctgggcacacacgggccctgttaaccttcccctttgcccccactctctttcttccccacctggccaccccacttcctgagtcacgctcccaaagcttactcacagcactatcatgaccaacaacatctccaaggctcacttcactctagccagacttggagatacttcaaaggccccacatgattggagagaaggataagggagctgtgtttttgttttttttgtttttttttttaatacaacacatcctgaaggggatgccctgtttccatgtgtgtattttactctgacacaaaccgatcactctcaggcttgaacaagctcggtgaagacctccaccagatacaaaaccaaaaaggccgagacagctgcaaaggtttctatttccctagagatgggagtttcatggaaggctaaggatcaccacagcaaccagactacaaaaacagtcgtgggcttcagcaccgtaactctggtaaagcaatttgtgctctgtgaaaggctggggcacagaagttgaagaatgatcaaagtaaacactgctcctcaggcaccattttgttgtgctgatttcaagacactgagtctcagcatcaaagttctgttatgaaagatgcgcatcaagtgccaaagatttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaattgaaaaaaatcacctgttctagtctctgatctgccaccctaaatctatactgcagtttacataataaataagaaactacagcatactatttctacactctatagaagcagcaaatatagagtatagtaactaaaacagaaatctcttcatggatttataagaggcttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatgtgatgtgtacacatacttaccacaccccttttctctaggatgtgtcccatgtatagtgcgctgctttctgaatcttttgtggggaaggggtccacttacacaatttctggagtttcagcagaggctcactcagtaagtcagcagggactctgcaatccacaaaatttattgttccataggcccctctagcccagcagtttgcaatgcataagaggtaattagtaatatctaacacctaaatgcttcacagacaggaatgaatggcttggcttacgggcttgctcagtcttttctagctgcaccctcctccttttatctctaggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacgtctgtaatcccagcactttggaaggccgaggtggatggatcctgaggtcaggaggtcaagaccatcttggctaacacggtgaaaccccgtctctactaaaaaatacaaaaaaattagccgggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagctcacagtttgatgggggcagagggacaggcagatacaaacacatctgtgggcagcaggaagggggcacttcagctgggccagagggtgaatggggaaaggtggatctaaggggtccagacaaggagaagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcagagacatagaccctgatttgcttcctgatagataatgagtacattaacttctggcttagtaagtgtcacttagttaaccacattactgcactgattcactaaatgaacttccattacctgacttacttgcccaaaagaaaacatatcattcataaatctaataacaattttaaatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctggtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttagaacaaaaataggattgtctgatttctagaaaataatcatttgttgtttgccctcaaggagaaaaaaagttaattgtctgagaaacagaggaaattaactttcactataaaccacaaaccccggtgctccccaattttgccttcctcctaatgtaagatcctgacatatcattcattttaaaaagggggttaggcacagtagctcaggcctgtaatcccagcactctgggaggctgaggcggacagatcacttgaggacaagagtttgagaccagcctggccaacatagtgaaactttgtctctaaaaataataaaaataaataaataaatgatttttttttttttggcttaagtatcttactttgggcttcagtctccccataaatgaaaaggttagactctatctctatggccacctataaatctagagcctatggttctttcagcaactaatagagtcagtaaaagtcttcaggacagatctctaggccaggcacagtggctcatgagcattatcccagcaatttgggaggccaaggcgggcagatcacctgaagtcaggagttcaagaccagcctggccaatatggtgaaaccccgtctctactaaaaaatacaaaaattagttaggcttggtggcaggcgcctgtaatctcagctaatcaggaggctgaggcagggagaattgcatgaatgcaggaggcagaggttgcggtgagccgagatcgcgccactgcactccagtctgggcaacagagcaagactccatctcaaaaaacaaaagatctctagaaatgaatgtatctcaataaatgagttgatgtgactgaattatcaatttcataaatgccatgtcacactaaaatgatctgtgtactcaattaaaaggaacaattttaaaaagtttagtttagcctgccaaagtgaatactagagaacaaaatagaagtgctttctcctttcaacaagtgaaaatgtcttgaaatgctggcttgaaaaattaaataatgtttgttttagagagtttctttgctttccttaactttaattctgggtcagtgtgcccacttagtcttttacatttggcagaagcaaaacaaataatgaaatactcaaagctaatcctaagggtaaaccatgatttacagtgcattttaaaataggaagtgttgacatggtagtagtctaaaaacaagttaatatacttggtcttgctaatttcttttagatatacttttctttttttttttgagagtctcactctgtcacccaggctggaatgcagtggcacgatctcggctcactgcaacctctgcttcccaggtgcaagtgattctcccgcctcaacctcccaaatagctgggagtacagacgtgcgccaccagccaggctaatttttgtatttttagtagagatggggtttcactatgttctcaagctggtcccaaactcctggcctcaagtgatccacccacctcggcctcccaaagtgctaggattataggcgtaagccactgcgcccggcctagatatacttttcaatgagagagttgtataattgatactgaaagatgagcaggttttttttattgaaatataagtttccaataaatcaaaatatgatttaaaaaaaagagtaaatgcaaacaacagtatcccactgtcaggttctcaaatgccgttttgatgggataaatcctcctcagtaaggacaatggcattttttggttaaaccctacatcactagtctgagaacaagtctcggtcatcacaatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccattcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgtgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtggaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaagtactcactgagcaagaaaacaaaatcaaaaaaatcaagttataaggtatttaataatacacggtagagtaaaatgccctctttcagttagaggaatcaaagttaattaattccagcaatattaagaattggctggagtcaccccctacatcatgaggacagatcattctcaatggcccaacttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctagggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggggcacacacagggaatgggagagtgactgttaatagatacaaggtttcttcttagggtgatggaaatgttgtaaaattagattatgggccactggttgcacatttctataaatatactaaaaaccactgacttgtacactttaaacaggtaaactttatggtacgtaaattatatctcattaaagctattttaaaaacacaaacaggcagcaggcagaattcagtcctgcctagcacccttgatctgtccaccagccacaccgtgtaggtgaagaactttcctccacacctggcgcccactctgtgtatattgagtcctcccatcccttggctcaacaacactaatttgacttttaagccctccgtcaaatgttctttcttctgggaatccttccctcacttccagagagaatgaacacaccctttgttgggcttctgtacttttttttttttttttttagacagcgtctcgctctgtctcccaggttggagtgcagtggcgcgatcgtggttcactgcagcctcaaccttcgggctcaagtgatcctcctgcctcagcctcccaaatagctgggaccacaggtgcacactactatgcctggctgtttgtatttttgatagaaacagggttttgccatattgcccaggctggtcttgaactcctaagctcaagcgatctgcccgcctcagcctcccaaagtgctgagattacaggcgtgagccaccacagctggccttctgcaaatttttaaaatatattagtcatattatttgtcatgtttcattaaattcattctctctcaactctaataggtgctaaagacataaaaatgagtaagaatctggcagagcacctacctagcacacagtgggttcttaatagtgattcattgaacaggcctgtgaatgaataaacaaattcattatgagagcattatttagagaagtttggttttatgaagaggttcacaagctagacagaaagaatcagggtctaaagctgaagaggccagtcccaggagaccagttaaggaggctccagggtaagtggagaaaaacagagaaattcaagggcaattgcagaggaaatgtcaataaaatgtggtgattggccaaatatagggtttaaagagaatgggcaggccaggtgtggtggctcacacctctaatcccagcactttgggaggctgagatggatggatcacttgaggccaggagttcaagaccagcctggccaacatggtgaaaccccatctctactaaaaatacaaaaattagccaggtgtagtggcgggtgcctgtaatcccagctacctgggaggctgaggcaggagaattgcttgaactcgggaggcggaggttgcagtcaaccaagatcgcgccaatgcactccagcctgggtgacagagcaagactgtgtctccaaaaaaaaagacaaaaaaaaagaggatgagtaaatacaagatggttcaaaagttccaagatggatggtactggtgacattgatgggtcagggaagccagattgaaaagccagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggcgtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgacagccactcctccagtccatatctgaggcacctggcagctcaagatgggacccaagagccgggatgcttcagccatctgactgtagttccactggagaagcccaggcagagtttttggagttgtaagcaaggaagtgacaagcaaaatcctaagaccagacaagccacctcagggagaggagacagaggaaaacagaaagccaagggctatgcctcagtcaagaacccccgaggttaggcacactggctcacgcctgtaagctcagcactttgggagtccaaggcgagtggatcacttgagctcaggagtttgagaccaacatggtgaaaaaaatacaaaaattagccgggcgtggtggtgtgcgcctatagtcccagctactcaagaggctgagatgggagaatcgcttgaggttgcagtaagctgagatcgcaccactatactccagcctgggcgacagagccagaccctgtctcacggggaaaaaaaaaaaaaccccaagaagaaagagtgagcagctgagaaagaaacagaaaaacagatggaatggtagaatgagaaccaggaaaccaagagggaggtgccagaaagggagtgcttgacagcactggaggcttcataagctggggaggagcaagagtggggcaggcagatgtgtagaggcagctctgcaacagaagttggtgccccgaggggctagtccagtgctagcaccaagttcttggttaatagtgaacatgtcaccgctacaccctctggcctggttcccctaaggtattagggctaggtggaccccagggaccctctagtcctagcagcccttgagttgttcaaaggggcatcatcagggtctccccagagattagctcaggccacagagagggaagaagggaaagaaggacgtacagatgttcactcattccagtggagcaggggaaggaaaagagaaataagctgacctgaggcatcagaggggccaagtcatacatggcctcttcatcgtggaagaaagaaaagtgaaataattaaacgtgtctaaacttacacagaaatatttagaaaataccgtggaaggagtgattgaagtcaatgcaataaatacttctgcagagtttaagtatttaaatcagcgattagcagttaagtttccttttactctcaaacagaatgtcaagaagcagataagcaatggcaaggagaaggctcaagctggaaaactggagacgctgcacacgcatgcactgggcctttgcccaatcagcacatctgcatctcagatttgcagagctgctcctgacttgggtctattgcttttttttaatactctcccaaaagttctaagagcaaaatgtcacatttttaaatgcagagagtgctcttgtaaaaacattgtctaacaacactttcaggaaattatataattctttttttaaagccaagggcagttaccatggcaacagtagtacaggtcagggttctaaccctaacctccataaagacaaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcgtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgttttaacttcttagcttagccttgtgtcctggtttgtttcctaaaccccggtgtttgctattacctctctgatttctgctttcactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatatgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaatgtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggactgcattaggaagtcatttatgaatagcagcagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccccaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactgacatgtggtgtgataatcctaaaccatgaaagggaaaaaaagagacactgccacacacagaccaacttaatactgccccaaagctgcaaggaagggaatcaaaaaggactccaagcactgcaaagagttattacaaacctatgcacagaacccaaaccctcactaacagacctacttgctggctgtctaacaaagcagactcagcagactagcaggttctgtagcccagaaccaagtaagagctaaaaggaaaggacaactagctggagtatgggaaaagcttgcagcttgcactgtagaatccaacagacacaactcgggggctggctccacaactcaccatctggttgtataacctccctaagcccaagcatcctcttctgcaaaaacagtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtgtgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacgcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaaactcgggagtccgacacaagggggcggctgcattttacttcaaagtcagagggtactaggagctggttttcatggggatggaaaccatgacactggtcctcacttgctctaaaagataaatctgatctctcagcattgtttatgctcttctgctgtcctctgttgccagaaagtcattttccagtttcctgttcgcttccaaggctgttgtttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctccccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggccaggtgaggtggctcacacctgtaatcccagcactctgggagtctgaggcggacggatcacttgaggccaggagtttgagaccagactggccaacatgatgaaactccatttctactaaaaatataaaaaattagccgggcacggtggcatatgcctgtaatcccagctactcaggtggctgaggcatgagaattgcttgaacccgggaggtggaggttgcagtgagccaagatcacacaactgtgctccagcctgggtgacacagcaagactctgtctcaaaaaaaaaaaaaaaaaaaaaaaattggtagagactgcacaaaggctgcctctggccctcctactattaccctcaaaacagatcagctgttatttttagcatagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttggactaatgctgccatgaacagtcacagacaagtctttgtgtggacatgtgttttcacttctctcgggtatatacctaagagtggaattgctgggtcatgtggttcaaatgatttttaaaaactgtttgcatagctgcgggaatgttctccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgagatctgccgtatgtgagcaacgcagagccagatggaatctccaaaaatcagttatcccaaaatcttgttttcaaacagtattgaactacaaccatctaattcttaaaggtccgtctgttgtctattctcagaaacatcttcaaatcactggcccaaaatcatacatatactatactaatatcgaaagagaataatgttcaggtttttaaacaagtttgagactaccctttgtaggccctctttcttttcttcctcactgaacacactatgtccctgatgccagctaatgttatgtatcctcagtactgccaggtcctaaaatgaatcccattttgaataacatagtaaccaagtgcaggagagctctgctgtcactcctcgaggtatttttctcttgtttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaatatgagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggattttttgtggtttctctctccctggagagcgaatacctgagtgataacatttctgacacacagaagcttaaaaacagaatactctgtgttatcttgttgggaaatctgtactcttaaatgatgaccattcacccacaatctaggccatttttgagccacaggaaagaggacgccatttctctctgaagatgatgaccttgcgcaaataagttttctgcacctgttttgtcacctgtaaaatgagtataattgtaggattcatggagttactgtatgagtgcttcgaacagtgtttggcagagtaaatgctgagtaactatgagcatatatctttatcatcaccatctccgctaatgtcaccgccacctttgggaagctgcctagatagtgataaggagctatgctcagggattttcaggcaagtacaaagtaccgccatctttattccagagtgttcccatttcccctcactcatcctgcagaagcaataagttcatatgacaaagtaaagaaagaagacagaggacacaggaggaaatgggaaagacatttcacaacaacagagaaaacggtaccttatttggtttctcacaatcatgtttaaaagatgaaattattattattatttttgaaacagggttctgctctatctcccaggctggagtgcaatggcaatcacggctcactccagcctcgatttcccaggctcaagcaatcctcttgcttcagcctcccaagtagctgggactacatgtgctaactaccacaccctgctaattttttttttttttagttttatttttagtagagatgaggtcttgctatgtttcccaggctggtcttgaactcctgagctcatgcgatcctcccaccttggcctctcaaagtgctgagattacaggtgtgcaccatcaccatgcctggcctaaaagttgaaattcttatgaacgtttttttccaatacggagggccaggaaatggggagagccaaccaatctctagacagagaaatcctaaagttgcccaatccagacagcagctggtattttaaatctgttctcttatgttcatacatgagcttcttttgttgaaccccagaagagaagaaaaggacttctgtccagaaaatcatctctgcagactcagtggcagtgggctgagagctgacacctgcacctacctctctctgtagctggccaggcccctggcctgcagtgcggagattcaggacatgcacctcctgtggcagcccagttgtgcctctgctggcacagcctgacaaaacagtgaagctctccatcaaggcctggacaggatgggaggcactgacaggtgacagttcacacagtgcaccaggctctggacctgccaagggaatcacaaacacaagccactcagaaacagcaattaattctgccccaaaggggcaagggtgatcaaaccactgccaacccaccagagatgcctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataagatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccctagacaattacaaaccttcctgaacggagtctgaggactcaagctctgcatgccaccttccacacaggcactgtccacctaacctagaggcactcaatgttacgggtgttcccaaagcaaatgcctgccgttggcatctctgtgggaagttcctgtcccttcagaatagctgccctaccaaataaagcctgagctccaccacagagcacaggaggcccttcttgatctagccccttcctatgtctcatccctccccactccacgtcaacttatttaaaggtctccagacacaccaggatgtttcccaactccatgtcctcattcaagcctgcttcctttacccaaattcctcttccactctcactccgcccccacaacaaacatctcaagctgaggaaggctctctttctctgccctcccgcaatccatctgcctgtctccactactgcatttacatgatagccactggtgtacacatccatctttattggtcgaatgtgacctctctgagggctgtgggtactcatctttgtatcctcagcattcatctgcagtgcctggcatatatgagatgctcaaaaaacgtttgttaaatgtataaatgaatcattgagcttaaaaaaaattgccccctctcagatcagtgagtagggcaccattccagggacttggatttggctgtagggaataagggaaataggctgctacagccctgacatcactgcagcctcctttcacattggctggattgatagagacatacccaggggaagaaggaactggatgcttactcctcacacacttctgtgagcttggtgctattgtctccattcaatcacccaggaaactgggctgaaacagtgcccactacaccacaacctcccagatagaacccacgaaaaaggcctgaatgtactccagtttgttcttcctgacttctaaataataaaggtaccctccagggttgcaaacaaagttcagaaccagccagtctgcacccagaagcagacaccctgcctggtgggccaagtctatttcaggacttacagaaattatctaggctgataatagctatctggtctgaaatgaagtatgtgccttctcaaatagtcactgccactctctggactgtggccagctgctttctgagaaagcataaggtggtgaaggaagatgtcccgagagcaacaacaggaggtactgactgtaaattccctggagcccctggcggggtgcggggaaaccatatgggcaggtgctccctctgctgccctcatcctgccctcctggcctccggctttcccagccgcagtgggatgtctggtatacttcacacccagagcttcaagaaattatcctactcctactcaattctggggacacacactggctacagctacccacactgggaaacccttctgaactggttgcagagcctcctgccatgaatttacaattatcacaaattaagcacaaataaaaatgcctttcagttccattcttgtatgtgtgcaaagctctgaacaggctgaaaacacatctgcaaaaaggcctgcaatctatttgatctgccctcctctgcatgatgccaccatcacccattaagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaaaaaatatatatatatatacacacacacacacacacacacactcacgcatatatatacatatatgcatgcatatatgtatatatatgtgtatatgtgtgtgtgtgtgtgtgtgtgtgtatataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaagaaaaaaagctacaacatatgattaaactatccttacaccaaaaagacaaaaaaaaaaaatcaggaattatctaccaccatccccagggtcatataagaaatggtatctttaacagttcagcatacaacgtaataagagacactgctcggcccagtgcggtggctcatgccggtaatcccagcacttcaggaggccgaagcgggtggatcacctgaggtcaggagttcaagaccagcctagccaacatggtaaaccccgtgtctactaaaaatacaaaaattagctgggcttggtggcgtgtacctgtaatcctagtactcaggaggctgaggcagaagaatcgcttgaacccgggaggcggaggttgcagtgagccaagatcgcgccattgcactccagcctgggcgacaagagcaaaactctgtctcaaaaaaaaaaaaaaaaagagagagagagagagactgctcccatttattaagtgcccactatgcaatgctaggtgctgcatatccttctgacacattgcaaggaagcagcactaaccccattttaaagaaagcaaagtaagctcaatgtgcttaagtaactgtttcaaggttgccccagtcacccaaagcttcagacttggccctccttgcggctctctctctcaggaggcagggtcctgaagtgcccggccttgcagtaatcagggcaagagagatgatggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcctcagcctcccaggtagctaggattacaggcgcccgccatcacacccagctaatttttgtattttcaatagagatggggtttcatcatattggccaggctggtctcgaactcctggcctcatgtgatccacctgcgttggcctcctgaagtgctgggattacaggcgtgagccaccatgcctggcccatacttctttttctaagctccaggcctgaatattcaacagctccttcaccatctacttttgtctcatggacacccaatctcaacatgcagaactcaggatctttacccctcgtgcctgttgttcctccttcattccctccctaagtaaatggcaccagcctcttcctacgtacacctggcaccaacctgggggaggtgccccaacatcaccccttccctctcctcacccaatggattctctctctggccactcaactctgacccctcctctccatctccatgggcaccatcgtctctcgttccctgattactgcaagatgctcttaattcttatctccaccaaaatgtcttctatagagcagccaaactgatctgaaaaacccaagtctgatcctgcttttctctgctttaaaagacttatcactccatctctgctgtccagatgaagccccaaaacctcaacgtgacttacaaggccctccaagatctggccctgcttcctgccacggccccgtctctcattcctcggacacttgctcccgtgttttggccattctggtgaagcacagaagtgctcactgtctccctatagccatcattctcctttcttcaagtgccagctggacacacagccacccagaacgaaagctatgtttcccaatcccgctagcagctggcagcttcctgtatgaagggaaggaggtcagttcttctgccatttccttctgactgctggttggaatgtggatgtaacaggcagcactagagcaagcctttggggccatgagacagaagcagcatgctgaggagggcacagcaactgagaagccacctgggtacttgatgaacatggagccacgggatcagctctgaactgcttttttttttttaataggaaacaaatgtaaactcttttttttatataagccaatgttattttgggttttctgacatttgtagcttaacctaccctaattaatgtacttgccttcttttatttcatcagaagtgccaacctttgtcccaaaggagcctctgaatagcaaggtttcctccaggaacacattccccaccgtttctgttccttcccaccaccatggcctgacaaactcctgctcattctactgatctctcaaggaagctccccaaacctccctcactgtgttagatctgtattttttcatactctcatggtactctccgtttctctccacagcacttcctgtgatgagatgtacataattatttgtgcaattattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctttgtgccaataagggactgtctgtctcagacttcctgctttcactctttacctgagagccaaagcctcactcttatactaaaaggggcagaaaaaaaaaacaccaaccatgaaatgaaggaggtggcatttttggttgctaagaatcaagtcccagttggggcttccccaccttcaactgtcacagaaagcaggaaacacaaatctgtttttgtcttctcttcccggacactcttctggccaatcccctctctccaggtggcaggacaatcctctatctctccgttggcacaccacagccccagcctcatcctgccacttctgggtcaggccctagccttcctgtccctttccctctgccacagccagctcatgaacctgtctcccatccttcccccttggcctcatagtggttccttccgcaatctgtctgcacaatgccagggccagctccattcaggaaggcttccacctgggaacagcatgatccaccccacaggctctagcacaagtgcctgagttaacacagtggctcagattctcacttgaccaccatggggcccgagtatagcacctcccagccacgaaggcttggaaaccaggaaaacatgctccgaaaccccatctgactcatctgctcacttttgtggtgacctgtgagctctggagctgctactgtaggccctcaccggcagcctcaaaaggctgggagtgtctcctgtggccacggctgaaaacccacatcccgtcttccctacgcaatctcttccctgcagtcaagagccaagtgagtgacatgctctgatgatgctccttatcagcagcacagcaaaagctgtgttaccacgtaaggatcaaccagggcgtggacgatgacgaaagaacacacctgaaagcaacaatgctcataagcacacacgcgtgctcacttcacaccatactctatcatgaaaaggcatgttgcagatacttcatccaaagcctcacagaaactctataacccactataagtaaactgttgtgagccacacagaggtagaatgtgtatttcagaaaagtgcttcctggcagtaatgtccatatggattcacctccagagacaatcctcactggtgcctcccaatctggatatttcagttcattctgggcatctggtatgtgacgagtacaagattccttaagggtagctcccaaagaaatctaacttttccttggactcaaagtgtgagctgagtttaatcctcccctgctggcttactcgagaaatctgatctcaaaatcttgccgggtgtcgtgtcttgtttgaactgaagtcaggctctgctcttctgtttggtacactctcctcggccaccagcacagaggcacagcccccttcacccacaagatgctacttctactgacaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaataccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaagacttcatgaacttaatgaaactcgtttctcattttaccaaatgccctcctccatccttttcactaatgcttgcttatctggacacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcggggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggtttttgttattgtcccacagggaattctgaaatgctgtcagctgcaaagagggacaaactcccacagattgtgggactgggtactacaggatctattctgcccttgggctgaaaatcctttctacccccatgggatgcaagaatctgtaagaaagggcacccaggatgatttctcagccaatagcactgcctcacttcaatcgagcttcatgagaaggaatgttaccaacacaggatatgacgcaaaaacaaagctccaagaaaaaaacacctggaatgccctgagctcacaaacacgcctgacgtgtacataacatatgctcatgtttgtaccatctcaaattacaattcattggaactacagcgccttggggatggagcggtggaatgtaccaccattaaactccaaagagggcgcttctaccacagctcctacctgggtttttcaacaataaaacctggcttcaggctgaagcttatccctagtaggaaaaaggtagacaagtcctaaaacttgtaatttggatttctcagggggaaaaaaactagatttttctacagcacaactcttaggcatatcttatcatggtttctttcaccctccaagcaaaatctacatccaaaccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctctgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggacttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcattaaccctgagggatgacattaccaaatctgttcatctctcagaccttgatttgtacctaagatgatcactaattttctcttttttatcatttgcaaactggtgtctagcaagaaagaaaaagatgggagaaagagaggtaagaatgtgtgcaaaagcacggaggaataacatgcattgcatgtggcatgctctgggcctggtgagcattctgttagggctggtggccagggtctggggtgcagagtctgaagcagagacaagtggcaagatgagaaactgtaagagggtcaggaagggcagaagggggaaaccacaactgctggggagttgaatcatcgcctataaccactggtcctgattgcagataggagaccatggattaaaaaaggaaaatctgcaaacttttggtttggctgtgcaaaatattgttaattacagccatgtgtacacactgggccacgaactaaaacacatttactttaaggagtttatacataatcagggcactcacaattggttacaggaatgagtcaaatgcttaacactgaatgccaaattattcagcttaatatataggtcccaattataagactaaactctattccttcctcttcaggctagctagcctgctgcttcaggtgcttctgttaggagggaaactgagagctgacatttgcagagaaattatgaacacctggtcactggtgtgctcttgctcctttcacagtgaagctaaaaggctctgagaagctgtggacctggtttttccagagcttgtggcagttacaggcccatcaagcagtgccatcaacagaactactcagtgtagactgggtcttagagagacagaaggattgtgctcggctcagttgctgtggttcagaaccacagttttttgggggtaagtggacggggacaaggtctggctttgttgcccaggctggagtaccatggtgcgatctgggctcactgcaacctctaccttccaggctcaagccatcctcccacctcggcctcccgaatagctgagactacaggtgtgtgccaccacaccagctcatgtcttatattttttgtagagacggggttttgtcatgttgcccaggctggtctcaaactcatgagctcaagcaatccacctgccttggcctcccaaagtgctgagattacaggcatgagccaccgtgcctggcccagaactacacttttgtattgcacctgataaaattcagaggtcccttaaactgttacacctgttactcctttatagcaaatataagcttttataaatctattgcttcatttatttgggcatatgtttgtgtgtcctctacttaccagaaactccatgagggcaaggactgtgtttcttttacttcctctctcccagtgcttgacacagtgcctggcatgcggcacgtgttcataaacatttgttgagtgatgaattcatgtgccaaacaaccaaactcccaagctgctaattctctaaggactatggagccagtctcctacgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatgaaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcactccagtctgggtgacacagtgagaccttgtcttaaaaaataaattaataataataataataggaaacatcagctcttgcaagaaaatacttttccaaggtctcaatttaagaggcctgtaataaagcaagaatcagtgatttttaactttttaaaccaataatttgcattattgtaggtatgaaagcaagaagcaaactggcatttatttgctaaaagcatgtgatggagtttgtgatcttggcatgatatatgccatgacatatatcaaaaagtttggattttgctgtgtcgggtcaataagcaatttctgaaaggataaaatctaagcagagatatcagttcaataaaaggctaagagagaagggtataattcaatcaaattgtatttaacctaaaaataagataaagtactgtactattattgtttaataaactctcccccaaaaatttaaaactgggataaatgagatacctgttcagaaaaacatctattgagcttgctcaagacgaaactttacatagtaacatactgtaaaacatacatctgtatctgacaaagcaaccttccaaaacagatgtgtcatatgatgtttcaaagctgatttccctttttttttttttttgaagtttgtcacattcagtgaaagtaactgctgtttttcagaaatccgtgtgtgttattttggagaaaactttgctttggtgtttttccactctggatcaactagctcctctcttttcctcccaagcaaaccttcgtaaaccacactgccagagggaactcacctttctcccatggagacagctctaatacttgcaaatggtcaaactgaaaataaaatcccttgcatgccatttcctccaacaaaaagggctttgtctcaagatttgcacagaaaaacataccaaagctacatctattatttaaagtagtaattccttctctcagtatttcatattcctttcttcccaccttacttcatctggcccaaagaaccacctttccgccacacaataaatgcctcacttattcaacattgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcctgtgtctctgcctcaagcctatcacttaccatcttttacactcttatatactcaattttaagtcaatcaagtctggatgaagaccagaagatggctccccaacccatccacagagtaacctatatggacttttgatggctattttccttgtaactcactaaaacgttctgacttccttcatgatgcacaaacctgctgtaaaactgatactgtatcataatattagtgacaatattagggacactgtccacagtaatctaatttgaatggcaaaccatcaaagaaagttaagcttatgcactaaaggtgaactgttgggaatttagttcacaacaaaaccatgctaaaagctctattctattgcttctggggcttcaagcttttcagaagttctaagagaaaaaaacaaatgtataactaggtatgacaaagttcttatggtccctcaatcccattttctcatggtgacctccccttttctttcaggatgaagagatattcaacctgtacagcccagattaattacaattttagcataatttgcacattttttccactctagtttctcaatggaagttgtattcaccattccttcctgtcttctttcttgagtcagtgccagcaagcactgttcatagaaatcagatactcctaccagtgctccctggtccaggtcagtacgaatgatctaccatgaaccacagagtccagggcaggctggaaagcaccacctcacaaagaaaacacctaacggggccacccaaaggcccctctatggcagcagtccccaacctttttggcaccagggactggtttcatggaagacagtttttccacagaccgaggaggagaggatggttttgggatggaactgttccacctcaggtcatcaggcattcgtgagattctcataaggagcaggcaacctagatccttcatatgcgcagttcacaacagggttcacactcctataaaaatctaatgccactgctgatctcacacgaggtggagcttaggcagtaatgctcactcacccgctgctcacctcctgctgtgtgccccagttcctaacaggtccgtggcctgggggtggggacccctgctctatggtacaataccatttgcagctttctaaaatccagccatgacatggaatcttccctgcctttccatgttgattagaagtcggggtccaaattcactctttgcaaatcattattatgtaaggaaaggcatatgtatatgtatatgtatgtatatatacacacacacacatacatgccaagggctattactgtttctcatactcaagaaggttcgcttcctaagctccttcctgaaatgaaatcgtttctttgcccgagagatagctcataatttatcctagatttcaaccttttttagtaaaaagtataggaagttacatggaaacaatgaatggaagtgtacttttttttaatcaaacaagaacaggaaactttccgtggtttatggtaaaactacatatttgagccaaagaaaaaaataaactatgctcaacccctttttactctcccctatccaaaacatataagaacatgcacaactgacaaccacaagacaaatctcaacaccagggacaaattaatatttataggcttcaaaaatatacttccccaaattacttaataaaccccttcaaacaggccgacacctacttcttctactattgtatgaccaaaatgagtcataataaaacttaggaatattaaagacaataagtgaggaaattccagaaaatataaaaactatttcagggagccaaaacagaactatatttatttttctatcaaaatgcataggtataaataaacgggcaaataaaacaggcgctcacaaaagtaaacatatacccggctgcagttctacaacatagtcttctaaattaccacctcctccacattagagaaattacttccttcaacaaaattaacctccaacaccctccaaactgtaaaaatctctactatactgtgagcaatttataaaagcaggcatttttgaggccaggcacagtggctcacgcctgtaatcccaacactttgggaggccaaggcaggtggatcacttgaggccaggagttcaagactagcctggccaacatggtggaaccccaactctactaaaaatacaaaaattagccgagcatggttgtgggggcctgtaatcccggctacttgggaggctgaggtaggagaatcacttggacccgggaggcggaggttgcagtgagctgggatcgcaccactgcactccagcctgggtgacagagcaagactccatctaaaaataaaataaaataaaataaaataaaataaaataaaatagggatagtcctgtcctagctaatcctcagggtcatcatgaaaacaaatgagatcatggcatttgagaagtgtttaattaaatcaggaagttctataaaaatataaagataacatcaataagtatatgaaagatcaacagaaaagaacctcctttctcctcactacccactttacgttacaaaaaagaagcccacaggatacaatgggaaccttgggagcacagaggaaagaacactacatttggacctagaaggcctgggttccaggctcatctctgccattaacaagttccttgacttagggcccctctcttggttgcctcacctggagttaatactacataccttgccaaaatgaattaaagtaaaggatagcaaagaattctataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctatttttctttctttctcctcatttttctcaattattttccctaatccctacacttcactgaccactcctgcgttctcaactgcagtaagcaaatacatactaagttggataacatattattttgtatctatggtacacagctacagtgttggaatggctcctgattcttcctgggttagcaaatgttcacttaaatcaagtgtaccacctatttcagctattgagtctctttcatctttatgggactatattttgaaaatcactagaaactgcgtggttcccatatattgggctcaactgaaactttaaactcatgcaataactgttaatattcaagtataattttacctagcagtaaagttatattttgcacatcaaaagcaaaatgaagcattaagaaatttagttatatacattctttcatatccctttacataagcagaatacaaagtacttactttttttcccccaaatgaatacaggatttcaacaacattaagacatgattattttcacttactcccatataataggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctggctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgctatgaggcaaataaaccaagaactgggaatggccttcctttttaatcagtactttctgaaggatgctactgataacagaaaaaaaaaaaaaaagtcaatatacttgataattcacatctccctctgtcttggctggagttttttacagatgcatttacagatatttaaaataatgatcataaataaagctttaagtttagagtatataaatttttatttttcccccactcctgaaaaaggcttgatggttacttagctttttcttttccttttttttctattttaccaaacaagtttccacaagtccttcctacgcgtgtcctcacagccaagcaaagagcagtgagatttctcaccattaattcactcttcatttcacatgttcctacagcaccagctgttagtttatattttcagtctttactattaaaaaaaaatttcaactgcaactgcaccatttccccttagccccagcctttttttttttttttttttttttttttttttttttttttttttaggaaagtttaggacagcagaaaaactgctgagctgtgacacaaagaaaagctgactctgcacatgcctcattgttttctattttcattccagcacagttgtggctggaaaccagccttcaggattccccgtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgcatcaccacacactgagcacacatgtgttaaaatgctgacacattcattacaagaacatcatttatcctattacaagttttagagttttgcatgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggttcatgcctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgaccttgtaagcgaggccactcctcaaagagctagggatcccacaggctaaaaataaccctttgacccacatagaaattacaactcagaggaagctgagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattagttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaatcataatgctcaattcatacttttcagagggtgtagtcattcaataataaagaccagtagaaatattttaaatcttttgtaatcttctcagccaggtttgggacagcaactgaactgtccaacctctctctaaaggcattacatcataactgtaattacaccaggctgtaactgatatcaatgtaaatacacctactgtactacaccataacaacatcactgttatggtactataaagtattacaggcatagatgttaactgccacagtatttataataaacaaatactttaaaataaccagccgggcacggtggctcacacctgtaatcccagcactttgggaggccgaggcgggcggatcatgaggtcaggagatcgagaccatcctggctaacacgttgaaaccccgtctgtactaaaaaaatacaaaaaaattagctgggcggggtggcgggcacctgtagtcccagctactcgggaggctgaggcaggagaatggcgtgaacccaggaggcggagcttgcagtgagcagagattgcaccactgcactccagcctgggtgacacagcgagactccgtctaaaataataataacctaaatgttcatcaaaaagggtgtatctatatcatgaaatacatatgctgcatttaaaacactgttatttgtacagacagaaatatcttatgacatgttctttttgtatgtaaagaatgatacaatttattaaccttctaaaactatgtgtatttgtccatatgcatgcacatacatgcatagaaaaaggattaaatggataactctaactataaatggttcttacctaaggtaggggtgatgctagagacgggttggagacacgagaggaactctgactttgctctccatccttctatgaggttgacacaaaagtaattgcagttttttccattaaaagtaatagtaatggccgggcacagtggctcatgactgtaatcccagcacttgggagactgaggcaggcagatcacccaaggtcaggggttcgagagcaacctggccaacatggtgaaaccctgcctctactaaaaatacaaacattagccaggtatggtggcacacgcctataatcccagctacttgggaggctgaggcatgagaatcacttgaacctgggagacagaagttggagtgagccgagatcatgccactgcactccagactgggtgacagagataagactgtctcaaaaaaaaaaaaaaaaaaaaaaaagtaatggcaaaaaacacaattacttttgcaccaacctaatacattcttaatgcttttactgtgcaaatgtgtttttgaatattacttagataattaaaaatttaaaaatatgctctactttatcataaaaataattctgaccaaagccaatgctagttgattggtttctgctctacatatcttattttaaaaatcatatgtggtttaaaggaacaatctcagtgtctctctaggaagcagagaatcctggtttcctccacttcagtgacaacgccctctcatagacctgagagctgtggcccaacttcctcctcctctgtggtcagcaactctacggacctggggccttgcctgggtaggatgctgtagagaaaagacctggctttgaatcctggttctgtctataccatctgaaactttgccttagttttctcatttgtaaaatgaagacatctacactttgtgaggattacataatgcatgcaaatatacgatacatattaaatggtcaataaatggcagcttttatctttactattattaaccaggttagtctctagatttcagtatcaattctcctctgtaaagggagggcctatcatttgattattttgaaagttcccagctctaatagtctatgaacatgtgctatagaagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaaaaaaaaaaaaaaaaaaagatgaatcttagtgtgaccttcccaaacataaacttcattttccagcctcaccaatcttttagaacagaagatcaagtcaaatccctttagaatcaacgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttacagggccataaacccccttacaaagctgaataagggccgggtatggtggtacacgcctgtaatcctagcactttgagagaccaaagcaagggaatcacttgagtctaggagttcgagaccagcctgggaacatggcaaaaccccatctctacacaaaaatacaaaaattggccagcgtggtggcacgtgcttgtagtcctagctacttgggaggctgaggtgggaggactgcttgagcccaggagccagaggttgcagcgagccaagatcacaccactgcactccagcctgggtgacagaactagatagaccctgtctcaaaaataaaataaaaataaagatgaataatgtcctatttagtcgcccattcacaagccttattgagcacctatctagatggtaaatactatataaggtcctggggatacagaaataataacgcattttccttcttcaaggagctcacagtctaatgggaaagataggccagtgaacactcaatcatcaaggtgttaagggagcctggagggggagcctccctaattcacctcaaagaaggggaagatgagaagggtcaaaaaaaggcttcctagggcaggtgatatctgaggtgattcttaagaattaatataatctacccaagcaacatggataggaaatgatgaatctgtattaaaaccaacataggtacacatactttgaagaactgcgtggcaagttcttataaagttacatacaactcagcaattacagtcctaggtatttactcaagaaaactgaggacatatgtccagaaaaagacatgtttatagaggttcatagctacttaactgcataatactaaaaggaaacaacctaaacatccatcagcaggtgaatgaataaacaaattggggtatatccataccgcggaaaacattcaacatcaaaaaggaacaaattactaatacatgcaacaacttggctgttgattctcaaaaacattttgctgagcaaatagaagtcagacacaaaagagcacatgaacttctagaacaggcaaaactaatctatagcaacagaaagcagattagtaattgcctgggactggggatatggactacagggaggctgaagagaatgaaaggggtggagatggataatagaaaaattctctgtatcttgattgcagtggtgattgcacaggcatatgtattcattaatactcatcaaaatgtacctttaaatgtgtgcaatttgctgggtgcagtggctcacgcctgtaatcccaaaactttgggaggccaaggtgggagggttgcttaaacccaggagtttgggaccagcctaggcaacatagcaagaccccgtctctacaaaaaatacaagaaatagccaagtttagtggtgcacacctgtagtaccagtgactcagaaggctgaggtaggaggatcacctgagcctgggaggttgagggtgcagtgagccgagactgtaccactgcactccagcctgtgtaacagagcaacaccctgtctcaaaaataaatatataaataaataaagtgtacattttaatctatataaattatacttcgatataaagttgattttaaaagaaaaaaagagtatgtagtacagaacacagactctggagccagactgccagctctataatttattggctgtttaagagttaactagtaatggcattaatattcacactgcattaatatttagattataggcaaagatctggaagtaagaaatgacatgatagtatgaggactacaaacagtttggtatttagggaacataaatcaagaggaaagatgtgaaaacagatgaggccagagagacagacagccgaaggctgcaaatctctttgcccccacacctaagaaagagcatctgacatgccatgggtgcccattcaaatgtttattttcattgatgaacatccattgagataccattacacacccactaggatgactaattcaaaatgacagataataataaggtttgcaagcatgtggagaaactagaaccctcatatattgttgctgggagtataaaataatacaacaggccaggcgcagtagctcacacctgtaatcccagcactttgagaggccgaggcaggtggatcacgaggtcacgagttcgagaccagcctggccaagatgatgaaaccccatctctactaaaaatacaaatattagccgagcatggtggcaggcacctgtaatcccagctacttgggaggctgaggtaggagaatcgcttgaacatgggaggcggaggctgcagtgagccaagatcgcactactgcactcctgcctgggtgacagagcaagactccgtctcaaaaaataataacaataataatgcaaccactttgaaaaagagtttggcagttcttcaaagggttaaacacagagtaaccatatgacccagcgattctactctcagacacatataaatacaagagaaataaaaacataaggatgtgcttgactctggccttggccaaagccatacttcccagaaaaaagggaaaaaacataagcccacacaaaaacttgcatgtatatgaatgcccataacaacattattcctcatatccccagacaggaaacaatgcaaacgttcattaactgatgatgaattttttaatgtggtatatacataaaacaaaatattacttggccataaaaaggaatgaaataccaaatacatgctgcaacatggatgaaccttgaaaacatgctaagtgaaagaaattggtcacaaaaggccacatatggcatgactccatttctacagaatgtccagaataggcaaatccatagaaacagaaaatagattagtagttactagggcctggggaaagggaagaatagggagagattgccaatggataaagaggttttttggaggatgattaaaatgttctaaaattgactgtggtggcagctgcacaactctgataacatattaaaaatgattgtacactttaaagaggtgaattgtatggtatgtgtattatatctcaataaacttgttataaaatgtgcaatgaatatactatcaatagtccacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccatctcaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcattaccttgtccagtaccttatccctaagttatggtcctgttagatgtgcatttcttctattttaagtcccgctcacatttatatttagtaggaggccgctgtggtgagtggtgtgactgattctccagctgactgtcctaagccaatcactgtaactccattactctaccagggactgattcaaggatgggaggaaaagctgagtcaattcagccaatgattgcaaagagagacatactgggtgtctggggaaagaacctctctcgctcttagctgaagccagcattgcccttcctgtttgaaggagcaaaccgatggctcctgacagccattcctaagcaccagcacatccttcttcagctgaagatgaccctatgccagtaaagcaaacagacaaaacaacctaagtattaaataaaattagtcatattcccattttctcccatccactattaaaaaaaaaaaaaaggcctggccatgccacctgatgcctgtctcccctccctggtctggaggcacctacagagcagggggccaggagttccacgggtctcatttcctcccgtcagagcctagcacttagtcaaccactgcaagtcacatattttgcaagaacggaaaagcgatgaacagagagttatcaatctgttgttatactcaaccccaaacatttttaaaagcagattttaacggagaaaaaaaattacctacaggcctttcctattaaaacagatgaacatagttgcctttattgattcaagcaaagaccacattttactgaggaaaactttctgtcccttgccctctacctattcctgtggtgccaacatagaaaatgtcctggacttctagggaaggtaagctcccggggtggggacgccgtaggtgtgatgtaaagtgccaggcatgaggctggcatttgatgttaagcgctgtagcaacgatcacaacaacagaaccagcggggcgtgtacaggctggcggttacgacatggaatggtactggtttctattctcagcatgtgtcactgacttactgacaagacagttaaacataaaaggggtccattatcagtggtaactgggatcaagtccttgggatagcaggaataagaaaaatccagcagtaatccccaaacctcctgtttctcaagagtttcaatttcctgctccaaaccttttcaaaaactgctattaccaaagtaaactgatttaagttgactgttacttcctttccgtgatgtgacagccccaaaggatgagcagggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactactcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcgtcatgatcgctatagaataaacctgaaagggtttacttactaccctaattacaattactcagggtgaagcactggattctcctgcaccatgaagaactttcaaatgtaaccatgcacacctcctcttcccctaactccacacccccgtcaatattttggcttcattaactagtcaaaggaaaaagagtttgccaaatggcaaactcatatttcacacaggtatctcagccaagacaggaaggaaacatcaaatccatagcccagtgtataaatgttcagcactgaaatgaatgaaaacgaacaggacacttgtggttacgctttgacttaaatccttagttaaagggaaactaaagctgatccagttcagtttatcaacaggagagttcataaggaattatcatgagcaaacaggggcagccacccccgaaactgtagttgccttaagcagaaacggaggtgcaagtgaacttagctgtgaaagggtccctctggatggtcacctccacagaagcagcagctgctcaagccccaaggcacactactaaagttaaggagtgaaaggctgctggggtagaggaagaccgaaattcttccaggaaggaattctagtttaagcctgtattactgtcactgcagttccaggaccctcccactgcaggtccctctctcccaattccctggcatctagtcagaccaggaagagcaggtgagggacctcaaggactcctcaatgcagtgagtgggtgtttgaagctttaaggctaaagctgacttatacgtacgtgaaggagtccctctttttctgaccatcttcctgggcatgtgtcctgctggcaaatcaccaatgccagcactctctacctcccaaccccgccccctccaccatgacacctgggccatgacccaagcagacatgcagtaacaaggcacagtgtggctgggcacgatggctcacacctgtaatcccagcactgtgggagggtgaggtgggcagatcacttgaggtcaggagttcaagaccagcctggagagcatggtgaaaccccgtctcttctaaaaatacaaatattagccaggtgtggtggcacgcacctgtaatcccagctactcataaggctgaggcacaagaatcacttgaacccaggaggcagaggttgcagtgagctgagattgccccactgcactctagcctgagcaacagagcgagactcgaaggtcttcaaaaaaacaaacaaacaaaaaaaaaaaaacaaggcatggtgtggggaagagagccacaggatggcatcagaagacccatgcactggctgtggttctgacaaagtgacaccaaagggcacatatgctagaagggtccagccatagaatcatagaacctgtgaataccagaagcacccagaacatagcagtcccctcaaaggaagctctgagattcaaagtgtgctccaagatgatgtccatggctcaccaattcccatggagagttaaaactaccaaggatgctttggacacaagaaaacaatcactatgaaagcaaggactctaaggggacaacaaactccaaactcagttgttccagacaaggggtttttttttgttttgttttgttttgtttagagacaggatcttgctatattgcccaggctggaatacagtgtctattcataggcacaatcccactactgatcaggatgggagtttcgacctgctccatttctgacctggccagttcatctctccttaggcaatctggcagtcccctgggagtccccagggaagtcaccacactgacgctgaacttagtgcagacacctgattggcatagtgcactacaacagcccagaactcccgggctcaagtgattctcctgcctcttgagtacagacccaaatgatcgttacagtttacataaaggcagggcctgaaataaaattttcaaaaagctagatctttggtactcaacactctttccatctaaaaccagaactagaggccagacctgagcaatacaaggctgtgttccaaaaactgccaatactagtaccatgttctttgcctctgtctttctctggcataaccaagatcagctcagcctggcagggttatgcttggtgaagagggatacaggcaatcgggacttggtgctcgtccccaagggcagaatacttcctggctacttgtgtttggtatgtctttgttttggtttagccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtacacacaggtaaaaacttctggactggagtcccaaaggtctcttcaagttagaaatcatcaccattgtgtttccacctccccaaggcaagcctgtccaaaggccacaagatctgctagacctcacaagctggggcacaacctgcaccatgcccacctgcctgggttgttcatttgttaaaaccagtaatagtttgtcttttactctgcaaagtacagcttctgtcctcaaggtagatcatttcagacaaaaacaatttaaaaaaaaaaactgcactataaggcaggtcctcttcgctcttgcaaaaccaagtcaccttggctagagcccaaggaagctgtaaaatagaagtgagcataaacgtcacttagtctttagactcattcccatgttaacatggaataataaacattcttcgaccccagtgccagttccagaaataagtgatcatttaaaacttaagcaaaattaaggtttaccattcccagaaacatatgcttctgtctttatcaaccatgaaccaactaaaccactacaaggaaaggaaaatggaaatgaaaggtccctaattcgcagtgtaactcaaaggtaaacctgcagatttgggtcaaacacgcaaccaggacccaaatgttttatacacaggattttttgtgttatttccaccactgtagtttattacaggccagaagaaacctaaacagttaagaagtttgtccttaggcaaatagttcaataatttagacttcaaagactccatattaacctctgtttacacaaagtaatgtgtttcctttgcctgctgaacatcaaaacacgtaacaattaattacctctatttttgaaaacgacgtaagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcattttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggttccaaaatcgaagggagtttcttctcagagaaaactctgaatcggggtcacgcatggtggctcacacctgtaatcccagcactttgggaggccgaggcaggcggatcacatgaggccaggagttcaagaccagcctggccaacatggcgaaaccctgtctctattaaaaatacaaaaattatataaaaatataaaaatggtacatgcctgtaattccagctactcaggagactgatgcaggagaatcacttgaacccgggaggtggaggttgcagtgagcccagatcacaccactacactccaccctgggccacagagcaagaatctgtctcaaaaaaaaaaaaaagccaggtgcagtggcctataatcccagcactttgggaggccaaggcaggtggatcacagggtcaggagtttgagactgacctggccaacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaacaggcctggtaacccacgcctgtaataccagctactagggagactgaggcagaagaatcacttgaacccaggaggcggaggttgcagagagccaagatcacaccactgcactccaccctgggcgacagagcaaagctctgtctcaaaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccaggaggcggaggtttcagtgagccaagatggtgctactgcagtccagcctgggtgacagagtgagacttcatctcaaaaaaaaaaaaaggaagaaaaccctgaatcaagatatcccaaggaatatcccagtgagatctgacctaaatatatgtcctaattctatggaaaactcaagtactaacatattaaagaaagaaagaaacaaagaaaaaaggaggtccagatttccttaatcatctgctcagaattctcaatatcattttaactctacacatattttctacattgtccaatattctttgcaaattacctaagaaaatgtttaaagcctccagaaaaaggaactatttggacattatatactggaattttcactacatttttttcctacattgtaatgttttcatggttttttaacaattcatgtttctggcaaacttgttcttttaacactcaaagctaaactcatgtaacacatcatgctggctgcagtttgaagctactatccagctgggctgattttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagagacccagccactgcctatcccctgtctggctcacagccccatcataggctcaatgaggcaaaagtgttcccaactagatcaggatagctctaaccacaaatctgagccttgcttcttttaccaacagggagcaaagtcctctgagctccctcaactttgacacacaccatccggccacttttatacaacacttaaattgtccagaattcatttgcttcactgtcaccattcagatgggttatttgttagacaaaaattctatgtagctctacaaggaagaagtaagggctgggagaggaggttacagccagatgaactgtagcacaacacaaggaagaatttcccaagagtcagggatgttttaaattcaagtaaaggttgggggcttagtcaacaggatattagaaaggtagtttacatatcaggctgagtttgaccagataatctccaaggattcttaaaatgccaacacaggccaggcgtggtgctcacacctctaatcccagcactttgggaggctgaggtgggcagatcatgaggtcaggagatcgagaccatcctggctaacacggtgaaaccccgtctctactaaaaatacaaaaaattagccgggcgtggtggcggatgcctgtagtcccagctactggggaggctgaggcaggacaatgacgtgaacccggaaggcggagcttgcagtgagccgagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgtaaaatgtagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacgacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggtttaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatacttacaaatattcacataagtttacacatatacattagagcagaaaaattctcagaaatcatgcatttttaaatttgtgatatacataaattgacaaaaattttcagcaataattaaaaatctttcccttgctcattacagtaaaatctaataatcatgaaaacttctattcttttaaaggagcagtgaaagaaataattttacaggcccaaaaagaaaagtccctggagtccctgcttcacaaatactactgcattatatccttacatataaccttcatctttaacctagcaaatagcatactcgggagattgctgcataatgcccatgctgacaatgatagtgatttgaaatcatgtagtttggggtttaaagaaacttggagatagtacaaggcaatccccctcatctgccagctgagtacactgataattgagtgacttccctgcaaggaccaagagtccttggtggagtccttcattaaatctttatttggtccagaagaaaagattcccctactaagatatctcttctgtattattcagaaaaaaagcaattctgaaactttttgttgttaggatccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcaaactcggcgcactgcaagctctgcctcccgggttcacaccattctcctgcctcagcctcccaagtagctgggactacaggcacccgtcatcacacccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtatatgcagttggaagtttcaaatcttaagtttttttatgtttgtttgtttgtttttgagacagggtctcactctgtcacccaggctagagtgcagtggcatgaacatggctcactgcagtcctgaccttccgggctcaagagatcctctcacctcagcctcctgagcagctgggaccacaggcacacaccaccattcctggctaatgttttagtttttcgtagagacacggtctcgctgtgttgaccagcctggtctcaaactcctgggctcaaacaatcttcccacctcaccccgtgaaagtactggaatttacaagtgtgagccaccacacccagccaaatcttaagtctttttatatacttgtggttatttcttctttactattacacctaaactcaacaaataatcatttcttaagtttagttgcaaggtagcatctgaattacataataaatttttcatactccgtaacattaaaatcctttgctttccccaaaatactgcgtaatttcaaagtgaaaaatagtacctttacaccagagaattctggcagacatcactctagccaagtgaccaagattaacgtcactagtaataattcctatcaacataacatatcctcgatttgatgccctgaaaagaggacatcacctctatggtattcttccaaatgacacataacctcaatgtaatcctgagagaatgtcaggaaaaaaattaattgagggacattctccagtagttcccaaagcgtcaaggtcattgaaagaccagggaactgtcagcctggaggaggctaaggagacaaggcgactaaatgcaatgtgagatcctgggttggattctggaccagaaaaagaacattagtagaaaaactggtgaaatcctaataaatattatactttagttaataatattgtaacaagattaatttcttagttttgatcattgtactttggttatgtaagatgtcctcataaggtaaagctgagtgataagcctaaagaaacgctgtactacttatgcaacccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccgagaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtcatctgaaaaataatggtttactgccaaataagacatatttcattatataatattttaaaaatcacatttgttaatatctcaactgatttcatcagaaaagtatttaaccattgagaaactgtcataatcatggtaatggatgtaagttttccaaaattttaacttgtgtgaaaaacgaaattttattattggcaacaaatactgttgttttccttgaactaacaggttcactttgttcattttcttttttttttttgaaatggagtttcactcttgttgcccaggctggagtgcaatggcaccatctcagttcactgcaacctccacctccagggttcaagcaattctcctgcctcagcctcctgagtagctgagactacaggtgcatgccaccacacccagctaatttttgtatttttagtagagactgggtttcaccatgttggccaggctggtcttgaactccggacctcaggtgatcggcccaccttggcctcccaaagtgctgggattacaggtgtgagcccccgcgcccggctcactttgttcattttcaaaaatgtctgccaaatactgaagtctggataaccatcagttgtctgtcagtcactctttcacatcaaatggtgttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattataaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaaaaaaaaaaaaaagtagttttaggccaggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcacttgggttctcctgtcccccactggtcctgatcctcagcaccgccaccgttcttgagcattcatctttaccctgtaacttccagttaaagaccaagtcactgcctcaaaagaaaacaaggtcttttccatccaggtgctcagttcaaatccacctggctcagccaacagctcctcagccatctcccaaggacattccccaacctgctttttctccattgggagcacaaagctaaacagcaaatgcattctgcccataataaggttgttctagctctctctccccctcttttcctacacatatatattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttacggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagagaactctctagtttgtctttttgaggactgtatccatgtgaggatacaatgaaaagtcatcagtctgcaatttggaaaaggccctttccagaacctaaccatgctggcatcttgatcacagacttacagcctccagcactgtgagaaaaatacatttctgttgtttataagacatacaatctatgtgtgacttatatgtgactttgttatagcagtccaaactaggtaagtactatggtaacattttcaaagaatactatttccagtagtttcattcataataaacgtgatcctctggtttatatgcattatctcatttataatcctcacaagaacacaactgagacaggaactactgatacttcaattttacaaatgaggacactgagcctgtggtcacacagcctatgatctggacctgaacctgtgtgcctgaatccaaaacccaaggtcacaactagtgcacgatcctgactctctgacctttcatatgtctctgtcaagaccactcttgacactgtggtggagaattactttccctaaataaaggtgcagcaacccaacaaagttactcttcatcttgataaagccctcaggtattacccacattcagagggtaaaatctctacaaaatccttttgttacaagtccaaaatgaaagttcactggagtgactctgttccagcgaaactctgctgggaaagcccaacggcctgatggaaaggcacaacatccaatctttgggttccaagactgcctctaactctgacatttagtccaaaggaacaaggatattcattttactacatctcttgctcagcaacactagccttcagccttaaagaacatatctcacagtacacactgagctttgagttcctacaacttagagcaaaggcagccaggccgataactcactttagcaatagccttagttacacacccctgagctcactctccaggaaagtcagagggagtatcagttttcatcattattaatgaagagtagattgaagaggatagcattacagctctaaaacagaggttcttaaacataattctaataagacagacatgatgaatcttgttcacatttggacacactagagtcttcaaaagaaactagtgaaaactacaaaagcagtgctgaaagaaattaaggaaaacctaaacaaatgaatgggtgtaccatgttcatgaatagcaaaacagatactacaggcaacaaattatgagcacttttcattctatcacttgtaatcctaacttctctttctccctttgaaatatttttaaatgcaaataaccatacttattttagaataaccttgaatttagttttatctttttgaggaaaatcatttaaagtcttcaatttaactatcagttgtaatgttattcatgatatctcacaacctaactgggatatacaagtaggtcttgttatacagaattacctctccaaaataaaagcataatgagaccttttaaccataataaagcagcaaagaaaaatcatagtcttttgtcagtacaaaggctttcataattcctcatagctctcagatctgtgtttctatcaactcaaaaagttggctgggagtcatatgacagaaagggttaaaaatactaagctgctactctagacctgctggctgaggagcaggcaggttgcccagggtttcaggatagcccgcctcacacagagtaaacgtaggggatgctgtacacccaggaataaattcctcaaccagtgcatactctcctgaggcattcttgtaagctttttccaagttgagtaataaacagaaataatagatttttgggggcctttcctgagttcagggagatctgacaacatcacgaaatgtttcggcacagtcctctgaaatttttcattagaattcttttcttctgaatcatgttaataaagtaagatttggtctgggatttgtacataagtacttactcacatgttgctcaagcccaaaaggacaagaaaaagacgctgaggcctgtcaacaggaggcagggccaggctcaggaactggaagattactggatggatgttttcaaacagagctacacacagctcccttatataacactcaattggcttttagataagtctgaaatatccttctatactttgatcttcagctgtctccgttgccttcagagtcaacagaaactggcacttggctccaaaagcctcaaatctctctcatctataagggacagggacttctattatttgtctacaatttgtcaagctgagttaattataggtgttatcattctatatgtcaaatgtagcaaaataatgcaaacctgtttacctgtttcttcctttcctgcatgtagtataccctgaccttaaattggcatgcacttgatttcaaatgaagatttttttaaacagcatcttccaactgcagtagcagttggaaaattcactttttgctgacctgggccacctaaacagaggacatgaggaacctgacttgttttattttaagaagaaaaaactatttaaagccctgatcctggctcctttgaacatttaacacttaaaacctgaattgttacactacaaactagagttccttttcctctatttaagaagaggcccttgcgaagaatttatttagttaatgaaagttaaacaattgtgtttctctcacaaaacaaaaataaacaaaacctcttgaagatggtctctgggctctctaggtctgcaagtgtccatatgagctccctcacggagagcctagagcagtacactggcagtttagaaaacaatatagccacaagcacttctccaaaaagaaaagcaactcccctcttggcccaattccaaaacgcaattgagccgggtaaggtccaagctaatctctgtaccgtctctctgccaactttctcctgcaggcattaggtttttcagcatgggctttgcaaataatctaacaattaattagtgcttttgaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacacatttttgggagggctagaaaaaagctagcaggggggcaaaaagaaaaaatattgttacattcctcaggacttttctggttcaatttcaaaagcagaatgaccaccacctgagtcttgcggcgagctccagagctgtacataggttgtacgctgcctctccaaaaacagtgatgaggccagagaaagcaaatcagaaaaccttataaactactcaatggcagtgtaaacaaataaaagttagtttaaaacacaacttttcaggcacagagcttaaatattctcagtcttatccccacttataataaatgtggtgtcagggtgcttaataaacatcaattacaacttacagaaatttttcccttctaaaaaatgttaattttttaaaagctctagactggagtgtgattataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcaaaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaacttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattctcatgcatataagaaagcactggcctaatatttgtttataacctcaaactccaaaagcaaaacttcctattccataaacaagatggtatattccacctctggcaaaaccactcacctctggcaaaaccactatgaatatccttattataaaatatatttaaaagtgattattttctttatagaaaaaaatctgttgtatcatgctccttgctcacatttaatatgtagtttaacttataaaaataggttgacctacaactcagaaacatttactatgtaaaactggatgcaactgtatttcttcgaaactgtaatttacaacactgtaagaagcacttctgcaaaaggtggtaagaccctcaaaactcatgatcctgaaaaccaggccccctgagaaatgaaaagaacaagacttggaaatcaggagggtaagtaagcaaggaaaagagggtttaggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattttctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatatccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttaggaaagttaactgtattagaaaaaaatgaaaaggccagcgaggtggctcacgcctgtaatcccagcactttgggaggccgaggcgggccgatcacgaggtcaggagattgagaccatcctggctaacacggtgaaaccccgtctctgctaaaaatacaaaaaattagccgggcatggtggcgggtgcctgtagtcccagctactcgggaggctgaggcaggagaatgcatgaacctgggaggcagagcttgcagtgagctgagatcgcgtcactgcactccagcctgggcaacagagcaagactccatctcaaaaaaaaaaaaaaaaaaaaaaaagaaagaaaaagaaaaaaatgaaaaaactcattatttgcactaaccccaaagtctctcccctttctgtgcctcagaagctagcaaagtacctgaatcttaggaggtacttaacgttgaccagactacaagtcttcatctaaaacatagtagttatttaaaagtataaagaaaaggcaaaataagtggttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcaggaagatctcttgagcctgggaggttgaggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcaagaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactagattgaagttcaggataaatgttttttaggccattctggcagagatcgttttaaagaaaatgaaagtcagtggctgccatggatgtggtgcgggatgggccaatcatgcgcctcggtgctgagcagggtcagtcctaaaggaaggcctcttgctggcacgcttcccggaacacttcccagaacactccctgctcctacatcacttccaaaatcagcgtgctcagagctcgaagctctatggggtgataaagatacctccagagttggattaattaccaaagcaaacaagctgagaaagtctaatttcctatatacacaaccgtgtgcaagggtaagcttttagcaattaaagagctgtgtaggcacatacagataaagctgtgtcttgatggaagtgttgatcactgtaaaacacaccatcactgctgtcctaaaataacccaaatcaatcagaaatccagaaagctgggtggcaattatacagcctacgataaggatgcaaagcaaagagaaacctcgattctcttgacttggctaacatcacatctagcaataatcttactcattcttggtaaacatcctcccctccactatatgcacattcagttgcccaactagctattagtaaactctccttgaaaatgataaaaagggccaggtacagtggctcacgcctgtaatcctagcactttgggaggccaaggcaggtggattgcttagctcaagagtttgagaccagcttggaaaacatggcgaaaccttgtctctacaaaaaatacaaaacttagccaggtgtggtggcatgtgcctgtagttccagctactcaagaggctgaggtgggaggatcgtttgagcccaggaggccaaggctgcagtgagctaccgtgccactgcactccagcctgggcaacagagtgagaccctgtctcagggaaaaaaaaaaagtaaaaggccttgcattaggctatccaccccacctccacacacacacaggtccatacagggcaagggaatctttgagaaatgaactcacctttctctcaactactgcctcaactcccgtgtgtgtgtatgtgtgtgtgtgcgcatgcatgtgtgtgttgtgtttgcacacgcatgcacgcacatgctgtttctgtagaaaaatctaatggagaaggtaggtggggaggtgcttcatcacacttggctgtgcacaatatcctcaaagggaatacactctaaaatgcaggctaccctatccactctgggtctttcttttatttttgagacctagtttcgctcttgttgcccaggctggagtgcagtggcgccatctcggctcaccgcaacctccgcctcccaggttcaagtggttctcctgcctcagcctctcgagtagctgggattacaggcagccaccaccatgccactctaggtcttttaatagcagttatttgctctttaaaataaagtttggcactctggtgataactggtatcacatttgacaatatcctttccttgtgtatcaaaaagcagaattaaacacaaaactggttaaaataaccagctaaaggccaggcatgatggctcacacctataatcctagcactttgggaggccgatatgggtggaccacttgagctcaagagttccaaaccagcctgggcaacatggcggaaccccatctctacagaaaaaaaacacaaaaattagccaggcatagcggcgtgcacccgtagtcccagctacttgggggtctgtggggggaaaatggcttgaacctgggaggtcgaggctgcagtgagccatgatcgcgccactgcactccagcccaggcaacagagtgagaccctgtctcaaaaaaacaaataaaataaaaataagataaaataatcagctaaaaacaataataatcacagaccaaatcaactagctgtgttctaagacctgagggttggcaaaaaaaaaaaaaaaaaaaaaaagaagaagaagaaaaaaaggggagggggctttttttcagtttgctttgaacctttgagcctatccatcttctatccttacattccctggtggtagtcccctgccagcaccctccagccttcctgcccttatgagtattacagcctttgatcactcgtttggcagacaggagataactatggcagaaccacctctgaggttcacaggccgttaactcacatccaagatttctctttcaagtacaggataaatgaataaattgaataatgaaaatgtggtatatatacacagtggaatactatacagccttaaaaaagaaggaaatcctgtcatttgcaacaacacagatgaacatggaggacattatgctcagagaaataagccaggcacagagcgacaaatatcatatatgatcaaacttatatgcggaatcttaaaaagccaaactcatggccgggagcggtggctcaggcctgtaatcccagaacttttggaggccaaggcgggcagatcacaaggtcaggagttcgagaccagcgtggccaatatggtgaaaccccatctctactaaaaataacaaaaattggccaggtgtggcggcgcatgcctgtagtcccagtcaggaggccaaggcaggagaatcactcgaacccgggaggcggaggttgcagtgagctgagatcatgctactgcactccagcctgggtgacacagtgagactccatcccaccccctcccagaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagatggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggcccccttcctacagccccctataaaaatgtgaaaaaaaataatatattttacacatgaaaattgttaagagagtatattttaagtgttctcaccacaaaaaatgataagtgtgtgaggttatgcatatgttaaaaagcttgatttactcaccacaatgtagacatgtataaaaacatcatgatgtacaccataaatatatacaatttttatttgtcaagaggtgctaagggtgcactataccaaaaaggtcacaggatttgttggtgcagtttgtctgcaaaagcatgtctaagttctggtccaaccaagacttgaattatctttctaaatcacttactttctctaagccctattattctcattctagaaatgaagaaaatagtgcctgcctacccccagaggctgctgtgaggatcaaatgaaatacctgttataaaaacatttttaagattacaaatacaatatggtattattagcctctactcaaggctgccagcttgtaccattccagaccaagtattaaccagctggtatctcagcttgctctcccacagacacaaagagttcagagctttctgagcaggaaaatagctcagactaaaagcatctcgattttcctgtggactctacctggaattccaggtacatccagtagagaggaaaagaaatgtgtttctcaatagaaatctgtgcacagtttgcaggcgagtttccaaaaggatacatctgggtactgaattgagacagtggaatgaagaagttagccattccaccaagagcccactggcatcaatgccagcagccctgctccagagctcacctcagcggcacccctctcacctggcacaaggggccagtgataactccagcccttccaataaaactgatttccctgaattctccatgcatgcctctttttcttattactaaaactcctggaaacatagccctgcctaatgttggcaagcctcagaggcagcagctaatatcttttaaagatgtgtagaacagttgggaggttgttttgtttttgtttttgtttttgccttttcaagtttttatttttatccattttttgtattaaaaagaaaagcacaattatcacaaattacaaaggaggaaagcagaactagaataataaatgaatcacttcagcctggaaagcagatattttcaataatagtaatgttataacacaagtatagacgagtttttaaagcaaaacttagacttaagcccatagtatcaagcacttattttttaaacttcccacttttcttacattaggtagcttacaggatctaagaggccaataaataaccttagataatttctttttttttcttttttgtttttaaccccaataaatctcttgtatttattctctctcttttttttttaacccaagtaaatcacctaagctaatttctaatcaagaggcattatggtccttacacagctcgtgttcaccaagagcacagtccaccctccatcctcaacagtgctatatgataacgaaggaacgagggaggggagggaaagcatgagttttttgttttttgagacggagtttggctctgtcgcccaggctggagtgcagtggcgcgatctcagctcactgcaagctccgcctcccgggttcacaccattcttctgcctcagcctccccagtagctgggactacaggcgtccgccaccgcgcgtggctaattttgtttttgtacttttagtagagacggggtttcaccgtgttagccaggatggtctcaatctcctgacctcgtaatctgcccgcctcggcctcccaaagtgctgggattacaggcgtgagccaccacgcccagccgaaagcatgagttttgtcagaacaacactaacactgggacatggatatcccccgacccacccggccccgactgccttcattcactctctatcacaagcagagaaggaaagaaaggttttcactgaaggcccagacaaacctatggagctggaacaagcaggctcctattattctaacttgggctcaatttacgtgctcccttgtgctctgcccctcctctggccacataaccaaaaggaggcctttgacaaccttcacccctctgctgccagacctccacaccttcccaccgatttacagctttaaggccactttggttaagtcagaatatgaataaagaaggcccactacttgagggtccttctgctctgatgacctgtgtctgtctcttctgaggccaaaggggcttaatctggttccaggatgtcacactggtagctactcacctggtatttaatcaatcaagaagaggtttattcatcccacacacagggtctcctccctagagaaggatctagtggttgatgggctggattctagagccaaactgccaggttcaagtctcaactctgccacttattagttccaggactttgtacaaattattaaccaaactgagtctcaatttccttgtttgtaaaatggaggtgatgataataataatacccatctcatagagttgtcttaaataaattagctggcagagatcaagcccttgataaatgacagcctgtgagccaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacctaaatgccacattccgtgctaggccaggttttcccacctggtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctttaatcccagtgctttgagaggctgaggtgggaggatcacttgaggtcaagagttcaaggtcaacctggacaacacagcaagatcccatctctccaaaaataaaaaaaatagggtgggaacgaatcttacatttctttgcatgtatatccctaagtgactactactgtgctttgtactcagcagggatcagtgaataaatgatttaatgtttcaggaggacataaatggctcaaaacctattaccattctttccaaacaaatgatttccttcaaatcaatatagtagagaggcctaaaggctcaatctccagacctggactaagtaggtttatagttccacctgccatttattagctgtgtgaccttaagaaagttatttgacctctctgtgcttccatttcctcacttataaactatggattattaaagtatctatatttcttagagtatttatgaggatgaaatgagataatacatgtaaagaaatttggggcctgacacacagtaattatttgaaatattcatcattgttataactacccagatgagctaaattcagctcatccagaatgcccaaaaaaccattttgtaaagtatgctgggcctacagagaaaaatatcagatattagcatataaaaaattttttttgcagccaggcacagtggctcacacctgtaatcccagcactttgggaggccgaggcaggcggattgcctgagctcaggagttcacgaccagcctgggcaacacgatgaaaccccatctctactaaaatacaaaaaattagctgggcgtggcagcgtgtgcctgtactcccatctactcgggaggttgaggcaggagaattgcttgaacccaggagatggaggttacaatgagccaagattgtgccactgcactgtagccggggcgagtgagactctgtctcaaaaaaaaaaaaaaaaaaaaaaacaaaatttccctcttcttcattcatttgatctattatgttgtgcaaaagggaaacaaccaacaaacttctacaccaaaaaggcatccatacctctgtgctatttatcagttgcctcatgctattataaaatctgtaattcatccagcggtggtggctcacacctgtaatcccagcgttttcagaggctgaagggggtggatcacttgaggtcaggagttcgagaccagcctggccaacatgacaaaaccccatctctaccaaaaatacaaaaattagctggatatggtggtgcatgcctgtaatcccagctactcaggaggctgaggcaggagaatcgcttgaaccaggaggcagaggttgcagtgagccgagatggcaccactgcactccagcctgggtgacacacagagcgagactctgtatcaaaaaaaaaaaaaaaatctgtaactctactgtcccttccacctcagcaaagccttgagtgtgtattcaactcaaatatatatatacttgtgtgtatattttcccaaaggcttcaaataggaaaggaagatctgaagcaaaactgattcactatcaaattcatcaaggctggacagggccattgaactcactcctttcccataaagtgccttcttcagttgtgtttttcagtctgacccaggcatcaatgaaggcagaaagcccagcctcaaacccacaaggtgagactagacatcttgtcatcaaaacagcatgttttccatcaagccgcttctctccctctttctctctctctttttttttgggaggtgggggtgggggggtgcatttctactacttttcgatgagattttaagtcaattccattttaatacacaggctaaaaggcaaatagcacttcaataatgagacaaaatgaaactgctgatagacaaaaatagagaatgggcagttgaaattcataaactggcattcaaaaaacaacaacaacaaaaaaggcctagcaactttctttcaagatatttatagccaggggaagtggctcacgcctgtaatcccagcactttgggaggctgaggccaggagatcgagaccagcctggctaacatggtgaaaccttgtctctactaaaaatacaaaaaattagccaggcatggtggcacacgcctgtagtcccagctactcggaaggctgaggcaggagaatcgcttgaacccaggagacagaggttgcagtgagccgagatcacaccagtgcactccagcctgggcaacagagggagactccatctcaaaaaaaaaaaaaaaaaaagatacttgcaatgagaggaacattctactttccaatccataaaccagtttctgccagctgactctcgcttagtctacgtctgcacacaaccccagatctgagtctattggagtcttaagggagatctggtttcttcagtataacacagaggtgaagagcatagatgtaaaatctgaatgtaaaatctggctcttccactttccagctacatgacactacgcaagttacctaatctctccatatctcatttcatcatttataaaatgccaaattaattctacctccaagttgtgattaagtgagctcattaaataagaatatccttattcatttttatattctttaattgtttagcccagtgcctggatatagtgcccactcaatagatgatcattactatcactctcatctgtatgtgcaattcaacagccaaaaccaagcagctaatcacttttcgagtcaatgcttttcttgctgagacctgccagtttccagaactggtccaacaaattagttttatgtagctcattacagaatagacacaatggaaattataataaaatagagcaaattaagcttccaaatttactaagtaacccctcacagtaaacacactaagatggtggtgtgggagatccgatactcttagttaagcaacaatgttccaagtcatttgcatcttttcatctccaatctcatttggcctccaggaagctcagtgtatttctctactttttaaaaagttagtaatcccagcactttgggagaccaaggtaggcggatcacctgaggtcaggagttcaagaccagcatggccaaaatggtgaaaccctgtctctattaaaaatacaaatattatccacgtgtagtggcaggcatctgcagtcccagctacttgggaggctgaggcacgagaattgcttgaacccaagaggaggaggttgcagtgagccgagatcaggccattgcactccagcctgggtgacagagcaagactctgtctccacaaaaaaaaaaaaaaaaaaaaaaaaaaaaggttacatattgaaatatgtgaaataggcaaaactaaatacctcccaagcagcctatgtcaagagtgtcacctcaatctagaagatctatttatttgctaataaaggacaaaaatgctttcttgaaatccttattcagggacaaaaatgtaaatacaggtcaggcacagtggcacatacctgtaataccagcatgctaggaggccaagaagagaggatcacttgaggtcaggagtttgaaaccagcctgagcaacataggaaaccctatctctacaaaaaataaaacattagctgggcatggtggcacacgcctgtagtcccaactagttaggaggctgaggtgggaggatcgcttaagcccaggaggtagagcctacagtaagccatgattatgcctctgcactccagcctgggtaacagagtgaaacttcatctcaactaaagagactgggacaaaatatatccaaaaatatataacaaatatgcaatttatattatgcaacttacctgcagtggctaaacaggagctcatcagggcaaagatggcaatcacataatgggaagtcatttttatttctccaacagtgcgtctcgtccagtcacttcagcctgctcagagcacagacaatctttgcaaatcagaagtagtcttaaagtccctccttgcaattttcaaactgcctgtaaaacaaatttcaataagaaaacttaatgaagaaacttcataaacaaacagacactaaaattaaacagagaatttctgaaaagcgtaatgtaagaaatttatcttaaaagatgcaaaatagcactcaagcaaactagactgagggcagtgactatctaataaagatttttatagcaaatacttttgcaaatgacatatttgttattggctttttttttttttttttgagatagagtctctctctgtcgccaagctggagcacagtggcgcagtcttggctcactgcaacctccgcctcctgggttcaagcgattctcctgcctcagcctcccaagtagctgggattacagacatgcgccactacgcctggctaatttttgtatttttagtagagatggggtttcaccatgttggccaggctggtcttgaactcctgacctcgtgatctgcccacctcagcctcccaaagtgctgggattacaggcgtgagccaccacgcccggccctgtttttgacattttaaatctttggttttatagagaattttcagaactacagaagaaaatcaaggtgcacctgaaatataacaccaccagttaagttgtggtaccaaagtaatcaatgacacttgatacatgcaaccctagtgccagcaagaaaacaaaaccagcactgattagagactcaatctaatgttataataacagggttatcacaaggatcaaattaagttgtgctaggaatcaatctgaaaaaaataaagaaacataaaaaggcaaggttcttatttcaactgtttgccaacattttaacaggaaaaaagtcttccctgtctctcagcccatctgagactatctggttactggactcaaggatctagaaggttctttctaagcttttcctatccagagtcttcaatgagagttttgtggtggtttgcctaacttgaatattcctcacacggccctaatggtcactgatttagacactccaaagtatatttctccagccctctatccctgagcctggcacaactcacagaagttcaattaacaaacatgtactgagcatttactatgctccaggcatggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatggctctttgcaattgtaactttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaatccactctgccccttaccaaatggtaatgttaggcagcttactcttcttgaatgaacatatcctgtggtaggaaatgtatggtaggctgttgtgaggattcagttagttaatatacatacacaatgcttagaacagtccctagcacgtaacaaccaaccaaataaatgttagctacaattactgtactgtatcactacttgtccattctctttgagctatttataccaataaagtggagaaattaagatatagctatttatgtaattcttagctactgtaaatccagttcaatcttttgtttactgaaaaataaacattacaacagtcaaaaggagataagctaaagagtggactcactaaaagaacaaaattaccagtcaagttgaggcataagtcatcaatgacacaacggtcttgtctcaaaagctgactaaattatagagataatttgggagccattaaactgacttattatccctctaagtcgaacatttctgtcaccataattccacatcaactctgatcatatggaaatcttctccgttaacttaaaaattcaaccaccacaaagaggatctgtctctatttttttcccttcgaaatattagattccctaaattagtgaattggttcacaagaactatagtgcctcctgcctatataataattttgataaggaaaaacctctctgaaacaatatgctatttcagcaaatgttaaagacaacttttataaagcaaatccctgtaaggagatctcagaagaagatgacttcccagaggattttatgaagcacataaactgtaagcggcacgaggcttgtgggaatatttaatgagcttgcgtcaccctgcccacagctgcagtgggtctgagggtctgtgctgcgttaatccaggggcttaagccaggtctgaacaaacctgtggaaaagaaaggcaaatggttccattaaaaatataggctgcaaattgctgacaagaatattgggcaattattaaaatgcagcaattacagatataatagagccaagctaaacagtttgatgcccaaaggcaaaccacagcaagtttacaccggatcttaaaacatctctgaggaagtcctggacaagttgaaactacacactgctgtttgtaacaaaaagggagcttttcttcttttagcttaaaagtctctccataatgtaactgttcaaaaagaaaataaactgcagaaggtttttgtctaatctccccagtgtggtgaaagattcccaaggcagaggagaagcaaaagggaagtgtgtcattctcattcagctgaactccagttttggccacaacttgtacacctcagtgccttaacacccgacttaggaatcagttccctggaatgctggatggactgaaggcttccgaaaagttgtagctttgataaaactaacgaaatacaaactcctctttcttctgtgaggttctaccacactgactgcaaacatcagggactcccaatcctgactttttgacctcaaagaatctctggactttatgaactaaatgctttctttagaaatatgggttctggctgggcacagtggctcatgcctgtaatcccagcactttgggaggccgagctgggcagaacacctgaggtcaggagttcaagaccagcctggccaacctggcgaaactccagctcaaccaaaaatacaaaagttagccaggcgtggtggtacgtgcctgtaatcccagctactcgggaggctgaggcaggagaatcacttgaacccaggagagggaaattgcaatgagccgagattatgccactgcactccagcctggacaacagagtgagactccatctcaaaaaaaaaaaaaaaaagaaaaaaagaaagaaagaaatataggttctgtctatggagtagccattcctttattcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactttgatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccactgcactccagcctgggtgacagagcgagactacgtctcccaaaaaaaaaaaaaaaaagaaaattcttagaacttaatgggtttaaaaaaaaagcaaacaaatgtgctgctaattctgctaatttcagagatcccctgggtttatttctgagtccattaaactgagcatactgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaaccagtaagaaaaaattagtagcttccccttagatggctaacatggcctggctacatccatgagttgattcagaatcagaactaaactaatccccatcttcagatagatttggcacaatgagagaaaaagtcctagatttggataagaaatcttcggaatcacatccaagcacaactgatattcaataaatattactgctatatgccaggcactgttcaagatgccagggatatagcaatgaaaaaaagacgccaaaaatcctgccctcagggagcttatatccgagtaaaaatatcatttactacttctcacaagacatttaatttcctgagtttctcctttcaacaaatctttattgcttactctgctaagcagtggccaaggagacatgttttttgcccttgtgggcttaaaagctggtgagataaacagacaataatcacaaacatgtaactacacgatataatcagagctctaaaggaaaagtatacgcaacctgaggataagcgaagattttaaaagtcaggtgatgaatgacactgcaggcagaggaagcattacaggagggaggagagctgcagagctgaaagggaaagagaagaggaataagttcaaggaggggtttaaacagggaatagcgtgatcagatgggattactaaagatttccctcacgctgtacagagaacagactgaagggaggccagactgcctggacaatcagttgagattctcacagcatgtcagacaagaaaggatggaggtttagatcagaatggagcctcagtttcctcctttgtaaagagtgtaacagacaaaacttagctacatcacagagttgttgcaagaatcaaatgagattgtgcatgtatagtattaaaactatcatttatcattagcaagctgtttctaccaaagagatttattatcctgaggtatcagattaattagtcccaacattctgtggctgccagtggcaggaaaagaaaggaggaagattactctggaaccacctgtactggtaggcacgggggaagcagtacgcacagatggtacgaggagagcagagaagcctgactccactctgcctgttctgtgccggctgccttcagaggcaaggtgggctgtccctccagagcaggcccaccctcattcctggctgggagcatgatcaacaaatctggccccagcagccttggtttccttggggccgaacttcagtccgtccttaagagcccttccatctatcccaagcacaacacacctcactcccaaggaaaatacaggaaaaagggagggtgggtgttgacacatttcacaaagttggaaaagaccatgttttattcaaactcacaaactaggatggctttttcacccacccttgcaatactctaagaaccaccttttcacatttaagatttttgcatccaaaggtttctgtaccttttcatttataagggtgtctgcttttaagctagaattaataaagaactgtatttgggggttcaaaacctggcttacccagctgtgttacattggaaaagtcatttagcccctaccacgccctcatctgtaaaatggtagcaatattttgattataatataagacagaatataggcatggtacctaaaacaatacctggcccacacagtctattttattttattctttcttttttgagatggagtctcactctgccacccaggctggagtgcagtggcacgatgtcagctcactgcaacctctgcctttgggttcaagcaattctcttgtctcagcctcccaaatagccaggattacaggcatgtgccaccacgcctggctaatttttgtatttttagtagagacagggtttcgccatgttggcccagctggtctcgagctcctgacctcaggtgatcaacccacctcagcctcacaatgtgctgggattacaggtgtgaaccactgtgctcggccccacactgtctattttaaataaataatagtcattggtatttttatggttaaaatatacctagacttccaaaaagaaaataagcaaactactagtagcaaggcaacagaaatagttgtttatagcaaattttgtattatttttgagattagactttatcatctagaatttcaaaaattccctccatcacaaaaaaatgattccaaattccatacaaggtatgggttctaaagatactcataatgtagcaaaactgtccaaatggtggtgaagccattgcctcaacatttctggtataagttacagggatctggctgcagggcccttctcgattctatttgatgattcccaattagctgcaggggttcagctgggggctgtggaacttggtctggcactgccaccaaaccaaccaagctacctagaatgaggaatcagctgtcatcaaaaaggtttaaatcataaagctgtaattattcgagcaaaattcagcatatcagaatattctcaggacaacagtcatcctccctcaggccctagcaagcacctggccattgaaaaaagcttttgatagcctggacaacatagtgaaacgctgtctctacaaaaaatttaaaagtgcaccaggtgtggtggtttagagcccaggcatgtgaaacactaagaattaaaactcttcaatggttgcccactgccgtccagataaacagcaaaacttcacatggccaccaaccatcgtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcccactgtcttaattccagcaaggcggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatcacatctctacaagaaatacagaattagccaggtgtagtggcacatgcctgtaatctcagctactcgggaggctgaggcaggagaaccgcttgaactcggcaggcagaggttacagtgagctgagatcacgccactgcattccagcctaggcaacagagcgagactccgtctcaaacaaaagaaaaaagaaaaaatagtacagcaggatgataaattagaacatttctcaataacaagagttatgtataagaacctcaggcatcctcaaaggaaaaggaggcaggagtgcgaccatcagcatgttttaccagctcagaccttctgcatcctacttccctcatttctaatatgaagaaattaaacaagaaaatcttttattctatatcatactataattgtcattacatggactaataatcctgaatcccttctagaaaatgagacttcaaacacacttgtggaaatctgaaatgcataattatgtaaaggctagcaggaataacttcacaaaacagaaaagtgttatccaagaaaaatattcaacttggcaacataagaataaacagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaatttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctataccttattccccttcctgtcagaagctgacatctctgctttcttctgaacccacaaaatgtctgttatcatctactgaacacctatcatgtatatcacaatttcccatttaatcttctcaacaatacaaggagacagatgccctttactccattttgtagtgagaaaggtgaggcttcaagatgctaagtaaggctgggtacagtggttcacacctataatcccagcactttgggaggcagaggccaaaggctcccttgaagccaggagttcatgaccagcctgggaaacatagaaaaaataaaaataatttgaatatcaggagtttctgaaaataaataaataaataaatacaaacacaaatattagccaggcatggtggcgcatgccaatagtcctagctacttggaaggctgaggcagggggatcacttgagcccagaagttcaaggctgcaagtgagctacaatggcaccactgcactccagcctgggcaacagagtgggactctgctctgtcaccaaaaaaaaaaaaaagatgctaagcaaccccaagtcaccagcttataaatcctggcaccaggacttaaacctaggtctgtctaattccacgcccatgctcttaactactacaaacaagagatcctccagaaacagctgactttcaaaaaaaagatagggactgtgcctattactaagccactgtagacatcaaccaggccctgcatggacactcactttctggtggtgggtagtctgatgagatctggcacaagggacaaattattttgttctgaaaccagggtggcaggccttgatcagcagttttagtttacttcattcattcactcaacaaacatttattagcgcctaccctgtcctgggcactgttcagggaggtgggcacatagcagcaaattaaacacactcctgttttcacataggttaccttctaaaggtggggacagacaagacaacaaataaataatatgtcaaggcatgagaagacctaggaaaggaaaataaagcaggttaaggagagagagtgatgacaggagggatgctattttagacagggtggtcagagagggcctcccagacaaggtaacatttaagcacagaggtaagagataaagctatgacaatatctaaaggaaaaacctcccaggcagtgggaatagtgagtgcaaaggtcctgaggtaagagcatgcttggtttgtcctagaagcagactacagtacagcatagtggaaagtgcggggcccccatagcctacctgagttcaaatcccccacctgccttttctaagcaatataattttgggcaacttacttaaagctccatgcctgatctataaagtagagataatgattctacctccttcatgggattgttatgatgactaactaaattaataaataaagcacttacttcctagtatgttgttagaattcaggaaatggtagctttgattatttttaactactcactgataactcagctccattctagacaatttattttcaatgtgatacctttgaatcccagggtgaatgacactgcaggctttgtacatggccaatagcttcctcctaagcctttgcctttcttggctgggcttcctatccctgtaggaaccatgccgatgttatctcaataagagcaggaggcaaattcctctaactttactattacactaatacaaattatgtacttcattccacataatccctacccataagagtctgacacttcttcagagctgaatttattgccctgaggatttacggtattggtttcacaagatggggtcctgccaatcctgacttcccactagcatcatcagcagaagcaagcagaaatttcagggacaaccccttatcttgagaagggttaaaacttcacttcgaaagatggtaatttaattttaaagaatccgttctccaatgtcctttttgcctaaaattaagatttctcttcaaagaaattacaacatcaaagcaaaactcaagagtcatctggcctaaaagtctcaagactgagcacagcccccaagcaaggcagctctggaagggactgtgtaaccagacaaggggatgggcacagaaacaaggcaagatgtcagggctgcaaggaaattctgccctgtttccccctgccctcttccctagctcttttctttaacgttgtgtttgcttttcatctttgtagcctgctgggttaaagggcaaaccacaggcagagagaaaccgcagcaagcccatgcctgttagaggtaaaatgggagtcttcccaaaccacttgtaaggatggggggacccacaggtgctgctttgagtcagacatgaaaacgaggtcagtgttctagtccaacgagtcttaaatgaggctttttaaaaatcagattctccttccccgagattgatggttttccctttttttgacggggtggtgggagggggggatagggtttcactctgtcactcaggctggtgtgcagtggcatgatcatagctcactgcagcctcgaactccttggctcaagctattctcccacctcaactacagtccctttaagcagggactacaggtgtgccccaccacacccagctgactttttaagatttttttatggagatggggtctcactatgttatccaggctaatcttgaattctttgcctcatataatcctcctgcctcagcctcctaaagcactgggattataggggtaagccatcacacctggccaattttcccttcttttttttttttttttttttgagatggagtctcactgtttcccaggctgtagtgcagtggcactatctcagatcactgcaacctctccctcccaggtttaagcaattctcctgcctctgcctcccaagtagctgggattacaggtgcctgccaccacgcccagctaatttttgtatttttttttagtaaagatggggctttaccatgttggccaggctgctctcaaactcctgtcctcaagtgacaggagtcctcgagactcctgtcctcggcctccaaaagtgttgggattataggcctgagccaacacgcctggcccaattttccctttttaatgccctgagtgcacctataactggggctataagaaatccataaaatgggctgagcgctgtggctaacgcctgtaatcccagcactttgggaggccaaggcgggtggatcacttgagatcagaaattcaagaccaggctggccaacatggtgaaactccgtctctaccaaaaatacaaaaaaaattggctgggcctgatggcatgtgcctgtaatcccagctacttgggaggatgaggcaggagaatggcttgaacccgggaggcagaggttgcagtgagccaagattgtgccactgcactctagcctgggtgacagagtgagaccctgccacaaaaaaaaaaaaaagaaatccataaaatgcttcttattcatttaataatgtttatcaagtgcctgcttcatgccaggactgttccaggtgtgggtattcaacagagaacaaaacataaaaatccctgccctgatggagctttcattctagctaaaggagacagactataaacaagatacataattatatattatatagagaccaatgctaagaaaacaaagcagaaaagggagagacaaagtatgtgtgtggggttttggtttggtttgtctgttttgagtaaggacctaacagaagcgaattctgtagctatttggggaaaaacattccaagcaaaggaaacagcacatgcaaaggccctgagacagagcgtatctggcgtgctcagggaccaacagtcaggtgcggcagctggagcagattgagcagcctagagagcacaagagggaagtcaactgggtcaccagcataagagtggtgggctggttgggcagggctttgcagatcactgtaagaattctggcttttattctgagaaagacaagaataaacagtagagtggttttttggttttttggtcactctgtcaccagactggagtgcagtggtgcaatctcagctcactgcaacctccgtctcctgggttcaagcgattctcctgccttagcctcccgagtagctgggattacaggcgcccaccaccatgccaggctaattttttttttagtagagacggggtttcaccatgctggccaggctggtctcaaactcctgactttgtgatccgcctgcctcagcctcccaaagtgctgggattacaggcgtgagccactgcgcccagcctagagtgttttaagcaagggaatgaaggaatctgacttaggttttatcacaatcattctggctattgggtgggaactaggctgcagaggggcaagaagagaaacactgctctctggttgttctcatctttagagaaacttaaggaagattattctaagccccactgtaaccctaaactctatgattctgagttgattttctgtgtcttttctatagctataatttatatcaactgtaagcctgatctttccccaaagccataactgaagtgggctgaaatgaagaattccatttgacaatatatctataaaccaggcccatgctacacacctagaataccaagatggtaagactcaatcctgctctggggaatctgccgaaggaaaaacaacattctcacgaggcagcaagagaagcacctgccaggaggagccacatgaagccccactggaggagctggcagcagtgagagcctggaagagtaagcaggaacccccatagagaaggagggacatgggaaatacagaaggtgacactgtggaggctgtggaccacagagaagtaatatggtggcttttggactgtaacagaaaaatctacagaacaaccagatggcactgtccgataggctgttggaaatatgggtgtgaaaaaacagggagctgctgatattgaagcacagaaatatgagcaactcaatgtagactgaaaagacaagaaaaagaaaagaagaggggagaggagaggaggaaaggaaaatgcaaccttggaaaatgtcaacccatagggatcaagcattgaaaaggaagactgggctgggcactgtggctcacgtctatattcccagcattttgggaggctgaggcaggcagatcacctgaggtcaggagttcaagaccagcctggccaacatggcaaaaccttgtctctactaaaaatagaaaaattagctgggcatggtggcgcacacctgtaatcccagctactcgggcggggggggggggtgggagtgtgcagctgagggaggagaattgcttgaacccaggaggcggagactgcagtgagccaacgtcgtgccaatgcactccagcctgggcaacagagtgagactccgtctcaaaaaaaaaaaaaaaaaaagaaagaaaaagaaacaaaatggaagactgaagagacatccggaacataagaggaaaaccaggagaactcgtttcagggaaaccaagaaaaaaaatgggggaaaaaggatagtaaagcagcaaatgcaactttgcactccgtacttcacacctcttctagcacctcatgggggtgtggtgggggtgtggtgggcgtgggagccagcagcaggcagaagagtaaatgggaggtgagaagaaaagcaccaagagctaaaacacattagcctcagtgacaagactaagagttatcaaagattatgcagcatcaggaaagtcttattcaacactctgtggaggtgtaaggtgtgagaaacaggaactaagacctgccggggctgatcttctggcagtggaaaggagatttcttagttaacacctaggtctcacaggaccactaatcctgaaactagcagtaggcatcccgaaaggctagttgcttctgacaagtgctgaggacaatatattcacccacacatcatccaaatgctaggcttcgcacctccatacctttcccacactaacatccctagttttctcctccagcagaataatgctaggcagcagggactacatttcagttcaaagcatggtaaaaaaattcatataacaaaaaccatagcaccactaccaggtatgatgctgtgagcccataacctgggaccattcaggcaggaaaaggctttaccaaaaacacaagctgggtcccggaacactggacccaaaccctttcatgtcagcaaaaactgcctaaatgctcttctatttgctctctgagaaacaaaaagaagccgaaggaggaaaaggcctttaatcctaaaattattcttaatttccaatacagagcatttgagaaaaatctgaaagccaacagaaaaactagcagattctttaaaatgtgtgtctacagtcctttctcctttaccctctgcaaaaaaaaaagcaacccaactcccaaatgatcatttttcttggcttaatttcactattttttgtgatacataattggaaacagactgctttttcctggctttagagaacaggatcttcagggttataagagttgccaactacagaacctcaaccttagcaaaatttttttgcaaacctcttacctatctacctacttgaaatacatattaactccaaagaaaacacgtaaatcccctattattatgcaaaagtggattttctcccaacaaattagacactcctctccttttcctagcctacccattgaaatcctgctctgtgttcagctatgtcccattcaaacatgaccaaaagccctaaccagcatggtatctagatgggatactttttggaagcattttcttttttcttcatattttctttttttgtgtgtgtggtgggggtagggacaaggtctcactctgtcacccaggctggagtgcagtggtatgatcatgactcactgcagcctcgacctcctggctcaagccatcctcctgcctcagcctcctgagaagctgggactacaggcacacaccaccatgcctggctaatttttaactgacattttcaggaatttagtagaattggttctacaggaaagctccttatttagcccacacagtgaatgaaattaaaacctggaacgtcttagagaacaaccactctaacaatgaaataaagatgccacaaattgaaaaaagatataaatatggaaaaatgtgaaatgcaacaagtaggtcatccttcccctagctcctgtgtcaaaaacatgatacatccaatggctgtacagctattgtaacgaataatgagtatgacagcttaaaagctcaaagacaagtgtctttacaaaatgggctgttggcataagtatttttttcaggattcagatgatttatcacgaatacataacaagtagcaatctctctaaagtctcgaaaataagaaaatgaataggaatgtctattcagaaatgctttggctaaaagatagaccagcaataggaaacatgcccatttagatcagaaacttctcccacacacatagggaagaccttacgctgcaatgatgcaaaatgtatgtaatgagtcaatggtgctttccctcaaagttaaatttaatttgccagccaactgcacaaaatctaatataacaaaatgagatacttattctttatggagactcagaagagttttgttttaaagaaaaaaccataaaagagataactcacagcaacacagtgagtatcttacaaaagtactcagggtaccacatgaacacaagcctttgtgattagaatctaagtttttcacctcaaataaccttccagaatgaaaagaaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgatccacaggaaagctcaaggactagtatctgtaaagatcattttctaaagatcatttttcaaggactaatcaacttaaatgtgtttttacaaatgatccatcagcaattttacacaaaaaacctgaccttcggcatataccagagaaatgaattatgtgcctggaaggacagaaaagcaggtgtttcgtcctcctgcaaacaacacccaactccaaaggcccccttcactaggagtccaatgtccagaaagtatacgcttctttataaccattttttaagtaaagatagagctaacatttcagacttaattctaaattatcttggcaacagtttaacattaaagtgggcttgcgggcatggtggctcacgcctgtaatccctgcactttgggaggctgagggggaaagatcacttgaggccagaagttcgagaccagcctggacaacatggcaaaaccctgtctctactaaaaatacaaaaattagccagatgtggtggcccccgcctgtaatcccagttacttgggaggctgaggcacaataatcgcttgaacccaggaggcagaggttgcagtgagccaagatcacaccactgcactccagcctaagcaacagagcaagactctgtctcaaaaaaaaaaataaccattaaaatctaattctaaaaatcaactttgctaggctctacatataactgaatcctcttcccaggatggaagaagatttcaacataaaagaaccaccaccacaaaaaccagacattaggctccctgccctgccccccgacaccaaaaaattatcttcagcagggcacattaggatggcctgaaggcatggttctggggctcttgttctagaccttccattttaaatatggtctctatccctcataagcagttgtcagcctattaagtcttcatctttggcctgaaaaactgaagaataaaaaatgaagaataagttccaaatgacagtagcctcatgcagaatttatatcaatgttgtttcaaaaacacattttggttgagagagcaagacatcaaaatcattattcaagtggggaggaagaatgcttggaaatttgtgctgattcttaagcaaggactttgcaagcagagaaaataaagctcaatgtcagttaacaaacaaatgtgctatttcaaaagatataaaataagaaatctagaaattttatattcctagatttatttattatatttctatatttcctggacagagcccaggaaatgaacccagatccttcttgtaaggcccttccaagctgtgttgatttatttcagcttgactagacactgaacaaattagcaacagcttgtgttttatgacatgctgcaaagaaacaatgctatcattccaagtgttactctgaagatgcagaaccagagaagttactgctatggctcttggtacacttaattttcttcctacagaaatgccctcactcaatctgctgaaggctcactattatgtgtttaaggttagcttttcatataacctagattcactcttaaattccaaattgcttatattcctagtggcaatacaagactgcttttacattaaaggcccctaaaaacatttatctaactcaagttatgcaaatttcaaaaaagttaacattttttaaatttacaattgttttaaataagtttaaaaatatggccgggcgcgatggctcacacctgtaatcccagcacgttgggaggccaagacggcggatcacgaggtcaggagattgagaccatcctagctaacacggtgaaaccctgtctctactaaaaatacaaaaattagctgggcgtggtggcgggcgcctgtagtctcagctactcgggagactgaggcaagagaatggcgtgaaccagggaggcggagcttgcagtgagccgagatcgcgccactgcactccaccctgggtgacagagcgagactccgtcccaaaaaaaataaaaataaaaataaaaatataagaaaaatgctccagtagactgatggaaatggcaataaaatcacttttaagtaactgttaagactgaaaaagaagactgtcctttagtagctaataaatctgacagccaggagcagtggctcatgcctgtaatcccaacaatttgagaagatgaggcaggaggatcacttgagcccaggagttcgagaccagccgaggcaacatagtaagactctgtctcaaaatatatacatattatatattatacaatatatagttatagattatatatatgtgagattttacatatatttacatattttatatgaataagtatataaataaaaataaaaaataaatctgacaattacaatttttatccaacagcaatgaaagcaccacaaaaagatgtttcaaaatgaactatcaagaagggaggtaattcaaaatgaccacagagcagaatcatccaggcaaaatattacagcaaagttattacttacacagtcacagtctaaactctaactgttctgtctgttaagcttaaaatgtaaagtcaggacctttcacagatttttgaagccaggaaattggtcttcacttatatactaaagaagtcagcagtgatcaccttcttaaaactcaaaggacagttgagttccctgggctcttaggctcagattctgccctcagaaaaacaagcactcacctgacttttacaagtcacaaccaagtttgcatgcaagagagaaaaattaattcttttgagtcttaaaaacaatggaacaacactttccttcaagccaacgaaaggctttctgtaagaaagccctaagcaacctgaaggcattttggcccccagtcatcagagcactgaataaggacaattaatttgccaagctccaagaccagaaaccatagcctagtagggagtaggaggttataagtgtttgttgaattactcgagtaaactagagcaaagcatagaagactaaatgagatcctaaataaatgccactctgtagtataagcgcaatgctaagatttaaaaagaagggactcaactaattttgaaagttattttaaaataggatccatgggaccctaacgtagtaaatgaaataaaggtaaatcaatactacataatatggggccgggcacagtcgctcacgcctataatcccagcactttgggaggccgaggcgggtggatcatgaggtcaggagatcaagaccatcggggctaacacagtgaagccccgtctctacgaaaaatataaaaaattagtcgggcgtggtggcatgcacctgtggtccccgctactcgggaggctgaggcaggagaatctcttgaacctgggaggcggaggttgcagtgagccaagatcactccactgcactccagcctggacgacagagcgaaactttgtctcaaaaataaataaataaataaataataaaaaaatactacataatacgcaagaaacaagaaaggaaactggcctacaaaactacagacaaaaattgaaaaccttttttttttttttttttgagacagaacctcgctgtctgccaggctggcgtgcagtggcacgatctcagctcactgaaacctccacctcctgggctcaagggatcctcccacctcagcctctggagtagctgtgattacaggtgtgcaccaccacgctcagcaaattgttgtattttctgtagagatcaggtttcgccatgttggccaggctggtctcgaactcctgacctcaagtgatccacctgcctcggcctcccaacatgctgggattacaggcgtgagccaccacacccagccaaaaactttttttaaaagtcaagtttggccaggcaccgtggctcacgcctgtaatcccagcactttgggaggctgaggtaggcggatcacaaggtcaggagatcgagaccttcctggctaacacggtgaaaccccgtctctactaaaaatacaaaaaaattagccgggcatggtggcgagtgcctgtagttacagctgctggggaggctgaggcaggagaatggcgtgaacctgggaggtggagcttgcagtgagctgagattgcaccactgcactcccgcccgggcgacagagcgagagactccatctcaaaaaataaataaataaatagataaatgtcaagtgtgattttttcaagcatattcttattgtttatgtttacaagtatgagtattcatagacacatcacacttatactagtatcaaatatgatacatctgaactactactatacttgaatattaacgtaagcctctgaggaattcacagtaatagaactgctgttatttaggattactgatcccctattgtcttgcacttagaagatgttaatgaaagatgatgacaggattgtgaacacaccaacctccctgagaacaaattcattatattcagttttctacaaaacacaaatgaggatcattacaaaaggattcacaacaaattcctctggatttccatttctcccaggtaagttgaaatattattcaaaccacacaaaattagtttacatacaaacttcactttttaaagagatgggggtctcactatgttacccaggctggtctcgaactccttggccaagtgatcctcctacctcagcctcccaaagtgttggaattacaggtgtgagccactgtgcctggcctacacaccacttaaggaaacaaattgaaaaaaaactatatgtgtgtttatctatctgtccagccaccatggagttcttgacatatattcaacatacaggccctgtcctcaaggtcattcttaatcagttcaaattaaatctagtcctccattataaactccaaaagcaacttagttattttgctagatattttgccctcccctttcaaactatatgtttaatactctaaaaacgggtttatgcgccttatagatatcaacagtgtgttatgctccccctattgactaatattcaaaataacaatgaactccccacgggttgcctttgaagtgctgggattcaaaactatgttggtgatttttatatttaaaaacatgagctgaatcaacagttgttaggcaaagctgccgtgtaacggtcagattccatcaaaacaggaaaaattaaagttgacaaatgtcaaactgaagggccaaaaaaaaaaaacgctcaagccttgaaacactaaacaatgcagaaataaagccaaaagcaaagaacagcaagaaatagagcaacatcctttaactgacacaatggcatgaaatcaatttcatgttaatagcccttaagggggtaagaattatttccctgcctcctgtgccaaccccaagctgtttcctaaggaagccaagtaatggtgatcaacaatgtctggagaattaataaaagaaattaagaataaagatccatgttggccaggcgtggtggctcacacctgtaatcccagcactttgggaggccgaggcaggtggatcacgaggtcaagaaatcgagaccatcctggccaacatggtgaaacgccgtctctactaaaaatacaaaagttagctgggcgtggtagcgcgcgcctgtagtcccagctactctggaggctgagtcaggagaaactcttgaacccgggaggtggaggttgcagtgagccgagatcgcaccactgcactgcagcctggggacagagcgagactctgtcaccaaaaaaaaaaaaaaatttccatgttaattaatacaagtcagagttctatttataattatttggggccagtttcagaggaactttaattgggcaccctcataagtatgtaaaatcgcctaaattcatcacagataccttatgtgtgtttcaagagatatgcgttcagctcaaatagaaagctgaaagatgggagaagatgcatggactatgcacacaaatctatgtacacacaaatcggcctgcacttgccgctctccgctgaggaaggaaggtagctttggagtcagaactaacagaaagttatgtatgatcttggacaagtaacttaacctctagtgtcttatctgtaaaatagggttattaatagtgcttttcccatagagatgctgtgaggattaagtgcacacagtatgggcttagaaaacgttagctgttattattatccaaaagaaacaactgagttcacactgaagtaactgtttgcactctgcattcaggaagaagaaacggtcttgacgtgtgtttttactacctgtggagacttctcccaaaccgctcacttcttcggaaggacataaaactcagaatacgcctggttccccagcacagcctgtcactcctactatcctctgccctcgccgctcctatcctgccaccgcagggctagcggcaagcagcgctaacctccgtgcggtgcttactcggtgccaagcactgttgtagcacctcacacacattaaatcattagatgctcacagcaactttacggggcaagtactactatcctcacttcacagctagggaaatggaacggttttcttcttccagcttttcgtgaggacaccaaatccactaagttctactttgccaaggtaattcatgcttgacacgtcggctcctgacactatgcgattctgcaaagcggggcaaatgccctaataagatcaagtctgcaagcagattcttctagcgacagtccaagatttccaagtttgtcctaaccaaatgaatacaagaagagagccttcaaaataaaccggggcgggggggggccgagctgcagcttgcggctcagcccgcaaggcaccctgagggcgcggccagcggggaacgcaaaccgcgtccgtgcacgagtccgggagccacagcctgggccacggcaattgactgcgaacccacaacaaaccattcccaccgaagctgtcacgcgcccggagggaagtggccgccgcgccccgcaggggtcagaaggacccgcggagaggaagagtgagggcgggcgtggagaattcctccccagcactgcgcatcgccgggggcactgcctgccccgtgcggccgctgcccacgcaccgctggccaccggtgcctgctccccggagggtaaacaccgccccaccagcgcctccctcccaaggccggaggtcctggcggctggagcgaccctggccggtaagtaggcactggcagcccgcgccgcgccgacgggcacccgcgcagcctgcagagcccacagcccgggcgggctgcagcgccgcggggctgggccggcacgtacctcggaggcggtgtgtccagcggagatccacccgcagcaagttggaggaaagcggcggcaagtttccccgcccagcgctcggcggcggcgagctccggcagctgctgcgccgcggcaaaactacgccatccggacccgctggggactctcacctcctgcagggagctccgggaatcgcgcagggaaagtggccggggcgcgagagccgccgactgccctccttcactcgctgggaagaggaaagtgccgctcggcgtccccgaaaccctcgattacccccatcaggccgacccggcgcactcgccctccctcgcacacacgcgggcggggacgggcaggacgccacagcaatcagcgcgcggggggaagggcgctcctccgccggccccaccgggggctctcggccgcccagaaactcctcctcccgcctcccgcctcccgcctcctctctcctccccctttgcctccgcggctgatggatgagccccgaatgctgctcgagcctgtgcttcccttcgggacgaggaggccgagagagaaggggctaggggcgcggccgggctcagcgtgcccgggttggggcggcccctgtcctgggggaagcgcgagggagacgtgggcacgagctgcggggactcgctccctcaaacgaggtcctttgaactttccagggctccctggaagagttggattttcatttggttccttggtctttatataaaagttctgaaacctcagataatctgatcacagcctcttgccctctccccagcagagctcccccatgcacacattcattctgtccctgtgctttttcccaacctccggtcccgcttgttgtcacgctctgatggtgggcgccggcggagtcttgcctcttcccctccagcagctgagactgcattacccagccgttccccctgctagctaaataaattaatacaaataatggagctaggtcagcattaccggcgttacccggaggtgggcgcgatatgaacgacagtctcggcggggcaacgtcctaagtacctgtgcctgtgcgacgtcctaagtacctgtgcctgtgaagtacacgctgcagaagttgaactgctggcaccagaacaccactctgatactcttgcttacacccagtttttcttattaaaaagtatacttaagtaacaggacattgttttacaaacaggcaggtgaaatgaccgtggactgacaggtttcaaagaccagacttccagtcctgactactgtgcgaccttccacaaatggctaacggctaatacccgtcaaggctcagttcaaatgaagggcttggcctagaaggcttcttccagttctaaagggctatggacctatgcctttttttttttttttttttttttttttgagatggagtctcgccctgtcgcccaggctggagtgcagtggcacaatctcaatctcagctcgctacaacctccgcttctcaggctcaagcgattctcccacctcagcctcctgagtagctgggattactgacaaatgccaccacgcccagctaactttttgtattttttgtagagggggttggcagggcgggggtctcacttagttgcccaggctggtctcaaactcctgagctcaagagattcgcctgccttggcctcccaaagtgctgggattagaggcgttagccgctgcacctggctcaatcctaggcttttaatatgttggagagtagaatgaggaggcttcttatgacatgttatttggaaagttattgagagaacaggaaatatttctcgtcctcttcctcttgtacctataggcagagaatccacccaattgcagaattggagattcattcacaaaggtcaaatgtcatcagtcacctgaattactgcaaaaatctcctcactgaaccatttttttccttaccaatattcattgagcactgactatgggagagccctgagtcaggcattgggaatacaagtaggcataatattctgaaggaataaacagtccagatggagctagcctctgcttttataaagtctaagtttaaggccttaagatttctcctagactcaaattaaacagtatttgatatggtttggctgtgtccccacccaaatctcatctcgaattgtaagtcccacaatccccatgtgtcctaggaggaacccaatgggaggtaattgaatcttggggatgagtttttcctgtgctgttctcatgatagtgaataagtctcacgagatctgatggctttaaaaacaggagtctccgtgtaccagctctctctgcctgctgccatccacgtgatatgtgacttgctcctccttaccttctgccatgattgtgaggtctccccagccatgtggaactgtaagtccaataaacctttcctttgtaaattgcccagtctcgggtatgtctttatcagcagcatgaaaacagactaatacagtatttatgccttgttaacaagttttagtttcaagtacagatgtgaacacttgaactaggtgtgaatatttaatcccacatttaaatgcatcggccaggtgaggtggctcatgcctataatctcagcaatttgggaagccgaggtgggtggatcacttgaggtcaggagttctagaccagcctgaccaacatggtgaaaccccatctcaactaaaatacaaaaattagccaggcatggtggcgggcacctgtaatcccagctacttgggaggctgaggcaagagaatcgtttgaacccaggaggcagaggttgcagtgagctgagatggtgccattgcactctagcctggacaagagcaacactctgtctcaaaaaaataaaattaaattaaatgtatcaatcatgttaaggccttctaaataaaatggcctggtagataatttaggagtgtcttgtctttaaagagtgatgaagtgactggtccccgtagagccagattcacaacagtaaccatcaacatctgagccagcgtgggtactgaattcttttttgtttgtttgtttttgttttgagacagagtctcgctctgctgccgaggctggagtgcagtggcgcaatctcagctcactgcaacctctgcctcctgggctcaagcaattctcctgcctcagcctcctgagtagctgggattgacaagcacgcaccaccatgcctggctaatttttgtatttttagtagagacggggtttcataccatgttggccaggctgctctcgaactcctgacctcaagtgatccacccgccttggcctcccaaactgctgagattacaggcatgagccactgcgcctggccatgggtactaaattctatacatataaacacatttacttctcacagccctctaagaatatgtataaatgaggccgatatacatgcctttatacaaactgagatcttgtccacgattcaatctcacatccaccgacctcaaaacctgtccacgattcaatctcacatccaccgacctcaaaacctaagtccttaaccaccaggttcttctacctgtcatcagaagctttatagactggcaaaataaaagggctcttttttttaattctgagctatttagtttcagtagatgatatggaaaaacacaagaaattacatcagtatttacaaaattaacaatgtctacagagatgttttctctttaaatctttacaatatgatattaaaagcagaaatccagatacctcaagcatagacgaaaggtttaaaataaacttgaatttttggttcctgagcaaagctctataaaaaagggttcccctacctcttttctttctttctttcttttttgagacggagtttccctcttgttgcccagactagagtgcagcagcgcgatctcagctcactgcaacccccacccccacctcccaggttcaagtgattctcatgcctcagcctctcaagtagctgggattaccagcacccaccaccatgcctggttgatatttgtattttcagtagagacagggttttgccataactcctgacctcaagtgatccacccaccttggcctcccacagtgttgggattacaggcgtgagctgccgtgcccagttgcccaacctcttattaatggcaatattaactgatttctaagggaatggatgctccctttcactaatttctcatggagaactgcattcaagctacagtatttgttactgtaagataccagctttcttttggtccaaagtggtttcttggtcatttgtttggaattgtttcaaacaggattgtaagcaggggggtgaaattgaggtgcattacttgcattaaaaatgtttgccagcagagtttcagtgatttactgaggctgtttttcatacaaggaaccacccctcctgtaggtgtggactcacatgttgacagtgactcagatttagtggcatgtctccagattctgttgattagcagttcacagtctgctaatcagactttctttaatcagataaagtctaaaagactttatcattagaaaaatcatttggttgtttctctataatctttttttttttttttttttttttttttgagacacagtttccgtcttgttgcccaggccggagtgcagtggcgccatcttggctcactgcaacctccacctcctgggttcaagtgattcttctgcctcagcttcccgagtagctgggactaaaggcacacgccaccacgccctgctaatttttgtatttttagtagagacaaggtttcaccatattggccaggctggtctcaaactcctgacctcgtgatccacctgcctcagcctcccaaggtgctgggattacaggcatgagctactgtgcccagctattatcctcattttacagattaggaaatgatgcacagagaggttatgtaacttgcccaaggtcacacaaccagcaagtggcagagtcaggtggcctggctacagaatccgttcatgctctgaacctccactttgtgctacaggtgaaagacaccttctactcataaaaagagagtctcatatttccttttttttttttgaaacggagtcttgcactgtcacccaggctagagtgcagtggtgcagtcttggttcactgcaacctctgcctcctgagttcaagcgattttcctgcctccacctcctaagtagctgggaatacaggtgcctaccaccacgcctggctaatttttgtatttttagtagagatggggtttcaccatgttggccaggctggtctcgagctctgtgatccagctgcctcggcctcccaaagtgctgggattacaggtgtgagtcactgagcctggtctctcttttttttttttttaagtttacttcaaaggctaagtacagtggctcaggcctgtaatcccagtacttgggaggccgaggtgaatcacttgagcccaggatttcgagaccagcctaggcaatgtggtgaaacccagtctctacaaaaaatacaaaaattagctaggcgtgagggtatgtgcctgtagtcccagctacttgggaggctgaggtgggaggatcacttgagcccggtaggttgaggctgcagtgagccgtgatcgtgccactgtactccagcctgggcaacagaactgagatctgtctcaaagaaaaaaaaaaaaaactcgattctttaaaaactttcaaaagataaaaatgaaagtttgtttagaagaactattaccccaccaccaccacataaaaatagattcctttcactaatttaaagtttgtctaatacagccaacagcttggaggcaattgcacaactactcttaagaatgtgtgacagaacatgaaccaaatgttccaaaattgttgtgacaggatgctgatctacaaactacagtatctgcccttattttctgctctgttaacctattatcacagacagatttactactttatttttcagattcgctcataaagacccagttcatactcgttggtgttttatttcatcataacctaaggccataatttaaagccacattttctatatctatctacgagattagaatttggttttcgctgataaaattgcagctggcaaatttcaattaatgagaaaaaatacaatcagatgaacctgtatgcagagcagagtccaaagcaggcactggcttcagatctggggaattccacagagattttggacataaaaatccaaagcaaattttctcacagtaaccgcaagttcctgcaaactcaccatttcctgtgactgtgcagaagcccccaatggaggtttccacagtacaccttcaatttccccctcagcagggattctgatgaagcaggaaacctcacaccatttcaaagtgacagtaaaaccccctgagatccctgtggtcttagctccttagggtatgtggcaggaccttgctctcccaacagcagggctgggattccagaaggaaaactccatcctcagccccacctccacaacactctgcagagaactagccccacctcttttgtttatctgttttctgtttactgggttttggtctagagaagagaaaaaaagaatcatgaattatgtaatgttattttgtgctcagggggacaaaaaaagacaaggggcacccggaacatatattaatgcctgtaaatgttttgaatctcagcccaaaatgaaagtgtgccagaaacataactttcttattttttaaaactgaactgaagttgcattgtgagtcctttagtcaaatgagggtctccctgaaccctctctgttcagggttataccttgaacattgaacagaaattagtgagggcaccatctcatcctcggatcatcatcttatctgtgcttgattgtttcgtaatgaacatgtatcatttttaccaagagccatgagatggttattcccgagatttcagagtttacttgaaagtaataccagtttagagctgaaagaactatatatgtgtattactattcgttttgagttgcatctgtgtggtatttcatccaaaaagttcacaatacttgcaaatattaaccaaggtagcttcagggaaatgctttattcctaaagccaactgatcaaacatttccttcctagtgcctcttgatactcagttaacacactaaagaaaacaacctcattgacttcatttcaacaagtagaagaaatgctgaaagtctacttctaaaaatatctaaatttaaaaattattgctgttattattgggtctgttattattaccctttattgagcacttattttgtggaaggccgtgttgtaagtttgggtttataaaatgtattttctaacatattttgaaaatgggcatatccacatatttgtcataaaattacctgctgtaacatttcttgagtttcttttaacatgttgtctaaggagaaagaagagtttcttaacttgtaactatttttttttttgagacagagttttgctctgtcgccaggctacagtacagtggcgtgatctcggcccactacaaccttcacctcccgggttcaagcaattcttgtgcctcagctctcaagtggctgggattacaggcacgtaccaccatgcccggttaattgttgtattttctgtagagcagggtttcaccatgttggccaggctggtcttgaactcctgacctcaagtgatctgcccatctcggcctcaaagtgctgggattacaggtgtgagccactgtgcccagcccaacttgtaacacattctttaagattcaggaatgagttaaatagaaatttgtttttatgttgtattttttattttagtgacaatcttaaaaagcaatcttttatcctgttttttttttcctgacaaggataattaagaaccaaaagactttctcataataaaagacattatttgcttatagtccatgtttttcaaagtaggaaatgttttcccaaaggtttctaagaatgtttctcttcaaaaagcgttcagtcagttggaggatttaaaattttatttttggtttataatacattgttaacatttgagaaaaataatataaaatttttaattaaaacttccttaaaaaaaaaaaaaaacttcctttggccaggcgcggtggctcacacctgtaatcccagcactttgggaggccaaagtgggtggatcactctacaggaggttgattttatttcttctcaagtcttcaataccttcttctccctctttgaactcagcagatgaccttgtttcttattttactgagaatatcagagccctcagaagaaagtatctttgtcttcccaccacatctgccgattttatctatgcgtcttctctgctctgctttctctcgttaccctggatgaactggccttgcttcctccatctgtgccctggagtcattccttcaatgactcaatgactttcatcctgtagtaattccctcttgcaattgcagcctcagatttctttctttcctggatcattctcatcaacttacaaacatactagaatatttcttgtctttaaaaatcttacttgaccccatctatccaccttacccctatttctctactccctttgcactaactcctcaaaagagatgtcttcctttgttgcccacacttcttcatccacagctcctcctcaatcagatccaatcagatcacttgtcaaggtcaccttgtggcaagaccagtgactgatactcagttttcatcttacctaactgctcttagtttacgcaagagattacttcatcctctttgagacactgcatttggctgcagggataagatgtactaatggtttccctcccatcacactggctgttccttctaagtcacctccgctggcttttctttctgctcccaggatctaaatgttggcttgtcccaaggcaatgtccttggtcctcttctctgttgagacactctctgtcctttgagacggagtctcgttctgtcgcccaggctggagtgcagtggcacaaactcggctcactgcaacttccgcctcctgggttcaagagattctcctgcctcagcctcccgagtagctgggactacaggtatgtaccaccacacctggctaattttttgtttttttagtagagaaggggtttcaccatgttagccaggatggtctcgatctcctgaccttgtgatctgcccacctcagcctcccaaagtgctgggattacaggcatgagccaccgcgcccagctgagacactctctctgaaggtgttatcatccagactcatctagcttgaatctgcgtcctcatccaaatctcatgttcaattgtaatccccaatgttggaagtggagcctagtgggaggtgattggatcatgaaggcgaatttctcatgaatggtttagtatcatacccttggtattgtcctcaagatagtgagttcttgcgagatctaatcatctaaaagtgtgcagcatctctcccctcactctcttgctcctgcttccaccatgtgaaacacctgctcctccttcaccttctgccaagattggcagcttcctgaggcctccccgagaagtagatgccagctttatgcttcctatacagcctatagaaccatgagccaattaaacctcttttcttataaattacccagtatcaggtatttctttatttttttagagagatggggtctcactacattgaccaggctagtctcaaactcctggccttgagtgaatcctcccatcttggcctcccaaagtgctgggattaaagtgtgagccaccacacacggccagtccagaatggactaatacaagacccatttctttaaatggattacacattgatgatctcaaaattttatctctaaccttgaacttcaaagtcatgtatttgtgacttctcaatatcgccacttgatttttcaactggaaaatcaaatgtaacaatgaaaaaaactcaactcttgattcttgcacacacattctgtctatcctcatctctgtaaatagccctgctgttcacccagtagctcaggtcaaacacattatgggtcatcattgatttatctctgtctctttaaccccacaaccagtctgccagtcagtcctgtttaccctcaaatgatcacttctcactatttccattgctgctacaaccctggtcaaaataccatcatctctaacctaaacaatgttgatagttctggtttccttgcttcctgtcttgcttcccacccactaacaaacatatacacacacactcatccagtaccatctatgtacaggtctcattagtgaagaaacctgatccttccttaaagcaggctccctgtgtaagctccacagtacactataagcaccatgaaggcaggggccatggctatcttaatcagcactatattcctagctcctagcagaatggcagcatctgacaggtattcaataaacatcaaattaagggatggtttcattctagagatgggtacccacagttaagaggttgaggcaattagtaatgtttgcaacaaccatgaagagagatgcacctctagggctcaatgagagactgatgcaaaggttctgagtgttatgcagctcaggacttgggagtcatcagaatacatctgacctgagggaaccgggaccaatttgtccaggcagggagcaagtatgtggtgtaaacggcatgaatgaatctccacctggaagccaaaggttctgacatgaggaaggggtttccatagtcagacctgttcacatagagtaaataaatcaaaccccctaggctggagcaaataagcctgctgactaaagctagctgaaagagaaagagtcagatacaggagtagaaataatgtataatgctttactatattgctcttattttggtcttataatagtatactgctagagtttttaaaaatgatgtccatactgctattatcattgctggaaaacgctggctatttccttctagagaaggaaaagtaaacaagtcttaaagggtctttgactaactccccaagtgagagaaaggaaggaagccctcattaatgtacacatcccctacttcctactcactttttcttttctttttttttttttagggagtgaagtgtatatatcttttttaacttttttttaaattaaaaaagacaaagtaagtttcctaaactagttctccagacattcaactttttaaaaatacctccaggttcaactcagctggaattttgagtgctgctgagtacacttatatacttgcctggttgtttttctctttcctatatgttttactaactggcatttcagtttgagactctttcagaggagattataatggtcttttcaatagcactctgcagctccactgcctttgcaggtattgtactgtcaaatgtagcctgcgggggtatcaggcagcatttgggtatttatgtggcaaagggacagcatcgacatattttgggagatgccgacttgacgtggggaagaggaatattcgttagaaagggtaataggtctgaaaagcatatttggtaaaaggttttgttatctttgggaaatctcatgtacaaacacaagaaaagtattatgtcccaaggcctttgtgtggcacagttctggtgacagcatattttcattgtatatattggttcattaagctcaaaccaacctcataattacatgattgtgacaagattaactgaatggacaatccaaatggccgaaaggtcaaatgagggtccctctgtctaataatacttttactcttctgttatttttaggctggcttagtgagaatgtatcatgcaggcttgcagaggattgcttacgttttgttccaagactcatttattactattgtgtgggccgaaatgtgcacaacataccaaatccaggcacaaagtagaaaattaatcttcacaggagagaacaaatcttatttataagaaatcttcaaaagacagaaaaatgcaaagaatataacaaacactcatgagtcaacatccaaaactgatcattgttaacattttgacaaattttttgtctttcctataagaaataaaatattacagccgggcatcatggctcatggctgtaatcccaggactttgggagcccgaggcaggaagattgcttgagcccaggaattcaagaccagcctgggcaatatagcaagacctcagtctccattaaaaaatgttttcaatttaaaaaaaaaaaaagaaataaaacattacattagtcacccctagaaagtacaggaaaaaaagaaaaaaaattacagatacaattgaagcccccttgcactcccctcaaccccagtccaaatcaattactctcccagtctcttcagaggtaaccactttcaggaatttagagtgtatccttccagtgtgtccctttcttccgcatatgtgtgtgtctgtgtgtgtgcatttaaaaagacagaacatgaagatgctattagtatgaatgtgtccatttaagaatgttccattttccaatgcccaccaaggagaaaaacaaaacaaataaataaaaacgttacataagcagtacataatctgtaacttgcttttcattcaacagtatgttttttttggtttttctgttttttttgagatggagtctcgctctgtcaccgaggctggagtgcagtggcgcgatctcggctcactgcaagctccgcctcccgggttcacgccattctcctgcctcagcctcctgagtagctgggaccacaggcgcccgccaccacgcccagctaattttttttttatttttagtagagacggggtttcaccgtgttagcaggatggtctcgatctcctgacctcgtgatccacccgccttggcctcccaaagtgctgggattacaggtgtgagcgaacacgtctggctgatcattgttaacattttgacaaatttgttatctttcctataagaaataaaatattacagccgggcatcgtggctcatgcctgtaataattacaatgattttaaaacccatctgtgttgtgtatatgtagatttagttcatttctcttagctgctatatatcccttgcattactatactattacaatttttgtttataagttgccttaaaggtgggaaagtaaagttgaacgtggtttcatgtatgtttgttaaccactcaattttcctccttgtgatacttattcagtttctagacagagcaaatcataaatgtaaagggaagaatggagacagatctattgtacagcttggtgactatggttaataatgtattataatttcaaaattgttgagagtaaatttcaaatgttcttacccccaaaataagaatgtgaggtgacaaatatattaattagcttgatttaattattccacaatgtatacatctatcaaaatgtcagctgggtgccatggtttatgctataacccctgcactttggaaagcttaggcggaaggatcacttgagcccaggaattcagcaacatagtgagatcctgtctctacaaaaaatttaaaaattagccacgtatggtggcgtgcactggtagtcccacctactcaggaggctgaggtgggaggatcacttgagccgaggaggttgaggctgcagtgatctgttatcacaccactgcactccagcctgggcaacagagtaagagagtcacaaaaaaacctttctactaatcacattatgccatgtaagcacttagatagatggctcattccacttttcaggctcaaaataaaatgctttttatgctgacatcttgacttaggtgacttttcccaggtactcaccaccaaagatctacacacaaggattctctgccgtccctctgatgttgtgtccttgctttgactacaaataaaacaaagaacattaattgagtatagttgtagcaaacttgagtttttggctgaaaattaacatttatacaagaactcctgaaataccaagaaactgctttggctgggcacagtgggcacttgtagtcacagctactcaggaggctgaggcaggagaaccactttagccaggagttgaagactatagtgtgctatgatggtacctgtgaataaccactgcactccagcctgggcagcatagtgagacctgtctctaaaaacaaaacaaaacaaaaagaaacttctttgacttttcttgcacagttgacttgaattttgtgcatagatatttggagtagttaaaaaaaaaagattctgaaatatactcctagatatccctctccattcatattaaacttacttattttacatcattttattttattttgagatggagtctcactctgttgcccaggttggagtgcagtggtgcaatctcagctgactgcaacctccacctcccaggtttagagattctcccacctcagcctcccgagtacctgggactacaggcgtgtgccaccacacctggctaatttttgtatttttagcagagacagggtttcaccatgttggccaggcttgtctcaaactccagacctcgggtgatctgcctgcctcagcctcccaaagtgctgggattacaggtgtgaatcaccacgcccagccaaacttaattatttaaatctaagttgttagctgttagatgaaccgtttctaaactaacaaactcaccgttttaacaacagtaacacttaaaatcactactaatgaaaattctaaatatgcaaactgtaatttcctaatgaaatagctagttttttcttataaaacaaaatagaaaagtatcacatacaagaaactccacatcttgaccatttctaccttgcaatatatattcttgactcactcttttctgttagtgccaaaggcaacactgacagtcttgcataatccacaaggtggtccaacattaatactctctggaaaatagttgggatgacagcaaagctgaatcatcatatcactttacagtgtctcaaagtatcaaagactaaaactgtgattgccccactctctggatatttccccagtggtgcctatcttgaaaaagcaaattcaagagacatgaaaaaaagttattgggtttggttttgttttatttgagataaggtcttgtcatgttgctcaggctggcctcaaacttctgggctcggatgatccttctgcctcagcctctggaatacctgggactataggcatacaccactgaatgtggcttctcatatggtaattctattttaaattttttaagagctctgtatgccattttccatagcagctgcaccattttacattcccactaacactttacaagggttccagtgcctccatgtcctcatcctcaccaacacttgttattttctgtgggttttgtttgtttttaaaataatcatatatactttttgttaggtgtatttttattgggtcttatcctctgaaaaatatataacaactcttcatcagtccaaatacttggttagttggaacacatacaaataatatccaaagaaaaagaagtagcttctccagcatggaagaaaaggatagtcagaagtaatatctgaaaatatgcaatgaatggaaactacatccaaagattatagtgaaacaaggcaatctctatgcaataggctgattatttatgtgattaagctgacaaggatttacatctgtttttattcagctttttgtttaaataatagcattgtacattctcatattacaaatgttattgtatactattatatattataacatgtttaaagacatcaaactaactttttcaactgttcttgaaattttatggaaataaacattagaataaacgttgtgggccaggctcatgcctgtaatcccagcactttgggagacagaggtgggaggatagcttgagacctgggttaaagaccagcctggacaacatagcaagacctggtgcttaaaaaaaaaaaaaagttagccagacatggtagcatatacctctagtcccagctactccagaggctgaggtgggaggatcacttgagtccaggagtttgaggctgcagtgagctataaacacgccactgcaccactccagcctgggcaacagagcaacaaagcaaggccctgaccctcccccaccccaccaaaagaaaaaaaaaaaaacggtatgtgttcactgatactcaaggaatttatagattttcctatcaaaatcagtaggctccattaatttataataatttttgttttaaaacttacataatactagcatgcacagtatttaattgcccctacatccttataagttaaatattattggaaaactgaggtacaaacatctgcccaaagacatatgtttaataaatggttagctgaaattcaaagttaggtgctctctttccaaatccctacttcttttcactcctccattagagaacatagttctgtttgaagacgtgcagtttctttccttttcttttgtgtgtgtgtgtgtgtgtgtgtgtgtgacagggtctcactctgtcactcaggctggagtacagtggcatgatcatagctcactgcagcctcaaactctcggactcaagcaatcctcccaccttagcctccgtagctgagatgacagacgcatacaaacacaaacacacctggctaattttttttaatttttgtagagacagggtcttgccattttgcccaggctggtctcaaactcctgggctcaagtgatcttcctacctcggcctcccaaagtgctgggattataggcatgagccaccacacccagccaagtgcagtttattttttttttcttttctttcttttttttttctcacatctttttaggtctctgaacacccagaacacatttatttcaaataagggctcaattaattacattccagacttggtccctgtataagaagctaaaacaaacacaggatgctaattcagcacccagcactgaagagtcaacatgaaaacaaggcatttcacacacggatgatggaggtcaggagtagagttcgcatcagagacttagtttaggaaaggagacagctgtggacaggggcagtgccaggctctccaaccccttttccctgcctgcaatgctgaggatctcatgagatgggcagggatgccctccagatcttctaaaaccactgggttttgtgtattttttgaaaaaggagtgactcccaagttctggtaacagtcttctagcacctcacttaaaaaaaaaaaaaaaaaattgaggccgggcatggtggctcaagcctgtaatcccagcactttggcaggccgagatggtgggggtggtgatcacctgaggttgggagtttgagaccggcctgaccaacatggcgaaaccctgtctctactaaaaatacaaaaattagccaggcgtggtagtgtgtgcctgtaatcccagctactcaggaggctgaggcatgagaattgcttgaacctgggaggcagaggttgcagtgagccaagatcacaccactgcacttcagcctgggagacagagtgagattctgcctcaaaaaaaaaaaaaaaaaaaaaaaaaaaattgccagtctggacctctgtctcataagagaaagaatttatcattcagataatgattgttgatggcaaattctgattatctataagaattttgacaggctaggtgtattggctcacacctatagtctcagcactgggaagtcaaagtgggaggattgcttgagcccagaagttcaagaccagcccaggcaacatactgagacccctatctctctaaaaaaaaatttaaaaattagccgggcatggtagtctctgcaggtacttgggaggctgaggtgagaggatcgtttgagcttaggagttcgaggctgcagtcagcctgtctaaaaaaaagagttttgaaataagatctccatgtcaattagacattcttattcctggctcatagcaggaataagctacatatgtattcaaaatatgttgaaaaaatgatatttgaatgaattcttatgaactgctagctacatatggttggcaaatttaaagaatcaatctaacacatctaacattaaaacttagtaaaactggccaggcatggtggctcacgcctataatcctagcactttgggaggcctaggcgggcagactgcctgagctcaggagttcgagaccagcctgggcaacacagtgaaaccctatctctactaaaaatacaaaaaaaattagccaggcctggtggcgcgttcctataatctgtaatcccagctactcgggaggctgagacacaagaatcgcttgaacccaggaggcagaggctgcagtgagccgagatcgtgccactgcactccaacctgggcaacagagcaacactgtctcaaaaaactatagtaaaaccctgctaactcaaaaacttactttggaaacttatagagagcacagtggttaaaagcatgggtttgaaattagaaagatcagggcttggattttttttttttttttttttttagaaatatcaacatgagggcttagatttgggttctactacttgtcagttgtctttctaatttcaaagcccatgcttgagcacattactaaacctaaaattctttttttttttttcttgctctgtcgcccagactggaatgcaatggtgggatctcagctcactgcaacctctgcctcccgggttcaagcaattctcctgcctcagcctcccaggtagctgggattacagacgcgtgccaccacatgcagctgattttttttttttttttttgaggtggagtctcactcttgtcacccaggctagagtgcagtggtgcaatctcggctcactgcatcctctgcctcctgagttcaagcaattctcctgcctcagcctcctgagtagctgggattacaggcccccactgccatgcctggctaatatttgtactttttagtagagacagggttttgtcatgttggccaggctggtctcgaactcctgacctcaggtgatccgcccacctcggcctcccaaagtgctgggactataggcatgagccaccgcgcccggcctaatttttgtatttttaatagagatagagtttcaccatggtggccaggctggtcttgaactcctaacctcgtgatccgcccgctttggtctcccaaaatgctgggattacaggcatgagccaccatgcctggccagattctttacctgtaaaaaaggaacaatcacacctaccttttaggatttctgggcgaattaaatataaataatgataggcttagcacacttcttggcacaaaatatgtcaatatgttgtagctattattagtacagaactcaggatcatttctcttggcatcagtttctacagaataatcctattaatgttggaaatgtaggtgattaagttgaatccacactgacactctgacataacctggaattacatctttgaataatcctcaggatcagttggcttatttaacacttttctctagggtacagaaaaatgctagttatttgagctttctaaatttagcatgccaaaccaataaaaatttaccagttatccaaaagagattgtgataagttttctattactcacaaccgttgaccagttactttttgtttttgtttttgtttttttgaggtaagagtctcactctgttgcccaggctgaagtgcagtggcacgacctcggctcactgcaacgtcggcctcccaggttcaagcgattctcgtgcctcagcctcccaagtggctgggattacaggcgcccaccagcacgcaaagctaattttttgtatttttagtagagacggggtttcgctgatccacccgcctcggcctcccaaagtgctgggattacaggcgcgagccaccgcgcctggccaaccagttacttttgcttgcaccaagttgatcattcttacccctagatgaaaagcagtatcaaagcacttttggttgcaaatgatggaaattcaattaatattagcttaagcaaaaaagaaggtactgacctcaatgttgccagagctctgcttccttgtgtgtgctggcatccatctgcagatagcttcttcctgcacagcctgatgttaagaccatgcgcagcttcaggctcatgcggttctttcagtttgaaggcccaaggaaaaaaagctcctttctttcttagtagctacaaatcttaaaga

SEQ ID NO: 1427 - DNA, 205938 bp, Homo sapiens
attaataactgatatatatctttttattatgcacagataaaagatttaaaactgtggttatcaaaactatacatctaagcatcttcacaaaatagctgacacactgaacagagaaaagaatacaacaggggtgttcaaactggccacagggattttaagggtactcgttttaccctcatagatgatgaaaaccagcaacaaaatcaggctcattcaggaaaaaccagaagagagaagtattgtatttggaaactgataatagtcctttttagaaaaacatctgtcagtttcatgaacaacccccagataaaacaaacatgaaaaaaatcacataggactcacccaacaaaatgtgctctgttaacacaaccagcagtacaatcatcattcaaaccatgaggtagttacagtacaaaaagactggcacgcgtgtgagcaccccacacacactcacaatcatgcccactaagaacacaagcaggaaatggatttacaatcttattacaaggcaaagaaaaaaaccattttttttgtttagaaaatgctatagaaacagtttagacagaagaaatctctggctttttaaaatacagagtaacagctggtaaacaccacatggtgaaaagctatagcgtattatacagacaatctgccttggagtttggggcattttaacaacagcttcagcatcaaacaaacaacaaaatggcctctgcaaattaagggtgtagcctgcagaaataacaaaagactgcagatacaagagttcagctgaaatacaacaatacttttaaagaaacttgtagtacacgttataaaagtagagcttgtactttgtattaaaactgtaaagtgtgaagcaattagaaatactgtaatgagaagctagggagaaaataccttatttttttcatgttcattttttagaaacatttcagaaatacttaacgacattcactctccaatatgagattaggttttatcgacacagatttcttgatctgaataataattctgacaatgagacccaaacaaataaaaggtgatttttttcctctctctctcttttaaaaagatcttttggtttgcatctataaatttgtaaattaattttaaattatttataaaatcattggcaatgtagcatctctcttaaaaatatatatttaaatatattacagaaggttttaaccctgtccttctaagacatcaatcttttaatatctcctaatagctaattttctttttaacacgatggaaaagattttttaaaaaagcaaaggactgatcgaaagaattcacagtagctgaaattaaacatttcatatggagtaacttaaatttatctaaaacacttaaatatatctttatacacaaattttgtagtaaaatatagctataagtgacttaaagactctagtcttctttgaagacatctttaaacttttttatacatagaatatgctgaaacaatacattccaccgaaggttaggcaaagcgcaatattttcaaacacaggtagcgtaatctaggtcctccactctgatacccttctgttaaaaaaaaattaaaggaaaaaaattctctaaactcatgtcttcttcgtttgtatatggaaatctagaaatttttcagtagatcaatgtagatagcctggaaatctcagccctaaagtaatgttttagttaaaatgttccttattgaaaaaaaaaaatgttccttattgaatgtgtatatctatcaggtaagtcatattattactcaacgatttggtaaaaatgattgtcaatttccacatacttgtttcccatgtagacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcctgattttggtcattttcaatttctgtaggcctgtaagaaatacaaaatttgcattaagacattttgcagtggtgtatgcaagtatgggaagaaacaggaagctgataaggtcatcagcattggttttggcccagggcacaagaaaggaatgttgccttaacacttgtcagggtgcagtccctgagggcagcacccatcaagggacacatcagaccccacaggttgtggcagcaaggtcagaagtgtgcatccagacaaaggtgcaaattagacaggaggatcgcttagaaagcctcaaagcatttcttgttttacatcttggttcagatataaagaatctttggccgcatctcctcactggttctactatctggctattaaccctttaccaactccttgagtctgggtaaaactcagggccccaaattatggatgttctcacctggacaaagcagcattttaaaaactggcatgtgtttcacattgaaaacccccaagcctgtgaggggctggtggagaagaccaccattttagctttctcacatgaattctagtgtggtacagaagcccagggtcatgtttatactagccctgggtgtggggtgaatacaacgggtgatctttatactgaaattcactctgtctttacaagggaaccaaaatccagccctctgagtctggacacgaggctcagccattggtcctgcccttggcagtagctgagctgagctgggctgggctgggttgggccgggttgggctgggttgggctaggccgtgctgctgctggagcaaggcgtgctctgcgtgctgccgatgctgtgggcagcactgctgttttccgaggctggcggggaggtggggacttgctgccttcctgctgtctcccctgcagttaataaagaaaaggcagagtcagagaaagacgcatattatgtatgtgcattcctgaaaagatcatttattccgcatttgccattttaactgatatttttctcaaccagggcagaagcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttcaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccacttttcattacacaccccactgcattttagctaaagccattcatcgtgccaaatgtgcagtgctttggagaggaaggaaacctcaagtcacacacatggtttgcatttaacagtgcaaaaggccctagagttagtcttctcttcggcaaaaccggcctcagtgcaaccctcaaaaaatggctctaggtagggaaaagcgatcagggctctccaataaaaaacactgcatttactttgaaaagtcagagcataaacttcataaacttcttgtaagcagcatcccctccttcaatgtgggaaaccccagagggccaggcctgtttatgaatgagcctcctctttcctgtcatgctgaaatacacatctatcagccggagataagcaacccttccagctgcttcattaaaacaaaacactcgaggaaaggccctgccctccagtgcaggaacttggccccattacttccattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgtgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgacttttttggaaacctatgttttggaccctccccagcactgccctctactcttcatgtgtgtgtataattaaggctggggaaattagcctccatggcaataactttctgccaaaaattcactttccccagagtaggagctttatttctagaagggaatcaaatctcttaactattctgaggtcaaaacaaaaacaacctccagagacccaaacaactctagatatactttaagaatttgactcccttacaaaccacatgttggtccatacccagctggatcctcacataatcaatcagaaggactaatgtggctatgcatgaaccacattttaaaaatattttttcctattttaataaggatacatctgaaaagcaggaggccaactccatctttttcttttttggctcacctgggctttgtttgctcagcccaacagcaggtaaaagagaaggccttgcttcatcaagcaatagggagcaagtgtgctcctccaggatctgccctgtgcttgattattcacattcaggaaaagtgccaggactatgccctgcccaggaagcctgaatatctgctttccgatgtctatttgccaaatataatttgttgccatgtcagtttattttcatccgtgcccattaaagagacctttcaacttcccgagttttgggaactcttgttctggtaatgcaaaacacttcaaaacaaaaccccaaacaaaacaaagaagcctccgcactcaagactgcaggatgcatctcaccagctggataagtcaagttaacctaatattatattgactttgatccaataatgggccaaggtgagtctctgtctgagaatctgctgggaaatattgaaagtcccctcttcagaccatcctttccagttctgtggctattttcacatgtaagatgcaaggtttctcaatataaccatgttttaaaaataactcttaccttttgacagattaagttttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttgcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttaggaggctgaagggggaggatctcctgaggccaggagttagagactgcagtgagctatgatctcacctgtgaagagcctctgcactccaacctgggcaacagagagagaccctgtctctaccagggggaagaagaaaaaaagaagcaaaaacaaacaaacaaaaaacatttcttaatggagaatgttttatttctttagcatggcatggagttgcccagatctgacttcctgctacctctttggcgtctatattacaactgtattcttatttctaagtctttcaccatggcaggtcctggggaagaaactattcaagaaagatgtgaatagcatgggaggactctgtggggaaacaagagaagagttaaaaagaaaggtgagggcaagcttggtatttaggccaaaggagactattgcaaatactctccatgaggattattacaaataggagcagacagctgttctttatctccctggagggcagaacatgaggaaatgagtttaaatggcaggactagggatttagatcagatagaaaagaacttgctgattatgaggattggttagttatagagggaatttatggaatctccttctcaggagatatttaagcacaggattgaaaaccatatacctggggacactttagatttaatattccttgatgctagaaagaaaataaagatattttcttctagatctacgtgttggatgcgattttctatcaattaatgtctcagtttcttgatctcctaactgtaattaattcacaagctcactctttaagcagagtgaacgatactacctttaatttagagaagtcttcaatcactttttatcattttcaaatttcattcctccccagcctccacacaaaagactcttcttttgcagcaaaattctccaggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggacttgaagctctggtttgttcaatggctagacttgctaccttagtaggtatattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaacacaccatgtgttcttaaagcaaaagtcaagcgcatacccaaaagtccacccaagtcaggtaagaggttttcattagaagtagctcgggaggtgccaatgtgttcagaggcctgaggtttctccaggttcccaagtgtagcccgatgaaaagagaaacagcaagcagacagactaaggtgtgataaggtaggaggcaagagaccaagtcccagggatcagacagatgcagctggaacagacggaaaccccaatgtgactgtaaagaaggcaggctccactctcttttcactcaaatgcccatatcattattttataaaaccattaaacacagaggttaagatgaatgccttcggctttcctggtgtctattggtgtgtctttttctctcaaaaaacaaagcacctcccggagcatctggccattcatacccttcccccttcttctcaccctcccctcagtttccataaaaggttaatagaaaacttaattcttcagattagaaacacttcttctttctccagtgagacttcccttgtcagttctccatttttctgacacagttcatcaggtcattgctttcctaaaggttggcatgtgtgcctgtagctgggtttctgcctgagccaatctgcttataatcagtctgtttggttattctcttcctctgaatatatgggaactccacgacagcaaggactttctgttgctcatggctattttaccagtgcctagaatagcgttggcatttaacaatagcttaaaaaatccattgaataagttgagtgaaagaacgaatacatgagtgaacaaaccaaaaaaatttagctgacactaaacagaggcaaaaagaaaaaccgaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaacaccaggcacatttgagggcaagagtaccacattcaaaagggggggattcggcaaacatatattaatacgtattttggctcacctgggcttcttttgctcagcctaaaaggagataaagccagatggccttgcctcatctagcaacagtgaaactctgaatcaagaaagtagggttccagtcctactttgtaacaaatttgtctcctgcagaatttgccatgcgcttcactatttgcattcgggaaaagcgccaggattataccctggccgggaagtctggatatttgctttccggtgtctatttgccaaatataatttgttgccatgtcagtttatttttatcagtgcccattataatggtctttcaacagccagtcctatacctttcaagcaggaggcaaaaaaacatattttatggaagcctgaagagctaaagaggaaagatccaatgatgaggtatcagggattcatcaataaaatggcccagtcagatcatcttaaagaagttcacaatcaatacatcccacccacagcttagaatttcctcattctttttttttcctcattcttaaataatcctatattaatattctcagatgatactgcacccatgaaacaagaatagaactttttttaaaagaaaagaaattcacaggaaaaaagttattagaattaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacatacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcaggagatacatgacacaggacatccacaactcaaaagagaagtgaagggaatgcacagaatggtagcgaagaagatcataggaagacagcagtgtccagaaatggagggaaccggttcagacaggagcaggtcagaggctccaggaaagagctgaagaaaaggaatcagtagaacattccatatgtctcaatgtattaaaaggagattgagacagctggcagggtcagcagaagaattaatgataaatacatagaaaattaagctgatgactgaggaaggagaatggcaggaacctgagaggcggagcttgcagtgagccaagattgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggtgtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggaccttcatggactagaagttagggacccctgaactaggtagggttcctaggagcatgaacattctatggttccagcaccatttcagcccccaagcacccctcctctctacagcatcttaggagagaatgtaagttttaggaatggagttttccaaacagaattaatccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagtcagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaatacatgccataccaccaagttttgctttttatcaggtttgtgtgcttggctgtgggtaacagtctggattattggggggatttcagtggggcatgttccagtagtgagtattatctggttgccctatattctgcctggacctggcttcctggcccaagattagctatgagagtgcagctgtgtgaccaaggccagtcagtggctgagcaggcacatggtaaacatctgtgggtgacccagtcttcttggaggactttcaaactcactcccaacagccaacacaggctgccaacagccctagaacctctcagccaggcaggaggttggaaaagttgcaaagaactgttagcttgagatctgaacatgtcggtattcctgcgacaaaattacttactttaaaatgctgctctgctaaattctgtctttctggtccttttataaactgttcatgagggagaatcctcctaaactgattcacagatggttatataatactccagaatcatgacactggagtcttatttattttgagacaacttctctctctgtcgcccaggctggagtgcagtggcaccatcacagctcacttcagcctcaacctcccaggttcaagcgatccccacctcagccagctgggacaagagatgcacaccaccacgccatgctagtttttgtgtttttttgtagagacatggtttcactatgttgcccaggctggtcttgaactcctgggctcaagtgatcctcccgcccctgcctcccaaaatgctaggattatgagaagtcattttttaatctttcacgtaaacatactttactcaaagtatcctgactaggaacaagcatttgaggactcaaagtctctctattcaagtcttctacatttttgccaagaggttgccttttgggtgaatgtcccatgctaggcatgaaagagtccattcctctccttctggcgtaatctaaaatacctcaggcaggagatgtagtatttaaagtgaaaattctgatttgaatctgacacttttaactatcagaggatcactgtgtcatgcttttattctcaacagcttgacgttttgtctagcaatcaagagggtaaagatatgactctccaaaatatccttcagtacttccttcctctttaaatcagccatcctttcagcttggcccaaggggaagccaaagatcatggcattcattggtttaatggacaattaatgaaattataaacagagaagctgggcctgccacttgcctctgacggatcaatctagcacagtttatctaggttcacagtataaaactacaaggatccaagaacaaacaagaacaagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaaccttaaactctaacaacaaagtagctttattagcggctaaatttcaccaacatcacaatcgcaattagcacagtttaaaccttccttttctttccactgtttatggcaaattatacttttgtgaaacccaatttataccaaatatgtaaatgtaaaaatagtaggaatgaactttctctttcattcgttatttcatccaacaaaacactgagtgtctattgtgtggcaggaacacaagctgttcaccaactcttactcaacagtcacactaacctgtgtgagaatagatgtaccacaaggcccccgtcaggagtgctccgatcacaaaggctgcaaacgcaatgcccatcacggttagggtgtccagaccatggaaaattgctataaaggagagaaaccgatacacacaactttttggttagtctgcatcatgcattgcaattttatatttgtttcacaagcactgtcataaaggttgagcactaataaaatcggagaatgcaatgaagattccaataaaatacactgtattttgtaacttgcaaatttttttcaaaggttaaatgaaattatcaggtttccaaagtattctcagtttgcaatttattttgatcaacaaactaactaaaaaatcagatttgcaaactcagtaaaatcttgtctgtcatctcattgtctcactctaaggacctactatttgaatggagggtagcttgaaaattcacaggttaagatgctttggaaaataaagtgaacttccatgatcaaaatctggcttactgctgcttattcactgaacatctccaaaaatgacacactgcacagaaaacacacaccttagaatactttatacacatatttttgtgaacatttacaagtatgaaagataacagaaagaaaggagaatatagaataaaaataaactattcctgtggattataacatttcaccgatctcctcatattaaactcttaatcttaacagcttcatattgtatcatttaaaacaacctactttttaacacttttccaaccatgatctttctataaggggaacggaaatacttcccagtggggagtgatgtcagttttatggtcagcaaaacatataaatagaaccaattgtttctccatttggcaaaggtttttatatttgaaattaattccaggccccagaaatagaacatttcctttcatttaagagaactaccttctttgagtcacttataaaaagttaaaattggtttccaagggggaggagttttaggtagaatacaatttctaaggtctctgggttttgaatataagtgggaaatacaggatctccccactattatcatattatttctactttctgctccagtcagaagcaactccagtgatctctgtataaattaaatccctgcctttcaactcacttcagtgtaaagaaagctattttttttttacattgaagactgccatacactcctgtgacctttgggcagcccagcactccaaaggctcggggaaagtatgctgtggtggaacaagtctggaaggatccgaactcccaagttctggtccccactcttctagacctgtgctctttggtgtgttcatttaccttctgaaaaatgcggatagctttagtcacctgctgaagtcaggtggaggaagaggtgggaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccacggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagagcagacataagcatgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccatcccaagacaccctcctccccagacctgctttgttggcattttctctgggggacctttgctgagtctcccactgttccatctccatcccagcagagctagtctctcccacccttgctcattccatccctcctctgttacacttgggccacaatacctcctagttctctctctctttttctctttcttttgctttttttttttttttttttttttgctgtgagggcaaggtctagttctcagtcatctgtatatccccaagggctcagactggcatagaataggtcttccagaaatgtttggtgaaggatgattaaaatgttaatgtactttttgcaaatggaggccacagaggaaaccagcaatcagactatgaagacgttcatatgcagtttgcaccagtgccatgaagaaggcagaaaaaaattttgtatcactgttttggaaatgagcagcctgagactctgatatcgtgtgactagagcccaaggtcacagctggaaagcatcagggcagaagttgaatcagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgcttatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaattgatgtctataaaaataaagaagctagacaggataaaagaaaacagaattgtaaattctcaggattaaccatctccgatgggtgggtcaacattctggccacatgagttatcaatgtctggctctaggggaaggaatgctactggatgaatcagagccaccacaattgaatggtgccccctggagttgtgcaacatagtggccctggaatgaggatatatgcaaaagtatacttaaatacaattactaagaaaataaaaatgattgtatgtttttaagaaaatctaattcagtatgcagaacacacactaattacgctaactacagaatgcactaccctgggagctgggtcccatcagcctcattggcaccaataacaacaatgatgccttacatttgtacatttgtatggtgttttgcaatagacaaaaagccttcggccttcacttatattgtctcattttaaactcccaagaactctatgaaggaagagtatctacccacaaacttctcctttcaagacgtagtatttgattccctgaactaagttcaaaggcatttaaaggttgctacaagatgcatcatgtaagaaatatacacacttctgggaataattccatccaatcaaccacccatggttaaactttctcactcagaatccccaagcggttgaaaaattatgactctctcctaaggagacctcccatgtaagagtttaagttttatagtaaggcctgtgtgatggatggcattgttttaaaattcttaatggatttctgttatgatctaatcctttacccccaccccaaataggagccttctcacagagctaaacagaaacagttgttgttcatttcccctgggtgaagtctcttcgtgatttctgagcacaaacaataacaagcagaagctgcagaactgaggttaaagaattctatcctcgaacttttctcttcccgaatccctaagaacccctgagtataactaaaatggcttgatctccaccggaaccctaccatcgagttggcatgctgagaggaaaagagtggactcaacaatatttacttttggtttaaggataagattaagattataagaaaggaatcttagctattgctgtaaagagaactgtaacaataaagatttctttacagaaaggacaaactataatcaatgttctgaattaaatcttttcatatacgctgagcaaattttggtctacctctagaaccaaaattcccctcttcagattgttcagcatggttttcataaacgggatatttctggggttatgcatgagtaactgaccacagcttttggcctttagtgctcaatttggtactaggcaccataggacggagtgggcccacagtgaaacaagacgtccaactggtacccacatctattggcatttggcaaagagaagaatggggagaggaagattcctcctggagactcaggaggtctttgtgcaggccccatttaagacagagtttttactaacttaacgtcactgtaactgaaccctttttctggattctttcaatatttatgatattcattgcaattacttgttcacttatctgtatcctgccactagaccagtgtgtctcacgtggtgggtgatttttattccaggggacatttggaaacgtctagagacattttgaatggttacaactgggctggtggtgggagggtgttgctactagcatgtagtgggtagagaccagggacactgcttaacatcctgtaacacacaggcagccccccaactacaaagggtattccagcccaaacactgattgtactgagattgagaaactttgcactaggctgtaaaggccttaaagacaagataatttgtccactatacacctaccatatttttttgaataaataaccacaaatatcacgtatattttattcttgagtactttccccagcaatgcaaccttcacaccattttcagagtagccttcctaaatgacctaatcgccgggcgcggtggctcacacctgtaatcccagcactttgggaggccgagacgggcggatcacaaggtcaggagatcaagaccatcctggctaacactgtgaaaccccgtctctactaaaaatacaaaaaataaaataaaataaaataaaaataaatgacctaatcatcagtttcctgcttgagatcttctgatggttcttaacttttagaggtacatactggaatatgtatggatgaaattaaattaaatgtctgggtttccttcaaaacaatccagtggatgacagaaagtgataaaacaagattcaccataaattggcaattgttgagacttattctatttttgtatatatttgaaatttttcaaaataaaaaggttttaaaatgtaaaatactggccgggagcggtggctcaggcctgtaatcccagcactttgggaagccgatgcaggcagatcacctgaggtcaggagtttgagacaagcctggccaacatggtgaaaccctgtatctattaaaaatacaaaaattagctgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaatttcagaaaatagggtaggatggcaccacctcaactattttaaatgttttgtcataaaccataatatgcataaactatttatgttctctgggctttctgagttactactgaaaatcacagaacttctcctgaactttaatactctgctaaacaggttacacatttcccaacatcttaatcctttgggtgaacagacatttttcctaaaatccttcatcttccttttagttcataatcattagggtatttggggtgttaccttgaatactaatgtgatatggtatgaaaagggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaaaaaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctcaacaaatgttagatcatcatcctcatctccatcactatcatcaccatcagctttaaactttcatctattgttaaaaatttaaatggtaaaagaacgctaacccaacactgattcccaagggacttagagatcaaaagtggcaaagatgtgctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctgacaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcaaatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaattgtgattactctgcaacacaatttatattcttatttctttctcctgaacccaataaaaaggaactatttggaccatccatttatataaagactgggtctattataactttcaaatggttgaaaaccaatcaataaaagtaaaacaaacaacaacaaaaatgttgccgagaacatctcatgtacacttcacaacaactttaggacggccagaaaaatgaattaaagattattttgcttcttcaaacagcatagttgagtattacaactgaaaggaccttttggaagtcacccagtccaaacctctcctttccagatagagaaaatgaaacccaaagagctggtggtaggggggttctccaatgtcccacagccagttagcagagaaagctaaaagcagtgccttaggctcccagctccaatccagtgtgcctgccacctatactcttctgccattttgagggagcacattcattcataggaagggggcagatgccaccaccagatacacaattggaatggcacagctgttttcacagaggttagtcaaccaataagacactagacagtacctgcatgcctctgttctggtaggttctgcccactgtccaggggtcacccctgctgcctagtcttgccaaatcccaatccaacatgctcagatcaggaatgccatcccagggccacaccaaaccctagatctggtgtcagcaccacccagcaggccttccagctaataccctgaaactggagccagacagtgtgctggcttttgtcaaggcccttggtgcccaggctcctctgtgcccctcagagtggcgagaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatttgcaattttgataaagcaatacaataggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagcttctatggtaagaagacatattaatacagccatcattttaagtctatagcaggcatcccaaaaagctaatcaagttccatcttttccaaacacaaaagagcaaagactttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccgggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtatatgaggaaatacaggctctaaggggtccagagactggcttaaagtcccattggtggcagcagagcttccttctcagtcccaggctctttccatgttatcttaccttgggggtaaagggcgacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgcctacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataacactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtgtttttggcctgcaaactatctgaaaagcaaagataaagccagaaatctccctccatggaaaagcgtcttgatttatcactcgtaaggtactactaagtagcacgcatggaaaaaagaaactcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggaaagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacattgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataaacttaaacacttgtagaaacagctagtccttacccatagaccaacagccgcagaatcatttcaaaagacatggagatagaaacagactttccacgctgagatacccaggggaaacccctgacatcacatggggctttgaatccgcagcactgttgtgaaagattcctacgtggtggttaactgcaggacactcaacagtgaaaatgctaatgaagaggattctgataatgtcactgtggtgacattctgtaaatactaacacttcagtatttttgcaatacttctgaaaaacaagatattctatcttggaaaggtggcaaattacatatgtgctattactaaaaactgccgtttaacatgaactcagaaaccacatgccaaaatgtgtaacagagggactgcaaatctcttctctaatctcaaaagaaagtatgtagcggcagaatgtctaaggtatcccaaaaagggatacctttgtagcagagggaaaaaatatatattattttttaatatattttatgtatatatagtttatatatataaattatcagcaaatcttttactaaaaaggattttacttttagaccagaagtgagtaggagaaggactacgggctttgtagtgagacgagctcataaaaattacatgctctcctgctcacgtgctgggcaccgagactcagtttactcacctacagaatgagaacacgaatacccacaagatatcataattgtgaaaactagcaaagtaaaagttacatgcaaacaacacagttcccagagtgtcaataaatgctacctattagtaatagtagtattctagatttaaaattttgggttattaacaactgggtttgtaaattccccaagacaaatgaaccaaaagaaaactgccattatgtgaccaacagtcacctggagatgaccaatgaacaggtggcaacactgttaacttggattatgaaagggactgtatggtgtagagggaatagaggataaactatgagaaatataggtgatatatgaaaaggtataaatgggaaaacaagaatggaaaaaaaaaactaccaataacacacttcaagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaagagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagcgaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgattattaacattatatataggaaatagtttaaataagtttatacagatactcagatcatgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagattaatgacagtcatatgaaggatgaaggccctgtagcttcatgagctttggcttttaacatctgattttattttcagatagtccctaactaaagccaacaaaatagacagcattttccacaaaccccctactgataacaaacacataccaccacgatttcaggtcgggtgaacagggaagcatctccttcatccatatctcccggaaatccattatcacctgactccagatcttcataaccatctggccaaccactactgtccccaagggctggaacctgtatcacaatctaaaaggcaaagaaagcacagccaatgttataaaaacaccaaaccatgtgtgtttggttctgcctcacacaaacactcatgtaatcattctgatgcaaattgaaaatctgactttaagacaaaataataaaataacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaagctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatatattcccggaatctatcttgacataggttgaaattatgattcctggattatttctaaataggatgagaaaattcacccaagggtcatgacgccataaatgaaatcctaatttcttttgcttcacatgcttggattctgaacatgatgcaaaatagaaatatatagtaagtctgaaaattactacaaacaattataattggtgagaacagctaaaacagtctccaaagggagtaggatgggaagaaaattaaaaaaaaaaaacaaactgcctttctctctgtaccaggtcctccaaagaaagtactgacgccaattaaaggaagcatctaggatattgctaaactcaaagatcataataaagaaaagaaaaatatgtgagaaaaaaaggaactttaagggatcattacatgcctttctctcctgaagcaactgacttttttttttttttattttttcttaacagacatattactgtagccacttttggtgttaacttggaccccagttttaaaatgccataatcaagtatttcagtaatatatgacattcattatatctgtagacactggataactgaacgaaaattcatgctgcaattatcaggaggtcaaaggttaataaattaattatttgagtaacaaaaggagattagcagggcctagcctggtgtctaggaaagattagtggacaagaggtcaggaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttatccttataagggccagttgagcttgggcactgagagaagtcataatcaccttgacagtgcagcctttgtcatcaggagacggaaacggggggtgagaaaacaggccttccaattcccaaagactcaccaataaaacaaataaaaccaaagagctcagggtcaaagtacatccattttgttgagaactgacacttggctttcttcaggcctggggtgaaaaccctcttcatcttcaaagaaatgttaagactaactttaagggagcacacagccaggctctggcaaagggcaaagctttgttctggaaaacactcacggagttatagtagaccacaccatcaagggctgaccaccggggccgagtaccgcagccattcagaggagactccaaaacaaagtgtgtgccattcatcttggccttgcaggtaggatccaacagggtgacgtccatccccgagtagccactggcctaaaacaacaaccaccaaagacatggttggaggcccacaggcagttctgttgtataattgacacaattgacaattgcctggtcttccaaggacaggcgatgagaggcctgcatcgtgccccttccccaagtatctcttcccagctgcccacctctcaacagctcaagggtagtatctgttggccttggaaattcaatagcaaaatattgacacacaaggatctggaacccccaccccctgtcactgagaacaacaggaaccaggtgagaatcacagccaaggggaagtaggcccatccaactgagaaaacagtatcaagcctccggagttcaaaaatgaaagagatagggagaaattacagatgcagactagggccagatgggaaaggaggtagcctctcttccctcctgtaatcagctgcaccgacctgaaaagaatctttttctacagccacgatcatcttctcattgtcacatttgacagacagggcaatatccacgctcccttgcacctcttctggctctctgagaccaggaaacagttgtatgctgggaatgacagggtcctttggccgagggagcccatcttctccctcttcattccagactctcctggaaatatctgggaaaggaaacggaaggcctccattttggccttcccctccccggatgggcgggttctgcagggcaggcagggcaccagggtccagcaggatccgtagctcaggaggaatagtgtggacttcctcatctcccatctcctctgctggtgaaagaagaaggcaaaacatcagcagtgtttgatgccaggccacaaccaacatcattacaggcagaacaggaggaattagcatagaatgggcaggtgtaaaatgacttttaataagcagtgcataaaggtcattagaagtctagaagcctgaattctagtcctggtgttctctctaactagctcagtggctttaggcaagcggcttgcttctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaacagacagtttctaaggctgtccaagctagaaaaatctgtgatttaagttacatgatgcaatattattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaataatattctttggaaaggacgctagagctgtaagggtccaaaataagtcatagctttgtagggtttttaatttgtactttcacgaaaaccttcacaacaaccctgtaaggtctgtcctattattttccccttattactgaagaaaaatctgtggctcagaggtgaagcaacttctccccaaacagtgactaaatggtagagctggggcttgaacctgtactcctaatccttattctattggcatttcactcagtggtggtaccatgagctgaggaacaggtctagggatcacaaaactagggtttcaagtcatgctagctagaagactccagaaaacctcaagaatttgttgaccctctgctttccaccccattcagctggggtagtaactcctgccatcctctgggtatgaacactcaagtatgagtcctcgtgactattttcctaaaagatacagccttttaccatgaacttctttcctgcagtcttaactcttctgtattctcagccataagtggtcattaggtgtctcggagagaagaacctaatgtaatcacactaaagataacctataacaaagttctctgaatatgcattcaactctatgtcactgaaaatctgtattacagtttcctcaaaatctctgtctaggtaattttaagccttctgataaaaagtagtcaaattattaaaatgtacaagagaaaaacagcaacatataagctgaaatgacagttcctcactggaaaagcttcatttggggggtattttttacataacttaaaaaacttctaacttaccattattttcaagccgaagatgaaatctattagccacaggagccattgtgtatgaagttattggactatagccattgtccaaagcccacttcaccagattcccttgggttgaaggaatgtcatctcttattgatttggtcattgtcatagatctttcactctcttttccaaagccaatactgttaggagcctgaagatatagcaaaaaaatcactcatgagtctaaaattaaacagtactttagataataaaaattaaatatcttaaataagtagattctatattgtatatgagggaattatttattcttttgacccctgttttccttgggctaagaacgatgatgtgaaaaacctttaatagccgactaaaagacatctacgtatgctgcttgatcatactatttgtattgcctatgctgataaaaaaaatcatccaatgacatgtaagtagttacatactaagtatgcctagtctataactgtacagttagtctaatgtttaaattattaacacacacagtacatatgtataataaactttcccttttttttacttaaaatgacatataaagtatacaaacagacatgttatattgccctcaaattcccatgcttccacttcctattcccctagatttcaatgaaagatagcacaatcacttacagccacttaacaatggagatatgtcctgagaaatgcatcattaggtgatttagtcattgtgtgagcatcatagagtgcacttacacaaacctacatggtagagcctactacacacctaggctatatggtacagcctactgctcctaggctacaaacctgcacagcatgttactgcactgaatactgtaggcagtagtaacatgatggtcagtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactagctttcactggataatcaattacaaaattaaaatgacagaaatatttttgggaaaggatataaatggactctactcaaccaggttattcaacaaggacatggaaggtaaatttatacatcagttgctgactcctgtggcagtgctcttctcagagggtgagagagctaaatgctgcagaggggaccccaaagggaaggtaccatattttcaacaactgcaccaacagggctggaaagcccttccagcatgcagattacaccattttcgtgctgtataaaaatcactttaatttccatgcccagtgattttctcctgcatgcatgcagcatttttcctaaattcctcatttgtttcccattctgtttgcccctaacatgactaaatattaatcctttcccactgtaaaaccctaaaagattcacaggctctaagttctcttggcctatgtggttgtgggatattggctgaagccacatatatttcaactcaaatcttaaaggatctcattcagtatatttttctattacctaaagtgcttatgtgtgggaatactgccagactcaccagtcacaaattctatatgcaaaggaaccagacagaactttaaccaacttctgcggccatttgtaaactcagtttaatagattcagaatattttagctcttactccaattcagaaaaaaactccttagggtaaagaagggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcaccaatgtggaatgagctgtttgcacctttccagattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataaggagttaagtctaagtgcctccacactcccccatatttacatctggactgatggtataggggagggaggactaaggaagggaatggccagagagcgtagtgcatatgcccactgagatttttaaaaatgtattctctaagaacaagctgcccatcatcaaccctgaagtcctgaggccacatgaaataatataagaggaaacctctaacaggtttcctccatctatttttttatgttttagaggttcttcctaccataaaagtgattatgcatggtccacacaggacctgagaaaagagccagagctggacaaggcaatgtagacacctccaatgttcccattcttgcccactgcctggctctttgcacctcttttgaccattttgccatctggaggacacattctgcccatgccccacccccgacacacacatgcataagacatccatatttaatggtgctcttctttaaattactccatcagactccttacaattcccttagtagacatctttctttcttttcaccttgtatagagaagtgccctaattgttcctatagacactctgaaagagttatttatggaaggaagatgaaccccctttttatggcaggcactctgctaggcatatattatcttatttctcttccaaaatataaggagataggcattaccattcctgttagagaaggagaacctaagactcacagaagcaacacatgtagctgagaacttacatgcgcaggccctgtgtccagtgctttaggtgaaatatcctataggcccttaacaagtatttggcaaataaatgaacaaacaaatgaactcagctaatgaaccacaaactcaaggtgagtactatcatcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaactggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagagaaggcaatcaaaacatctctgacttcagatcatggctaggctttgggcttgacaacaaattaatgtatcaccattacatatgatggctcactgggatcctagcaaagttataaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggacttgccaaaggtcacagtgggattacctggactcagacctgggtccgtcttaatccaaggccatgtttgaacaaccgcacctattttataggagcatgctattttgcaaagtgaaaaataattgacagagcttagagagtccaaagaggcaggaactttaaaaataacacttataaagtacagcttaaattgttgtcatttatctaaacaaaacaaaagacatgctccaccaacttacaataattttcaggcttcccttaacatcaaaagatttgatcacccagttgacagactttttgcacttcaagatcaggatgagatttttgaccacttcaagatcctcttgagaaggtcttatatcaattgttatatccacctggaaagcactgtgaatggaagacaaaggcaaagttaagacctacatgccagaaagttgcaactatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgatgtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaattgatgaacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagcattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaacctgtacctagatcatgactccttttctgagcagttgacttatactgtcatctgtctaccaagcatctcctatctaaaaatccaatacttatgtatttcatggtcagcgtatttaacattcaatccattctatccccaaatgcactcctccttggatatttgttatttcaactatcaggagaagcaaccacctaattaatcctccgacaccccatgtagaattaatctttccctcatatgtattcctcacagcactttatactctgaagatgaaaggtaggaatttgggggaaataaagaaggcagactttcactctttctcacaatctgaacacagacaactcaagtttatatggcactttacagtttacaaagtgctttcgcaaacattatctcactgtgctgagagttgctcaccacctccacccgggaaagtgatgcaagtaccagaatctgaagacactcccacaacggcacatgccatttacacagcacggcggctgatgggatttccatccacgggcttaaatatttcaacagaacttgaaagaaactgctggcagtgtgacagctgggaccagtgtcaaggaagttctaggtgtagcatgcttttttcagaagggataattaatcagaggcctggcactactataaaacagacttctgccttttccattttgaggacaggatgccagggttcaagtccacatggaagtctcactttggagtaaggaatccaaccagggggtcccaagactgggttgatactgtccctccccctccccacttgtgcaacctcccttgtgctgaggtccgcagcacacactggggcatcatggctctggccaccacagcacccccagcaccaccccagaacaaaggggaccaaagcctctgtttgtcggctcgttgcgagagagcattgggtttgcactctgcagtctcctctaattcccctccccctcagagagaaaagctcaaggctccactgactcaggctgctagagcagcctccctccacatctgctgagggttttgccagatgagcaaatgaggtatgcacaccgtgcagctgcagccctgcggatgcctcccccacatcacaggatggaaaatgatattggaacggcaaggttgaaatttaattaagaaagagcgtctatgggccagggacaggacagtctggaactcaagagactagggccctcctgggattgtggccggcatatccagttcataggtgtgcctggcttgtatctggcacatagtgggcatatggtataggtttcctgaattaacaaacaatgatgtgagatttgagacaaataacaaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgataaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagtccaacattctaaatgttattataacaaattttcttattctaacaaattccaaggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcgttaaactcaagagtcaggaagcctgggtttgtgttctggctttgtcacttgttagtaacttggatgtgagcaggttcacttagccctccactaagccctctgtaaaacggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgatttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacctagaggaaagagaattgcgtatttaacatggtgcagtcaccggagctgaatcataattagagaaagtacttctcaaatcgaagtgcttgtaaatcgaacctcttccctttgttatacaagcagatcagcgtttttaagcagcggattcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaatcgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatcatcatcttgttgctgtgctataatcaaatttagttgctggtgaaaatatgtatgccatttttgttggctagcatttataaaataactgattttttcaatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcaattaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaaccaaagctactcacaacagctaccactgactgcacacttactacgtatcagtgctgtcaagtgtagtcacgatcatttctgaatgtcctgatgccagttataaacaaaaccagaggggaacatgtagctctaaccttgttttgacgtcgcctgaataagaaaaaaatcctaggtcattttcctgccaaaaaataaccatgcccacctaagtgtaacttctctgaggcttagctactcatcaacactgaacttccaacaatgtttatctaattttttgacttttgcactgtagtaaaatcttcctttcacttgtactaaaaaggcatttttatcaaggctgtcaccaaaacccacaacagtccagaggcctttgtcccactgccagcacagttctgaatgtttagacgagaaaccctggatgttctgcttcttgtttctcattcatgttgtggccataaactacagcaaccctatatacattatacacagagtacgtttttcagagcggaaagcgggatgtcacactggtgcattccagaggcaagaaagcaaacagcacaaatacagaagatatcaacggcaactccgaattgtgtcctgaagtaattaaagagcgatgccgtgatgaagctggtgatggggctgattcgtggaggaggaacaactccctctgctccctccaggcattgttgtcctcacgggccagcagcaataagcttcatacactcagggctgaggaatttggaactggagttaactgccactcctcaggcacattccaataagaagaaagcaaagctgcagtgaggtgtccctgactgcaggtcagtggaaattttcagcttcagcaaggagtgagctagcactcccctcctgactgccagctctcctgaccctgacaaggctacagctgagttttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctactagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctccatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgccatgtgtaagtgcctgcacctgcttcatcttcctccataagtaaaagcatcctgaggtctccccagaggcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctaataagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcattagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaaggctgaagtctgtgactcatacgtacactcccacactaacctgagcacattagcagtccttgctggggttccaggttgttcagccaactaccaagggacctcacagaaccttcctcatctttgtaagggcatcatgctacaacccaccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctacatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccaccacatccggctaatttttgtattattagtaaagacgggtttcaccatgttggcaaggctggtctcaaactcctgacctcaggtgatccacccacctcggcctcccaaagtgctgggattacaggtgtaagccaccacacccagctgggattacaatttttttttttttttagatggagtctcgctctgtcgcccaggctggagtgcaatggcatgatcttggctcattgcaacctccacctcacgggttcaattgattctcctgcctcagcctcccaagtagctgggattacaggcgtccaccatcaggcccggctaatttttgtatttttagtagagacagggtttcaccaggttgtccaggctggtcttgaactcctgacctcaggtgatccacctgcctcagccttccaaagtgctgggattataggcctgagccactgtgcccggtcacaggattactatttaacatgagatttgggcagggacatagacccaaatcatatcatttgctgaaatgaagacaagatatttccaggtcattcctctagtctaccagtccatgctccagacactgcattaattttcatggcatagcacccttatcagagtctggcttgtagaagaacataggatataaagagaatagcaaaacacataagaaatgtagggaaaataattttgtctaatatgagaaagggttgcaatcatcactgcaaggaagataactgcaagagtgtataggagaaaaacaacctatttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagtttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttctaacctctaatcacatggttggttcccttggcaaccagcccccatccagaggctatccaggagccccagccaccagtcatctcaccagcatacaaaaaggtacttaacacttcagagatgatgagggttggaggagctgtgtgccagaggaggagactatttattccatgccccatcttccaccttatccctggaggcttgccacaacactgtcccattttgggtccttataatctcaaccaaactgttgcagtaactttctaccctcccagccgctattcctgttccttctacccctcctccacactgtcacctgggtaatccttctaaaaagtaaacacatgataaagcggaatggcacctaagcatcttaacatggcgcatgactgaagtgcctctgcccgccctcatctcatgccaccctcccacatacccaagaactactcacagttgtagaacacatcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagggccaagaaaaaaccttgttcattctgaatcccttgggcctggcatagtgctgggcatgaagcaaggacccaataattgcttgttgaatgaaagctcaatgttgttacctacaggaaaagatacaccataattgattcattcccattacccaaactcattgcttcccttactgcccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgaggtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgattttcccaaactcactttacattttatttctacagtacttgtcaccttctaaaatgccatataatatgcttattgcccaactccttccactagaaggttccttcagaggctgggatcttagtgtgcattgtccatgggtataccccaagtgttgggtacaaaaaagatacttgttaagtatttgtttgataaataaaacaaatcttgatgtccaattaactggcagtgcctgcctaaggttctgtgctgagaaggattctgaggtcatattcaggagcagtggagaaatgggaacaaatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttactttttaaatgcaccaatagaagacttaaaattacatatattgttggcattatatttctattggacagtgcttctctagagcctcctccaatttgaccctaagaaaggaacatgtttatgaactgatcatgtccatccatctgcttcttggtctggtctcaacataaatcaatgtcaagaaaacatctcaagcccaacgcttcccaaagtctgatcctcagacagaagtacgttaaaatgcagactccagggtggtgggaggtagaaatgtaggaaactacattataatcctccctctaccactcatgattctgacgcatacttgaggaacattgttctaggccatagatatgaatattatttaaactccaataatctttataaagctcgaatgagattgtttgaagaacgagcaagaatctctcctctgcactgatgataaaaagccaagagggagagtgtaaagccaagtcatggatggagtcatctccttgcacatctcaaaaggaagaaatgggccttgtgaaataagagaaaccatagctccccaatgataatgaaaaagcctgttgagatctcagaggaaatctgttccaggaatctcaaacgcacgcgtacacacacacacacacatcccctacaactcagctgtggtccatttggaacttgagttatcagctgggtgagtgcctgctattcaggttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcagttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctctgaagccatgtgatgtgaaatgcaatccgaaacatgttttctattaacatatatcatgactcaatgccttttaaaaaagcttcatttcaaagaaataataacttccatgcctgtgaacctaggttcataatttgcaaagctacatattcatgagccatgtgatgatggtatctgccaatcatgcattcatgaaacacaaatccatgcagccatttaaaaattcttgggtgattttatttagtaccccaaaccagattactttcttccaataaaatgacttaaaacatatttgactattactttttctcaaaacattcatgatgatcatcctgttcttaatttttgctgaaatataaaaaaaacctaaatgactgaaaccgccccatgttcttaacaccctgcatgtttacacacgtccaagaggaaagctctgagatgctgccctccaaacacaaacatgcacaaacttgaacatgagccagtacaaaagcaatactctcatctcccatggaaacgttatcagaacaacagtacatgtgagtgtgtatatacacaaagagaagcaaaagatgtctttccatctaaaaaacaaactaagtccccacaagttaccaaactgatgaagcacaagctgctttctaatatagttttccaaagtagagtcccaggccacacaggaatcctgtccagctttacaaaaaattcttcagactcctaactttacccttcctcatctgccaatgttagcctgatggaagagcttacccccaaattcaaagtgcatttcaatctaaatgatgtttttcacgaaaaaaaataaaatgttggtatcattactattacttgccatattcctttatctaattttgtcctccaaatgtgctcctggagaaccccacaggagggaagactctctttttttttcttctaagttacatccaatcagccaagtcaagttcaagagcaaaaactgatttttacaaatgcctggctccaaacatgttcctagaattctctttatagagttttttttttcatcaaggctgataatctcaactccattttacagagaaggaaattgaagctgacagaagctaaaggatctacccaaggcacacagctggcagacaacagggttgacaatagaaccaaagacctggtttctcactctagagctctttctattccatcgctgtggaagagtcagctaccaggctcagaaatcagtagtgtagggtagacacgcacatccctcagcctcatgttaataaaacactaggaaatatgatattaatcacaaaagctcaggctgcacacttcctaagtgcatgtcacatggattctgaatcctcatatctgatagtggaaacaactggggctctgagcaattagataaagtgccagattacacacctttagcaagaaatgagtgcagattcaaactgtctgctggactccaaaaatgatgctctttccactgtgggaaggtggacactctgcctggaaaggtcatctcccgttggtgagggaactgactggctcacaggtcagcaaagacctgggtgtcttagggcaagctttctaccaagtctgggtaggcaaatacagaggaacattctccaggcttagaggagagtgaaaaggaaaagcagtgaggcaaagcagggggctcccacccttcactgctgcttgcagagattctcctggtgggttatttccctctctgtcccctcttccccagcaatctcaggagctgtgctggtcagagtggagaggaacggaatggaagggacagacagaaatagaaatgaaacagttaaagcaacgaaataattacttggctagaagtcaagttagagtaaacaacaacaaattgctcaaggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctgcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctcctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctataggttcaattctgaagccctgttcttggaacagtcatgagtggctccagactggaggccagagttagagataaaatcatagtcatgccctcgagtcagcagtgtgactgttcccaatgaggtccccatttaccattctggaaagtattattattattattattattattattattgctaacatttactgagtacttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactatggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggaagaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaaccttccttaacaaaacagtcactttttctaccgaacagctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgcgtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactgaccctagttcatgagaggatcaagacccatataattaaggcccttaaggacaagccacaaaaccaacagatgagcagactccggaataaaaatgcatggtacacaaccacttggaatatcccacaggacacaatgagtcattccacaagagacatttaaaaaaagaagaagaaccaccagcaatcttgaaacatttagttatttaatctcccttcaagagagaatttatctggggaaagacctcactgcaaaacacaaactggtatatccgggtccctggaatacaggggtaatgcttctggccgagccaagagctgtgtttgtgtctgcaaccttgacccatttgccacatgctgttctccagagccaacctcatgcaggaagctgccttgattgcatttggaagaagagaattctcattttctccaatttctactattctcatcttctccaattttcactattatttagcgtaatagtacttagcacactaaactgcaattcccaatttttcaatcagctctcccacacaatgggaagctccctgacgacaggcaattcaccccagttttccctagatcctccacagctagcacagttcacagtcaggcactaaaaactgtgtgttggatgaatgaacaagcacatacataaaccatcatacccggtatgctaattctgtgtttttttctaaacatgggggtgggggaactgccaaagaagggaaagaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccagttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaatagcatagagtttagtttctgtcatttattgcaactgccctgccttgatatttacttggatttgctgaagaggcaatgctcaatttgccagtttctgttccaaattaaattgggatataacatctagcagtcgtactatcaaagaatcacagagtttaaaagctgggaggaactttagagatgagctagtacgatcccctcattttagaaatgaggaaacgaggtctgagtagttaagtgattttttttcccgatgatgtatataactagttagtggcagagccaagactagtactcaggcctcctaacacccaggccagggtgttaactggaaacaaaaacctgaattacctccgagtagagctgcccaataaagtacaggacacccagttaaagttgaatttcaggtaaacaatgaatactttttcagtatatgttatgtcccatatactacatgggcacactaacaaaatgatttgttatttatctgaaattcaactttaattgggcatcctctatttttatatgccagctccagcaattgtacctcaaagaccaaaatccccttctatgccccatcccccactcaaacatacacacattcacatacatttgctctctgattttaatgataaatggctagaaaaaaatagatcacagcacagtaatatcgagagtgaatgaggttggaagaagctgcttatttcttgaaacttctaatcttagatacccttttttccttatgagcatgcaaagtgactaagcctgacataagtaagctggccaaggcctctggactaggtattttaggttattaaaagccaggcactagggtctcatcttgaaaacgtctgcttgtcctagggctccaagtctacagaccttgcaggagagaatgctcaagtttggaatacaaataaagcaagattaaaaaaaaaaaattagaggccgggcatagtggctcacacctgtaatcccagtactttgggaggccaaggcaggtggacggcttcagcccaagagtttaagaccagcctgggcaacaaagtgaaaccccatctttacaaaaaaaaaagtcaaaaattagctgggtgtgggggtacatgcctgtaatcccagctactcgggaggctgaggtgagaggatggtttgagcccaggcagcagaggttacagtgagccgagatcatgccactgaactctagcttgggctacagagccagaccctctctcaaaaaaaaaaagaaaaaaagaaaaaaaaatcaggtacatggaataaagtaaaaagatacatttaaaaacctagtccctgcccagcactgtggctcgcgcctataaacccagcactttgggaggccaaagtgggtgcatcacttgagaccaggagtttgagattagcctggacaatatggcaaaaccctatctctacaaaaaataccaaaaaaaatcagctggtcatgttggcatgcacctgtagtcccagctactcgggaggctgaggcaggaggatcgcttgagcccagaaggttgaggctacagtgaggcatgtttgcaccactgcactccagcctgagtaagggagtgagactctgtcctcaaaaaaaaaaaaaaaaaaaaaaaaaaaagtgctgcagcaagtttttactagttttatgaaatacagtccacataccataatattcagccttttaaactgtacaattcagtgtttctgtgtgtattcacaaggtgtggtatattcaccactatgtaattatagaacatttttgtcacctcccaaaagaaatctcgtatcattagtagtcattccccattttcccctcccatcagcccctggcaattactaatctactttctgtttctatagatttgcccattctggacattttatataaattggaatcatacaacttgtgacaattagcatctggcttctttcacttagtataatgttttcaagacccatctatgttgtggtatgtatcagaacttcaatcctttttatggctaatattccattatatggatatagcactgttttcatccactcatctgttggtagacatttgggttgtttccactttttggttactgtgaataatgatgctttggacatttgtggacaagttcttggggacatgtgttttgctcagttttccacagaaccattttacattcccaccagcaatgtatgcgtgttccaatttccctacagctttcacaacccttgttatcgccttttttattaaagccatcctagtgtgaagtggcatctcactgtggttttcattagcatgtccctaatgactcatgatattgagcatcttttcatgtgttttttggccatttgtgtcttttctctagaaaccgtgtatttaaattgtagtatgtccttaaagacaacttcatactgtggctctcattttagcaaattcaggttgaaggttcaggcatcatcacccagttaagttatcttactttttttttcagtgtagaaatgaatgcataaataaaaacaggcttatgtgatccttctaagagattatttgcagtttcaacatggcacactgagagggtaagatgatttttatttctgattgttctctgggccacccatacaccctgcaaaaggaaaactataagattattacaacttcatcacgtgtgtgtgtgactcacactcaaagattcactacttgaaactcagcctgaaagcatcactcttcatcccactcatatttcctaggtaaccagaataaccagataaaggagctgcacctgcagagaaaaccaaatcccactttctccctgcctgacacgttcccttcttgcctgtgctgtgagggggtgagaaggactgaaatgatttgacagaaaaagacagatgcctttattactagtattaaagtatgttttcagtcaccctcaagggtggctgcgatgtcctgggtaacataaggccctcctaactaattatgaaagttttccttttttaatttgggcagtcataacaacacagacatgtccatttaaataaaaaggtcaccctgataaatgagtagatgctattacttgaacttttctcattgccctatttaaaaaaaaacagttaaaagttctgtaactctacgtacacagtagacagctctgagacagaaatgcaaaccatccagcagcatatcaggaaacaggcaaggatacatgcatcgtggactgagagtcaagagacccattcgctttccacagctcctttaggctccctgggtaacctcggagaagacagtgatgaaaacggtgaagcctgaatttccagagatcccgtgggccctctgaagtgtttgatgaacactttatataaaataatttagttatcttatccccaaactttaactcttaactatacaaatggataaagagaacacactactggatttctattgatcaccagaccctctgtggcaaaggctatcaaggagatgaggagaaactaaaattcatttcaggccacagagaggaagggaaaagcctgcccaaggagagtggcccagcttgtgcaaggacttgcatcactcgttgtctgctgatgtgagaacgtgaatgaacaacagatgttccatcgtctcttccaggccaagaagaaatgtgcagacgggaaaaaaaccgttttccctaaaggaagcctgctggacaacaaagcagagttcaggtgtcctggaatttaaatccttgacttctcctgatgctgcctcccacgtgttggtaattttaggctcattacttgatctgcaatctccttacatgggattgatccaaatggggctgacgttcaattgtttactaaagcggccaccttctttcattgttagtgtctaaactgatgaccaagaagcagtttttacagattttaagcaaaattaaagcaaattaataactaagagtaagacactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatccggcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactgacagtgattatgagtacgaaggcagacagtttagcataacagcttgtagaatgggtcccatctaggtttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatgtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaattataatttatttatataaaatacaatccactgtccccctaatgtcttttatagcagctgccccactccctacccaacaggatccagctcaggatcacatgtgtcttgtctttttgtctcctctaatctggaatggctccccagcctttctctgtctttcatgactgatacttttgaagattataggccagttatcttatagaatgtcgttcaatttggttttgtcagcgtttcttcatgattagattcaggttatatgcatttctggcaaaaataccacaaaagtgatgctgtgttctctctcatttataggcacacagcgtccatctgccccacattgctgatatgaattttaatcacctggttaaggtatcatgggatatccccaaggtatatagtcactattttttatgtgtaattaataagtaatttgtatgaaagatattttaagaatatctaaatatactacttcctgaactccctccatctctgctagatttagcatctgttgataattcttgcctggtcaacttttattatgatggttgcaaaatgatcattttctaactcctttgctccttctagattttctagttggcattttactataaagatgagcttttccttttctcccttttattcatttatgtacttattataataattgtattgactatggattcttacattattcaacaagaacctttgagtttttagaagtactcttcaaacacaggggaaagaaactacagatctggattgagagacattaactgggcaaagtttattcatgaggcaagaggaaaactattaactggggactccacttgttttggatgcttgtgggcaagagaggtttaaggcctcaggcaccgcagttaggacattagcctgcagctctcgtaatagacaatgtgagttacaactaccaagttgcagtgctgctcatcatcagacatgatatcacaccaaaaaaattccatccaaacaacccatcgatttctccacaactagcacacttgaatgttctggcaaactcaaagggacatgatttacaaatagtaggtaatatttggatctttcgacaagagctgagttccagcttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcaggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtggactgaggagatgggattcaggtgaagtgtgacctaggaagcaacagaaagagggcagaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccttggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagagtgaactcatcaaacataaccataaagtaataagggagggacaggacaaaaaaggacttaggctagaaagacacagactgaatgatgcactgggaataatagtacatctcagctagaatcctcatgaggatgacatggtctagatccacgatctgtgtctatacaaccatcagggatacagcactaaatgctggactatttcacattttcccaatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagcttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgacttatcacagcaaattcatatatttatatgttacctaaaggggaaaaaaaggttcaaaggaatttagctggctaatttgcaaaaaaatacaaaaataagcaatactccaactgtcatgagctatttctgcacacagctaggatcatttttatatctggcataagcatagcactaaatcaaagtactagatgaacagtgatgtcaagtacagctacagcaaagtaatgtgctccttggttgtaaagactctacctcacagcacactttggagatgctgtccgcatctagaaataaacagattgatagccactgagaagaagagatgctatagaaatagcagaagcaaagattcaaactgtactgaacaaagagacacacacacactatggagaatgaaggagggatgaaatcatcatttgttccagtgtacctgaaaactgcaaagcaacactctttcactaatagcatgtatcagtaaaaggtttctctatttatttattcaagactatttactgagtaccataatgatgcaaagactagtaatgtatatctgcaggggctgcatcaacccttcttctgaagattttctttgcagtcctcaggcatacaattcttcttagagctcatagatatgcagaagtttcggtcaaaatatatactacaaaatactagtaagtatgtatttcaaatgaacaagaattttttataaaagctcatgaaatgagaagaaaaagatctatgagacagatattggtgctcaggtccaaaattttccagatggtcaaaagtgctgaggcctggctcatacaatcaagggaagatttctaggagccacagctctctgagctttcctggaaacagctccctcttcaatatgtggcagtgtctggccaagatgaatctctgactctggcacacagggtccaggcagagccccaaaagccatttggcaaagaagaattcacactacaattgggaaattcaaagaaaaatacccaatagtttctttaaaagatcatttggcagggacaatgagtcctgcaagtgcctgctcacctaatccctcagcaacctgtcttttctatgcttcccccgcttgagtaaatcttgctgaagggaagataaaggacaaccaaaacagctaacaaaagaaccatggtataaaagcttccagaaatgtagagagaacacacagcaatatctcaaagaattcctggctaagttgctcaatttctcccaggcttgggggaaaaaaaaaaagacaaaagaaaagaaaaagaaaatcctccttaggatcaattatagctcagggtagactacagttacaaatataagaatatcctgaagctttttgtggttacactctccagtgctcatggtctaaaggccgagctgaggcagactacagcaaataaatatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccctaaatggaaaagagttaattggtctaacctgttctacaacatctattcatactaggtcttctgcagttacctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtagattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatctgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattccctcaaaatatttttagagaactgggtgtggagctttaaaatttttcctttttatttttatatttctctgaatttctagaagaatattaatcagttggtgctgaattcaagaaatcttgacatacacacacattcccccccacacacacccagggtccccatcctgacctggggcactcaactaaccattctccttggtcaaatggtatcaagctctttcccaatggttttgtcttgaaaccacttaaagtgctgagaggggcactgtcagtctatttcaaaactaatctcccttccccccaacaaggacatgattcaggattccctgagagcctctgaaaatcatctaatataaccacaaaagagacaaaaaaaaaaaaaaaaaaaaaacctaaaatgaaagtctgaaacgggatgcagaaataagctctgctccatattttgtatgccctggaaaaatactgggaactaaatttgggttgggggttgaggggcaagagctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcatttctgcatccttaggcctagcacagggcaggacatctagtaggcagtccacaagttctctgaaagaaggaataaaagaaggaacgaacaaaagttattaatgaaatgtgactaggataataattacagagtcatattgacctgtttttctggccagaacaagggggttggggtgtatatagtaaacagaacattaacacacagtcaagataagcagattccagctactgaaacaaatgacggagatgcttcctggaaggtatgctggacagcatgccaaggccactcccaggctttgtaggacaagccaccctgatcatcatcctctctgtgtgtaagacagcgtagaatggcacttgggccatccatgggaaccataaaaggcaaagaaaagaaaatagaaaatgtttgttatcttaaacagttacgcaaataaaaacacataaaatgtaaaaaacctttggagcgtgttttcttccttagggatagataacaaagataaaatattttgagcaaatattccactatcttttagaggcatagaattttacacgggtttgcatgtaggcaattaagtgtgttagaatgattagaaattaaaattttagacaaactgaagaaactcaatatttgcaaattgattaaaatggagggaaagtttgctttttatatatatatattccctgtcacatttaataaatacatccattcagatcactttttgtttttaacactaatatgtaaccaaagccccatataactatgtgctatacaaacgtatttcctctcaagttctcctttttttgagacaagatctcactctgtcgcccaggctggagtgcagttgcacaatcagagctcaccgtaaccttcaactcctcaagtaatctcctgtcttggcctcccaagtagctatggccacaggcataaaccaccataaccagctaagtttgttttctttttttttttttttttttgtagagacagggtcttgctatgttgtccaagctgatctcaaatcctggtctcaagcaatcctcccacctcagcctctcaaaatgctgggattacaggtgtgagccacacagtacctagcctaatttctacattttataatgggcttcaaattagctttgctacatacctgtttagtaagccagtatgctcacatgtatatgtctttaccaacaacagaatgttagaatggcctgtgcatcagtactgtgatgtatcaaactgcataataaagagaatcactagagtgatcattagaagctgatttacaaaataagcatagcaggaactcaattcccacaaaatctgagtactggagtaatcattccacctgctacgtgcagtcagagattgaagctgtcctcactgggttaacaagaattccggacagaaaatataattaagcattaacatgctgctctttgacctagtttcttgtaaccaagtcacatagcactagattctcaccatttgcatccccattgctcctatagatagataggatgtctgatgttagaatcctaagggttttgtttgagagttgcatgagcagatcctgaattccaacgggacagctgacaccaaccagtttaaagactcccacaaaggaaccaccaaatcagcatgagaacacagtttcttcatccccctgtcccacgactttaccctgcactcttcgacccatcaacaatctccatatttcagcccacccaaaacccttaaaaactccaaccccaaactcctgtgggagatggatttgagttttcccccagttcagcagctgtacaattaaacctctgtctctgctgcaacctggtatctcagtgtattgacttgccacgcacgttggacaatgaacctattatggctgtaagatctcaataaggatttctgtttaagcagcatcttaaagttagttaatttgtaatagcaaaaacaaacaaacaaaaccccacaaaatgcagttgtagtcaggtagcgatttaagatgctctcagcagcaaaggatggcatttggattcccctgggctaaagtacaatcttagaaagtatattaacctgaagctggtaaggaattctttaggagtacagtgttaccttgctagcagaaatcagaaatccagagaggagtaattactaagacatgaacattcaaaaacaccgcacttggattattgttaaaaatcatggtggcagcagtagtaataaccatcatcatcatcatctcctaaggaaagacaataggtagatccatggctcctgttgagatttgctgctctcatcaaaaggaagtgctctgcgtaatatctaattactcccatcttaaaggtaaagaaattggtgttcttgccaaagtcatatggctagaaaatgacagtgctggaagtagaatgaatgtctctccctgtctgtctgtctgtctctccccctacctacccacccccatctttaatcttgggtgttagtcttgggacatagaggagaatgggaagctgctctatagcagtaagaggcaggaactattttactcctggaaactatatacaaactcagcaaagtaacttctcaattctttctggaaggagggataaatgcattaattactgttttgtattttcacattggatcacagaaaaaaaaaaaaaaagccatgctctttaagatgactttgtgttggccgggtgcagtgactcatgcctgtaatcccagcactttgggaggccaaggcaggaggatcacctgaggtcgggagttcaagaccagcctggccaacatggagaaaccccgtctctattaaaaatacaaaattagccgggtgtggtggcgcatgcctgtaattccagctactcaggaggctgaggcaggagaatcccttaaacccaggaggcggaagttgagttgagccgagatcatgccattgcactccagcctgggcaacaagagcgaaactccatctcaaaaaaaaaaaaaaaatagaagactttgtgtccagaggatattactgacctatgtcctgttgacccatctcttacagcatccagaatctgctgccttgtattaactttgtacatataaactatctcagagcatggggtgggacttgtatttttatcaccttagaaccttgtccagtatctagcacttacaggaattacattaatatttggtaacgaatgaatgactgaatgaagaaattgataggttttggatctgtgtccccacccaaatctcatgttgaactgtaatccccaatgttggaggtggggcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcgggtatttctttatggcaatgtgagaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaatctgtcatttgtcgaaagcacttagaacagtgactggcatctggtaagcactctctaagtgttagctattattacttctacccactaaaaccacagctgctattctccattcccttggttcctatggaaggaagctcttgtctataccatcctccattgaggcttcaagtcaaaacgggtttcctcatagtcctctaaacatcaagctgctggcatccttggactcggcccacattctcctcctaaaccaacttctctctgggcacacacgggccctgttaaccttcccctttgcccccactctctttcttccccacctggccaccccacttcctgagtcacgctcccaaagcttactcacagcactatcatgaccaacaacatctccaaggctcacttcactctagccagacttggagatacttcaaaggccccacatgattggagagaaggataagggagctgtgtttttgttttttttgtttttttttttaatacaacacatcctgaaggggatgccctgtttccatgtgtgtattttactctgacacaaaccgatcactctcaggcttgaacaagctcggtgaagacctccaccagatacaaaaccaaaaaggccgagacagctgcaaaggtttctatttccctagagatgggagtttcatggaaggctaaggatcaccacagcaaccagactacaaaaacagtcgtgggcttcagcaccgtaactctggtaaagcaatttgtgctctgtgaaaggctggggcacagaagttgaagaatgatcaaagtaaacactgctcctcaggcaccattttgttgtgctgatttcaagacactgagtctcagcatcaaagttctgttatgaaagatgcgcatcaagtgccaaagatttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaattgaaaaaaatcacctgttctagtctctgatctgccaccctaaatctatactgcagtttacataataaataagaaactacagcatactatttctacactctatagaagcagcaaatatagagtatagtaactaaaacagaaatctcttcatggatttataagaggcttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatgtgatgtgtacacatacttaccacaccccttttctctaggatgtgtcccatgtatagtgcgctgctttctgaatcttttgtggggaaggggtccacttacacaatttctggagtttcagcagaggctcactcagtaagtcagcagggactctgcaatccacaaaatttattgttccataggcccctctagcccagcagtttgcaatgcataagaggtaattagtaatatctaacacctaaatgcttcacagacaggaatgaatggcttggcttacgggcttgctcagtcttttctagctgcaccctcctccttttatctctaggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacgtctgtaatcccagcactttggaaggccgaggtggatggatcctgaggtcaggaggtcaagaccatcttggctaacacggtgaaaccccgtctctactaaaaaatacaaaaaaattagccgggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagctcacagtttgatgggggcagagggacaggcagatacaaacacatctgtgggcagcaggaagggggcacttcagctgggccagagggtgaatggggaaaggtggatctaaggggtccagacaaggagaagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcagagacatagaccctgatttgcttcctgatagataatgagtacattaacttctggcttagtaagtgtcacttagttaaccacattactgcactgattcactaaatgaacttccattacctgacttacttgcccaaaagaaaacatatcattcataaatctaataacaattttaaatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctggtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttagaacaaaaataggattgtctgatttctagaaaataatcatttgttgtttgccctcaaggagaaaaaaagttaattgtctgagaaacagaggaaattaactttcactataaaccacaaaccccggtgctccccaattttgccttcctcctaatgtaagatcctgacatatcattcattttaaaaagggggttaggcacagtagctcaggcctgtaatcccagcactctgggaggctgaggcggacagatcacttgaggacaagagtttgagaccagcctggccaacatagtgaaactttgtctctaaaaataataaaaataaataaataaatgatttttttttttttggcttaagtatcttactttgggcttcagtctccccataaatgaaaaggttagactctatctctatggccacctataaatctagagcctatggttctttcagcaactaatagagtcagtaaaagtcttcaggacagatctctaggccaggcacagtggctcatgagcattatcccagcaatttgggaggccaaggcgggcagatcacctgaagtcaggagttcaagaccagcctggccaatatggtgaaaccccgtctctactaaaaaatacaaaaattagttaggcttggtggcaggcgcctgtaatctcagctaatcaggaggctgaggcagggagaattgcatgaatgcaggaggcagaggttgcggtgagccgagatcgcgccactgcactccagtctgggcaacagagcaagactccatctcaaaaaacaaaagatctctagaaatgaatgtatctcaataaatgagttgatgtgactgaattatcaatttcataaatgccatgtcacactaaaatgatctgtgtactcaattaaaaggaacaattttaaaaagtttagtttagcctgccaaagtgaatactagagaacaaaatagaagtgctttctcctttcaacaagtgaaaatgtcttgaaatgctggcttgaaaaattaaataatgtttgttttagagagtttctttgctttccttaactttaattctgggtcagtgtgcccacttagtcttttacatttggcagaagcaaaacaaataatgaaatactcaaagctaatcctaagggtaaaccatgatttacagtgcattttaaaataggaagtgttgacatggtagtagtctaaaaacaagttaatatacttggtcttgctaatttcttttagatatacttttctttttttttttgagagtctcactctgtcacccaggctggaatgcagtggcacgatctcggctcactgcaacctctgcttcccaggtgcaagtgattctcccgcctcaacctcccaaatagctgggagtacagacgtgcgccaccagccaggctaatttttgtatttttagtagagatggggtttcactatgttctcaagctggtcccaaactcctggcctcaagtgatccacccacctcggcctcccaaagtgctaggattataggcgtaagccactgcgcccggcctagatatacttttcaatgagagagttgtataattgatactgaaagatgagcaggttttttttattgaaatataagtttccaataaatcaaaatatgatttaaaaaaaagagtaaatgcaaacaacagtatcccactgtcaggttctcaaatgccgttttgatgggataaatcctcctcagtaaggacaatggcattttttggttaaaccctacatcactagtctgagaacaagtctcggtcatcacaatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccattcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgtgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtggaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaagtactcactgagcaagaaaacaaaatcaaaaaaatcaagttataaggtatttaataatacacggtagagtaaaatgccctctttcagttagaggaatcaaagttaattaattccagcaatattaagaattggctggagtcaccccctacatcatgaggacagatcattctcaatggcccaacttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctagggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggggcacacacagggaatgggagagtgactgttaatagatacaaggtttcttcttagggtgatggaaatgttgtaaaattagattatgggccactggttgcacatttctataaatatactaaaaaccactgacttgtacactttaaacaggtaaactttatggtacgtaaattatatctcattaaagctattttaaaaacacaaacaggcagcaggcagaattcagtcctgcctagcacccttgatctgtccaccagccacaccgtgtaggtgaagaactttcctccacacctggcgcccactctgtgtatattgagtcctcccatcccttggctcaacaacactaatttgacttttaagccctccgtcaaatgttctttcttctgggaatccttccctcacttccagagagaatgaacacaccctttgttgggcttctgtacttttttttttttttttttagacagcgtctcgctctgtctcccaggttggagtgcagtggcgcgatcgtggttcactgcagcctcaaccttcgggctcaagtgatcctcctgcctcagcctcccaaatagctgggaccacaggtgcacactactatgcctggctgtttgtatttttgatagaaacagggttttgccatattgcccaggctggtcttgaactcctaagctcaagcgatctgcccgcctcagcctcccaaagtgctgagattacaggcgtgagccaccacagctggccttctgcaaatttttaaaatatattagtcatattatttgtcatgtttcattaaattcattctctctcaactctaataggtgctaaagacataaaaatgagtaagaatctggcagagcacctacctagcacacagtgggttcttaatagtgattcattgaacaggcctgtgaatgaataaacaaattcattatgagagcattatttagagaagtttggttttatgaagaggttcacaagctagacagaaagaatcagggtctaaagctgaagaggccagtcccaggagaccagttaaggaggctccagggtaagtggagaaaaacagagaaattcaagggcaattgcagaggaaatgtcaataaaatgtggtgattggccaaatatagggtttaaagagaatgggcaggccaggtgtggtggctcacacctctaatcccagcactttgggaggctgagatggatggatcacttgaggccaggagttcaagaccagcctggccaacatggtgaaaccccatctctactaaaaatacaaaaattagccaggtgtagtggcgggtgcctgtaatcccagctacctgggaggctgaggcaggagaattgcttgaactcgggaggcggaggttgcagtcaaccaagatcgcgccaatgcactccagcctgggtgacagagcaagactgtgtctccaaaaaaaaagacaaaaaaaaagaggatgagtaaatacaagatggttcaaaagttccaagatggatggtactggtgacattgatgggtcagggaagccagattgaaaagccagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggcgtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgacagccactcctccagtccatatctgaggcacctggcagctcaagatgggacccaagagccgggatgcttcagccatctgactgtagttccactggagaagcccaggcagagtttttggagttgtaagcaaggaagtgacaagcaaaatcctaagaccagacaagccacctcagggagaggagacagaggaaaacagaaagccaagggctatgcctcagtcaagaacccccgaggttaggcacactggctcacgcctgtaagctcagcactttgggagtccaaggcgagtggatcacttgagctcaggagtttgagaccaacatggtgaaaaaaatacaaaaattagccgggcgtggtggtgtgcgcctatagtcccagctactcaagaggctgagatgggagaatcgcttgaggttgcagtaagctgagatcgcaccactatactccagcctgggcgacagagccagaccctgtctcacggggaaaaaaaaaaaaaccccaagaagaaagagtgagcagctgagaaagaaacagaaaaacagatggaatggtagaatgagaaccaggaaaccaagagggaggtgccagaaagggagtgcttgacagcactggaggcttcataagctggggaggagcaagagtggggcaggcagatgtgtagaggcagctctgcaacagaagttggtgccccgaggggctagtccagtgctagcaccaagttcttggttaatagtgaacatgtcaccgctacaccctctggcctggttcccctaaggtattagggctaggtggaccccagggaccctctagtcctagcagcccttgagttgttcaaaggggcatcatcagggtctccccagagattagctcaggccacagagagggaagaagggaaagaaggacgtacagatgttcactcattccagtggagcaggggaaggaaaagagaaataagctgacctgaggcatcagaggggccaagtcatacatggcctcttcatcgtggaagaaagaaaagtgaaataattaaacgtgtctaaacttacacagaaatatttagaaaataccgtggaaggagtgattgaagtcaatgcaataaatacttctgcagagtttaagtatttaaatcagcgattagcagttaagtttccttttactctcaaacagaatgtcaagaagcagataagcaatggcaaggagaaggctcaagctggaaaactggagacgctgcacacgcatgcactgggcctttgcccaatcagcacatctgcatctcagatttgcagagctgctcctgacttgggtctattgcttttttttaatactctcccaaaagttctaagagcaaaatgtcacatttttaaatgcagagagtgctcttgtaaaaacattgtctaacaacactttcaggaaattatataattctttttttaaagccaagggcagttaccatggcaacagtagtacaggtcagggttctaaccctaacctccataaagacaaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcgtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgttttaacttcttagcttagccttgtgtcctggtttgtttcctaaaccccggtgtttgctattacctctctgatttctgctttcactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatatgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaatgtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggactgcattaggaagtcatttatgaatagcagcagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccccaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactgacatgtggtgtgataatcctaaaccatgaaagggaaaaaaagagacactgccacacacagaccaacttaatactgccccaaagctgcaaggaagggaatcaaaaaggactccaagcactgcaaagagttattacaaacctatgcacagaacccaaaccctcactaacagacctacttgctggctgtctaacaaagcagactcagcagactagcaggttctgtagcccagaaccaagtaagagctaaaaggaaaggacaactagctggagtatgggaaaagcttgcagcttgcactgtagaatccaacagacacaactcgggggctggctccacaactcaccatctggttgtataacctccctaagcccaagcatcctcttctgcaaaaacagtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtgtgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacgcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaaactcgggagtccgacacaagggggcggctgcattttacttcaaagtcagagggtactaggagctggttttcatggggatggaaaccatgacactggtcctcacttgctctaaaagataaatctgatctctcagcattgtttatgctcttctgctgtcctctgttgccagaaagtcattttccagtttcctgttcgcttccaaggctgttgtttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctccccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggccaggtgaggtggctcacacctgtaatcccagcactctgggagtctgaggcggacggatcacttgaggccaggagtttgagaccagactggccaacatgatgaaactccatttctactaaaaatataaaaaattagccgggcacggtggcatatgcctgtaatcccagctactcaggtggctgaggcatgagaattgcttgaacccgggaggtggaggttgcagtgagccaagatcacacaactgtgctccagcctgggtgacacagcaagactctgtctcaaaaaaaaaaaaaaaaaaaaaaaattggtagagactgcacaaaggctgcctctggccctcctactattaccctcaaaacagatcagctgttatttttagcatagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttggactaatgctgccatgaacagtcacagacaagtctttgtgtggacatgtgttttcacttctctcgggtatatacctaagagtggaattgctgggtcatgtggttcaaatgatttttaaaaactgtttgcatagctgcgggaatgttctccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgagatctgccgtatgtgagcaacgcagagccagatggaatctccaaaaatcagttatcccaaaatcttgttttcaaacagtattgaactacaaccatctaattcttaaaggtccgtctgttgtctattctcagaaacatcttcaaatcactggcccaaaatcatacatatactatactaatatcgaaagagaataatgttcaggtttttaaacaagtttgagactaccctttgtaggccctctttcttttcttcctcactgaacacactatgtccctgatgccagctaatgttatgtatcctcagtactgccaggtcctaaaatgaatcccattttgaataacatagtaaccaagtgcaggagagctctgctgtcactcctcgaggtatttttctcttgtttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaatatgagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggattttttgtggtttctctctccctggagagcgaatacctgagtgataacatttctgacacacagaagcttaaaaacagaatactctgtgttatcttgttgggaaatctgtactcttaaatgatgaccattcacccacaatctaggccatttttgagccacaggaaagaggacgccatttctctctgaagatgatgaccttgcgcaaataagttttctgcacctgttttgtcacctgtaaaatgagtataattgtaggattcatggagttactgtatgagtgcttcgaacagtgtttggcagagtaaatgctgagtaactatgagcatatatctttatcatcaccatctccgctaatgtcaccgccacctttgggaagctgcctagatagtgataaggagctatgctcagggattttcaggcaagtacaaagtaccgccatctttattccagagtgttcccatttcccctcactcatcctgcagaagcaataagttcatatgacaaagtaaagaaagaagacagaggacacaggaggaaatgggaaagacatttcacaacaacagagaaaacggtaccttatttggtttctcacaatcatgtttaaaagatgaaattattattattatttttgaaacagggttctgctctatctcccaggctggagtgcaatggcaatcacggctcactccagcctcgatttcccaggctcaagcaatcctcttgcttcagcctcccaagtagctgggactacatgtgctaactaccacaccctgctaattttttttttttttagttttatttttagtagagatgaggtcttgctatgtttcccaggctggtcttgaactcctgagctcatgcgatcctcccaccttggcctctcaaagtgctgagattacaggtgtgcaccatcaccatgcctggcctaaaagttgaaattcttatgaacgtttttttccaatacggagggccaggaaatggggagagccaaccaatctctagacagagaaatcctaaagttgcccaatccagacagcagctggtattttaaatctgttctcttatgttcatacatgagcttcttttgttgaaccccagaagagaagaaaaggacttctgtccagaaaatcatctctgcagactcagtggcagtgggctgagagctgacacctgcacctacctctctctgtagctggccaggcccctggcctgcagtgcggagattcaggacatgcacctcctgtggcagcccagttgtgcctctgctggcacagcctgacaaaacagtgaagctctccatcaaggcctggacaggatgggaggcactgacaggtgacagttcacacagtgcaccaggctctggacctgccaagggaatcacaaacacaagccactcagaaacagcaattaattctgccccaaaggggcaagggtgatcaaaccactgccaacccaccagagatgcctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataagatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccctagacaattacaaaccttcctgaacggagtctgaggactcaagctctgcatgccaccttccacacaggcactgtccacctaacctagaggcactcaatgttacgggtgttcccaaagcaaatgcctgccgttggcatctctgtgggaagttcctgtcccttcagaatagctgccctaccaaataaagcctgagctccaccacagagcacaggaggcccttcttgatctagccccttcctatgtctcatccctccccactccacgtcaacttatttaaaggtctccagacacaccaggatgtttcccaactccatgtcctcattcaagcctgcttcctttacccaaattcctcttccactctcactccgcccccacaacaaacatctcaagctgaggaaggctctctttctctgccctcccgcaatccatctgcctgtctccactactgcatttacatgatagccactggtgtacacatccatctttattggtcgaatgtgacctctctgagggctgtgggtactcatctttgtatcctcagcattcatctgcagtgcctggcatatatgagatgctcaaaaaacgtttgttaaatgtataaatgaatcattgagcttaaaaaaaattgccccctctcagatcagtgagtagggcaccattccagggacttggatttggctgtagggaataagggaaataggctgctacagccctgacatcactgcagcctcctttcacattggctggattgatagagacatacccaggggaagaaggaactggatgcttactcctcacacacttctgtgagcttggtgctattgtctccattcaatcacccaggaaactgggctgaaacagtgcccactacaccacaacctcccagatagaacccacgaaaaaggcctgaatgtactccagtttgttcttcctgacttctaaataataaaggtaccctccagggttgcaaacaaagttcagaaccagccagtctgcacccagaagcagacaccctgcctggtgggccaagtctatttcaggacttacagaaattatctaggctgataatagctatctggtctgaaatgaagtatgtgccttctcaaatagtcactgccactctctggactgtggccagctgctttctgagaaagcataaggtggtgaaggaagatgtcccgagagcaacaacaggaggtactgactgtaaattccctggagcccctggcggggtgcggggaaaccatatgggcaggtgctccctctgctgccctcatcctgccctcctggcctccggctttcccagccgcagtgggatgtctggtatacttcacacccagagcttcaagaaattatcctactcctactcaattctggggacacacactggctacagctacccacactgggaaacccttctgaactggttgcagagcctcctgccatgaatttacaattatcacaaattaagcacaaataaaaatgcctttcagttccattcttgtatgtgtgcaaagctctgaacaggctgaaaacacatctgcaaaaaggcctgcaatctatttgatctgccctcctctgcatgatgccaccatcacccattaagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaaaaaatatatatatatatacacacacacacacacacacacactcacgcatatatatacatatatgcatgcatatatgtatatatatgtgtatatgtgtgtgtgtgtgtgtgtgtgtgtatataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaagaaaaaaagctacaacatatgattaaactatccttacaccaaaaagacaaaaaaaaaaaatcaggaattatctaccaccatccccagggtcatataagaaatggtatctttaacagttcagcatacaacgtaataagagacactgctcggcccagtgcggtggctcatgccggtaatcccagcacttcaggaggccgaagcgggtggatcacctgaggtcaggagttcaagaccagcctagccaacatggtaaaccccgtgtctactaaaaatacaaaaattagctgggcttggtggcgtgtacctgtaatcctagtactcaggaggctgaggcagaagaatcgcttgaacccgggaggcggaggttgcagtgagccaagatcgcgccattgcactccagcctgggcgacaagagcaaaactctgtctcaaaaaaaaaaaaaaaaagagagagagagagagactgctcccatttattaagtgcccactatgcaatgctaggtgctgcatatccttctgacacattgcaaggaagcagcactaaccccattttaaagaaagcaaagtaagctcaatgtgcttaagtaactgtttcaaggttgccccagtcacccaaagcttcagacttggccctccttgcggctctctctctcaggaggcagggtcctgaagtgcccggccttgcagtaatcagggcaagagagatgatggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcctcagcctcccaggtagctaggattacaggcgcccgccatcacacccagctaatttttgtattttcaatagagatggggtttcatcatattggccaggctggtctcgaactcctggcctcatgtgatccacctgcgttggcctcctgaagtgctgggattacaggcgtgagccaccatgcctggcccatacttctttttctaagctccaggcctgaatattcaacagctccttcaccatctacttttgtctcatggacacccaatctcaacatgcagaactcaggatctttacccctcgtgcctgttgttcctccttcattccctccctaagtaaatggcaccagcctcttcctacgtacacctggcaccaacctgggggaggtgccccaacatcaccccttccctctcctcacccaatggattctctctctggccactcaactctgacccctcctctccatctccatgggcaccatcgtctctcgttccctgattactgcaagatgctcttaattcttatctccaccaaaatgtcttctatagagcagccaaactgatctgaaaaacccaagtctgatcctgcttttctctgctttaaaagacttatcactccatctctgctgtccagatgaagccccaaaacctcaacgtgacttacaaggccctccaagatctggccctgcttcctgccacggccccgtctctcattcctcggacacttgctcccgtgttttggccattctggtgaagcacagaagtgctcactgtctccctatagccatcattctcctttcttcaagtgccagctggacacacagccacccagaacgaaagctatgtttcccaatcccgctagcagctggcagcttcctgtatgaagggaaggaggtcagttcttctgccatttccttctgactgctggttggaatgtggatgtaacaggcagcactagagcaagcctttggggccatgagacagaagcagcatgctgaggagggcacagcaactgagaagccacctgggtacttgatgaacatggagccacgggatcagctctgaactgcttttttttttttaataggaaacaaatgtaaactcttttttttatataagccaatgttattttgggttttctgacatttgtagcttaacctaccctaattaatgtacttgccttcttttatttcatcagaagtgccaacctttgtcccaaaggagcctctgaatagcaaggtttcctccaggaacacattccccaccgtttctgttccttcccaccaccatggcctgacaaactcctgctcattctactgatctctcaaggaagctccccaaacctccctcactgtgttagatctgtattttttcatactctcatggtactctccgtttctctccacagcacttcctgtgatgagatgtacataattatttgtgcaattattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctttgtgccaataagggactgtctgtctcagacttcctgctttcactctttacctgagagccaaagcctcactcttatactaaaaggggcagaaaaaaaaaacaccaaccatgaaatgaaggaggtggcatttttggttgctaagaatcaagtcccagttggggcttccccaccttcaactgtcacagaaagcaggaaacacaaatctgtttttgtcttctcttcccggacactcttctggccaatcccctctctccaggtggcaggacaatcctctatctctccgttggcacaccacagccccagcctcatcctgccacttctgggtcaggccctagccttcctgtccctttccctctgccacagccagctcatgaacctgtctcccatccttcccccttggcctcatagtggttccttccgcaatctgtctgcacaatgccagggccagctccattcaggaaggcttccacctgggaacagcatgatccaccccacaggctctagcacaagtgcctgagttaacacagtggctcagattctcacttgaccaccatggggcccgagtatagcacctcccagccacgaaggcttggaaaccaggaaaacatgctccgaaaccccatctgactcatctgctcacttttgtggtgacctgtgagctctggagctgctactgtaggccctcaccggcagcctcaaaaggctgggagtgtctcctgtggccacggctgaaaacccacatcccgtcttccctacgcaatctcttccctgcagtcaagagccaagtgagtgacatgctctgatgatgctccttatcagcagcacagcaaaagctgtgttaccacgtaaggatcaaccagggcgtggacgatgacgaaagaacacacctgaaagcaacaatgctcataagcacacacgcgtgctcacttcacaccatactctatcatgaaaaggcatgttgcagatacttcatccaaagcctcacagaaactctataacccactataagtaaactgttgtgagccacacagaggtagaatgtgtatttcagaaaagtgcttcctggcagtaatgtccatatggattcacctccagagacaatcctcactggtgcctcccaatctggatatttcagttcattctgggcatctggtatgtgacgagtacaagattccttaagggtagctcccaaagaaatctaacttttccttggactcaaagtgtgagctgagtttaatcctcccctgctggcttactcgagaaatctgatctcaaaatcttgccgggtgtcgtgtcttgtttgaactgaagtcaggctctgctcttctgtttggtacactctcctcggccaccagcacagaggcacagcccccttcacccacaagatgctacttctactgacaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaataccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaagacttcatgaacttaatgaaactcgtttctcattttaccaaatgccctcctccatccttttcactaatgcttgcttatctggacacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcggggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggtttttgttattgtcccacagggaattctgaaatgctgtcagctgcaaagagggacaaactcccacagattgtgggactgggtactacaggatctattctgcccttgggctgaaaatcctttctacccccatgggatgcaagaatctgtaagaaagggcacccaggatgatttctcagccaatagcactgcctcacttcaatcgagcttcatgagaaggaatgttaccaacacaggatatgacgcaaaaacaaagctccaagaaaaaaacacctggaatgccctgagctcacaaacacgcctgacgtgtacataacatatgctcatgtttgtaccatctcaaattacaattcattggaactacagcgccttggggatggagcggtggaatgtaccaccattaaactccaaagagggcgcttctaccacagctcctacctgggtttttcaacaataaaacctggcttcaggctgaagcttatccctagtaggaaaaaggtagacaagtcctaaaacttgtaatttggatttctcagggggaaaaaaactagatttttctacagcacaactcttaggcatatcttatcatggtttctttcaccctccaagcaaaatctacatccaaaccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctctgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggacttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcattaaccctgagggatgacattaccaaatctgttcatctctcagaccttgatttgtacctaagatgatcactaattttctcttttttatcatttgcaaactggtgtctagcaagaaagaaaaagatgggagaaagagaggtaagaatgtgtgcaaaagcacggaggaataacatgcattgcatgtggcatgctctgggcctggtgagcattctgttagggctggtggccagggtctggggtgcagagtctgaagcagagacaagtggcaagatgagaaactgtaagagggtcaggaagggcagaagggggaaaccacaactgctggggagttgaatcatcgcctataaccactggtcctgattgcagataggagaccatggattaaaaaaggaaaatctgcaaacttttggtttggctgtgcaaaatattgttaattacagccatgtgtacacactgggccacgaactaaaacacatttactttaaggagtttatacataatcagggcactcacaattggttacaggaatgagtcaaatgcttaacactgaatgccaaattattcagcttaatatataggtcccaattataagactaaactctattccttcctcttcaggctagctagcctgctgcttcaggtgcttctgttaggagggaaactgagagctgacatttgcagagaaattatgaacacctggtcactggtgtgctcttgctcctttcacagtgaagctaaaaggctctgagaagctgtggacctggtttttccagagcttgtggcagttacaggcccatcaagcagtgccatcaacagaactactcagtgtagactgggtcttagagagacagaaggattgtgctcggctcagttgctgtggttcagaaccacagttttttgggggtaagtggacggggacaaggtctggctttgttgcccaggctggagtaccatggtgcgatctgggctcactgcaacctctaccttccaggctcaagccatcctcccacctcggcctcccgaatagctgagactacaggtgtgtgccaccacaccagctcatgtcttatattttttgtagagacggggttttgtcatgttgcccaggctggtctcaaactcatgagctcaagcaatccacctgccttggcctcccaaagtgctgagattacaggcatgagccaccgtgcctggcccagaactacacttttgtattgcacctgataaaattcagaggtcccttaaactgttacacctgttactcctttatagcaaatataagcttttataaatctattgcttcatttatttgggcatatgtttgtgtgtcctctacttaccagaaactccatgagggcaaggactgtgtttcttttacttcctctctcccagtgcttgacacagtgcctggcatgcggcacgtgttcataaacatttgttgagtgatgaattcatgtgccaaacaaccaaactcccaagctgctaattctctaaggactatggagccagtctcctacgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatgaaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcactccagtctgggtgacacagtgagaccttgtcttaaaaaataaattaataataataataataggaaacatcagctcttgcaagaaaatacttttccaaggtctcaatttaagaggcctgtaataaagcaagaatcagtgatttttaactttttaaaccaataatttgcattattgtaggtatgaaagcaagaagcaaactggcatttatttgctaaaagcatgtgatggagtttgtgatcttggcatgatatatgccatgacatatatcaaaaagtttggattttgctgtgtcgggtcaataagcaatttctgaaaggataaaatctaagcagagatatcagttcaataaaaggctaagagagaagggtataattcaatcaaattgtatttaacctaaaaataagataaagtactgtactattattgtttaataaactctcccccaaaaatttaaaactgggataaatgagatacctgttcagaaaaacatctattgagcttgctcaagacgaaactttacatagtaacatactgtaaaacatacatctgtatctgacaaagcaaccttccaaaacagatgtgtcatatgatgtttcaaagctgatttccctttttttttttttttgaagtttgtcacattcagtgaaagtaactgctgtttttcagaaatccgtgtgtgttattttggagaaaactttgctttggtgtttttccactctggatcaactagctcctctcttttcctcccaagcaaaccttcgtaaaccacactgccagagggaactcacctttctcccatggagacagctctaatacttgcaaatggtcaaactgaaaataaaatcccttgcatgccatttcctccaacaaaaagggctttgtctcaagatttgcacagaaaaacataccaaagctacatctattatttaaagtagtaattccttctctcagtatttcatattcctttcttcccaccttacttcatctggcccaaagaaccacctttccgccacacaataaatgcctcacttattcaacattgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcctgtgtctctgcctcaagcctatcacttaccatcttttacactcttatatactcaattttaagtcaatcaagtctggatgaagaccagaagatggctccccaacccatccacagagtaacctatatggacttttgatggctattttccttgtaactcactaaaacgttctgacttccttcatgatgcacaaacctgctgtaaaactgatactgtatcataatattagtgacaatattagggacactgtccacagtaatctaatttgaatggcaaaccatcaaagaaagttaagcttatgcactaaaggtgaactgttgggaatttagttcacaacaaaaccatgctaaaagctctattctattgcttctggggcttcaagcttttcagaagttctaagagaaaaaaacaaatgtataactaggtatgacaaagttcttatggtccctcaatcccattttctcatggtgacctccccttttctttcaggatgaagagatattcaacctgtacagcccagattaattacaattttagcataatttgcacattttttccactctagtttctcaatggaagttgtattcaccattccttcctgtcttctttcttgagtcagtgccagcaagcactgttcatagaaatcagatactcctaccagtgctccctggtccaggtcagtacgaatgatctaccatgaaccacagagtccagggcaggctggaaagcaccacctcacaaagaaaacacctaacggggccacccaaaggcccctctatggcagcagtccccaacctttttggcaccagggactggtttcatggaagacagtttttccacagaccgaggaggagaggatggttttgggatggaactgttccacctcaggtcatcaggcattcgtgagattctcataaggagcaggcaacctagatccttcatatgcgcagttcacaacagggttcacactcctataaaaatctaatgccactgctgatctcacacgaggtggagcttaggcagtaatgctcactcacccgctgctcacctcctgctgtgtgccccagttcctaacaggtccgtggcctgggggtggggacccctgctctatggtacaataccatttgcagctttctaaaatccagccatgacatggaatcttccctgcctttccatgttgattagaagtcggggtccaaattcactctttgcaaatcattattatgtaaggaaaggcatatgtatatgtatatgtatgtatatatacacacacacacatacatgccaagggctattactgtttctcatactcaagaaggttcgcttcctaagctccttcctgaaatgaaatcgtttctttgcccgagagatagctcataatttatcctagatttcaaccttttttagtaaaaagtataggaagttacatggaaacaatgaatggaagtgtacttttttttaatcaaacaagaacaggaaactttccgtggtttatggtaaaactacatatttgagccaaagaaaaaaataaactatgctcaacccctttttactctcccctatccaaaacatataagaacatgcacaactgacaaccacaagacaaatctcaacaccagggacaaattaatatttataggcttcaaaaatatacttccccaaattacttaataaaccccttcaaacaggccgacacctacttcttctactattgtatgaccaaaatgagtcataataaaacttaggaatattaaagacaataagtgaggaaattccagaaaatataaaaactatttcagggagccaaaacagaactatatttatttttctatcaaaatgcataggtataaataaacgggcaaataaaacaggcgctcacaaaagtaaacatatacccggctgcagttctacaacatagtcttctaaattaccacctcctccacattagagaaattacttccttcaacaaaattaacctccaacaccctccaaactgtaaaaatctctactatactgtgagcaatttataaaagcaggcatttttgaggccaggcacagtggctcacgcctgtaatcccaacactttgggaggccaaggcaggtggatcacttgaggccaggagttcaagactagcctggccaacatggtggaaccccaactctactaaaaatacaaaaattagccgagcatggttgtgggggcctgtaatcccggctacttgggaggctgaggtaggagaatcacttggacccgggaggcggaggttgcagtgagctgggatcgcaccactgcactccagcctgggtgacagagcaagactccatctaaaaataaaataaaataaaataaaataaaataaaataaaatagggatagtcctgtcctagctaatcctcagggtcatcatgaaaacaaatgagatcatggcatttgagaagtgtttaattaaatcaggaagttctataaaaatataaagataacatcaataagtatatgaaagatcaacagaaaagaacctcctttctcctcactacccactttacgttacaaaaaagaagcccacaggatacaatgggaaccttgggagcacagaggaaagaacactacatttggacctagaaggcctgggttccaggctcatctctgccattaacaagttccttgacttagggcccctctcttggttgcctcacctggagttaatactacataccttgccaaaatgaattaaagtaaaggatagcaaagaattctataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctatttttctttctttctcctcatttttctcaattattttccctaatccctacacttcactgaccactcctgcgttctcaactgcagtaagcaaatacatactaagttggataacatattattttgtatctatggtacacagctacagtgttggaatggctcctgattcttcctgggttagcaaatgttcacttaaatcaagtgtaccacctatttcagctattgagtctctttcatctttatgggactatattttgaaaatcactagaaactgcgtggttcccatatattgggctcaactgaaactttaaactcatgcaataactgttaatattcaagtataattttacctagcagtaaagttatattttgcacatcaaaagcaaaatgaagcattaagaaatttagttatatacattctttcatatccctttacataagcagaatacaaagtacttactttttttcccccaaatgaatacaggatttcaacaacattaagacatgattattttcacttactcccatataataggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctggctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgctatgaggcaaataaaccaagaactgggaatggccttcctttttaatcagtactttctgaaggatgctactgataacagaaaaaaaaaaaaaaagtcaatatacttgataattcacatctccctctgtcttggctggagttttttacagatgcatttacagatatttaaaataatgatcataaataaagctttaagtttagagtatataaatttttatttttcccccactcctgaaaaaggcttgatggttacttagctttttcttttccttttttttctattttaccaaacaagtttccacaagtccttcctacgcgtgtcctcacagccaagcaaagagcagtgagatttctcaccattaattcactcttcatttcacatgttcctacagcaccagctgttagtttatattttcagtctttactattaaaaaaaaatttcaactgcaactgcaccatttccccttagccccagcctttttttttttttttttttttttttttttttttttttttttttaggaaagtttaggacagcagaaaaactgctgagctgtgacacaaagaaaagctgactctgcacatgcctcattgttttctattttcattccagcacagttgtggctggaaaccagccttcaggattccccgtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgcatcaccacacactgagcacacatgtgttaaaatgctgacacattcattacaagaacatcatttatcctattacaagttttagagttttgcatgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggttcatgcctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgaccttgtaagcgaggccactcctcaaagagctagggatcccacaggctaaaaataaccctttgacccacatagaaattacaactcagaggaagctgagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattagttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaatcataatgctcaattcatacttttcagagggtgtagtcattcaataataaagaccagtagaaatattttaaatcttttgtaatcttctcagccaggtttgggacagcaactgaactgtccaacctctctctaaaggcattacatcataactgtaattacaccaggctgtaactgatatcaatgtaaatacacctactgtactacaccataacaacatcactgttatggtactataaagtattacaggcatagatgttaactgccacagtatttataataaacaaatactttaaaataaccagccgggcacggtggctcacacctgtaatcccagcactttgggaggccgaggcgggcggatcatgaggtcaggagatcgagaccatcctggctaacacgttgaaaccccgtctgtactaaaaaaatacaaaaaaattagctgggcggggtggcgggcacctgtagtcccagctactcgggaggctgaggcaggagaatggcgtgaacccaggaggcggagcttgcagtgagcagagattgcaccactgcactccagcctgggtgacacagcgagactccgtctaaaataataataacctaaatgttcatcaaaaagggtgtatctatatcatgaaatacatatgctgcatttaaaacactgttatttgtacagacagaaatatcttatgacatgttctttttgtatgtaaagaatgatacaatttattaaccttctaaaactatgtgtatttgtccatatgcatgcacatacatgcatagaaaaaggattaaatggataactctaactataaatggttcttacctaaggtaggggtgatgctagagacgggttggagacacgagaggaactctgactttgctctccatccttctatgaggttgacacaaaagtaattgcagttttttccattaaaagtaatagtaatggccgggcacagtggctcatgactgtaatcccagcacttgggagactgaggcaggcagatcacccaaggtcaggggttcgagagcaacctggccaacatggtgaaaccctgcctctactaaaaatacaaacattagccaggtatggtggcacacgcctataatcccagctacttgggaggctgaggcatgagaatcacttgaacctgggagacagaagttggagtgagccgagatcatgccactgcactccagactgggtgacagagataagactgtctcaaaaaaaaaaaaaaaaaaaaaaaagtaatggcaaaaaacacaattacttttgcaccaacctaatacattcttaatgcttttactgtgcaaatgtgtttttgaatattacttagataattaaaaatttaaaaatatgctctactttatcataaaaataattctgaccaaagccaatgctagttgattggtttctgctctacatatcttattttaaaaatcatatgtggtttaaaggaacaatctcagtgtctctctaggaagcagagaatcctggtttcctccacttcagtgacaacgccctctcatagacctgagagctgtggcccaacttcctcctcctctgtggtcagcaactctacggacctggggccttgcctgggtaggatgctgtagagaaaagacctggctttgaatcctggttctgtctataccatctgaaactttgccttagttttctcatttgtaaaatgaagacatctacactttgtgaggattacataatgcatgcaaatatacgatacatattaaatggtcaataaatggcagcttttatctttactattattaaccaggttagtctctagatttcagtatcaattctcctctgtaaagggagggcctatcatttgattattttgaaagttcccagctctaatagtctatgaacatgtgctatagaagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaaaaaaaaaaaaaaaaaaagatgaatcttagtgtgaccttcccaaacataaacttcattttccagcctcaccaatcttttagaacagaagatcaagtcaaatccctttagaatcaacgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttacagggccataaacccccttacaaagctgaataagggccgggtatggtggtacacgcctgtaatcctagcactttgagagaccaaagcaagggaatcacttgagtctaggagttcgagaccagcctgggaacatggcaaaaccccatctctacacaaaaatacaaaaattggccagcgtggtggcacgtgcttgtagtcctagctacttgggaggctgaggtgggaggactgcttgagcccaggagccagaggttgcagcgagccaagatcacaccactgcactccagcctgggtgacagaactagatagaccctgtctcaaaaataaaataaaaataaagatgaataatgtcctatttagtcgcccattcacaagccttattgagcacctatctagatggtaaatactatataaggtcctggggatacagaaataataacgcattttccttcttcaaggagctcacagtctaatgggaaagataggccagtgaacactcaatcatcaaggtgttaagggagcctggagggggagcctccctaattcacctcaaagaaggggaagatgagaagggtcaaaaaaaggcttcctagggcaggtgatatctgaggtgattcttaagaattaatataatctacccaagcaacatggataggaaatgatgaatctgtattaaaaccaacataggtacacatactttgaagaactgcgtggcaagttcttataaagttacatacaactcagcaattacagtcctaggtatttactcaagaaaactgaggacatatgtccagaaaaagacatgtttatagaggttcatagctacttaactgcataatactaaaaggaaacaacctaaacatccatcagcaggtgaatgaataaacaaattggggtatatccataccgcggaaaacattcaacatcaaaaaggaacaaattactaatacatgcaacaacttggctgttgattctcaaaaacattttgctgagcaaatagaagtcagacacaaaagagcacatgaacttctagaacaggcaaaactaatctatagcaacagaaagcagattagtaattgcctgggactggggatatggactacagggaggctgaagagaatgaaaggggtggagatggataatagaaaaattctctgtatcttgattgcagtggtgattgcacaggcatatgtattcattaatactcatcaaaatgtacctttaaatgtgtgcaatttgctgggtgcagtggctcacgcctgtaatcccaaaactttgggaggccaaggtgggagggttgcttaaacccaggagtttgggaccagcctaggcaacatagcaagaccccgtctctacaaaaaatacaagaaatagccaagtttagtggtgcacacctgtagtaccagtgactcagaaggctgaggtaggaggatcacctgagcctgggaggttgagggtgcagtgagccgagactgtaccactgcactccagcctgtgtaacagagcaacaccctgtctcaaaaataaatatataaataaataaagtgtacattttaatctatataaattatacttcgatataaagttgattttaaaagaaaaaaagagtatgtagtacagaacacagactctggagccagactgccagctctataatttattggctgtttaagagttaactagtaatggcattaatattcacactgcattaatatttagattataggcaaagatctggaagtaagaaatgacatgatagtatgaggactacaaacagtttggtatttagggaacataaatcaagaggaaagatgtgaaaacagatgaggccagagagacagacagccgaaggctgcaaatctctttgcccccacacctaagaaagagcatctgacatgccatgggtgcccattcaaatgtttattttcattgatgaacatccattgagataccattacacacccactaggatgactaattcaaaatgacagataataataaggtttgcaagcatgtggagaaactagaaccctcatatattgttgctgggagtataaaataatacaacaggccaggcgcagtagctcacacctgtaatcccagcactttgagaggccgaggcaggtggatcacgaggtcacgagttcgagaccagcctggccaagatgatgaaaccccatctctactaaaaatacaaatattagccgagcatggtggcaggcacctgtaatcccagctacttgggaggctgaggtaggagaatcgcttgaacatgggaggcggaggctgcagtgagccaagatcgcactactgcactcctgcctgggtgacagagcaagactccgtctcaaaaaataataacaataataatgcaaccactttgaaaaagagtttggcagttcttcaaagggttaaacacagagtaaccatatgacccagcgattctactctcagacacatataaatacaagagaaataaaaacataaggatgtgcttgactctggccttggccaaagccatacttcccagaaaaaagggaaaaaacataagcccacacaaaaacttgcatgtatatgaatgcccataacaacattattcctcatatccccagacaggaaacaatgcaaacgttcattaactgatgatgaattttttaatgtggtatatacataaaacaaaatattacttggccataaaaaggaatgaaataccaaatacatgctgcaacatggatgaaccttgaaaacatgctaagtgaaagaaattggtcacaaaaggccacatatggcatgactccatttctacagaatgtccagaataggcaaatccatagaaacagaaaatagattagtagttactagggcctggggaaagggaagaatagggagagattgccaatggataaagaggttttttggaggatgattaaaatgttctaaaattgactgtggtggcagctgcacaactctgataacatattaaaaatgattgtacactttaaagaggtgaattgtatggtatgtgtattatatctcaataaacttgttataaaatgtgcaatgaatatactatcaatagtccacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccatctcaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcattaccttgtccagtaccttatccctaagttatggtcctgttagatgtgcatttcttctattttaagtcccgctcacatttatatttagtaggaggccgctgtggtgagtggtgtgactgattctccagctgactgtcctaagccaatcactgtaactccattactctaccagggactgattcaaggatgggaggaaaagctgagtcaattcagccaatgattgcaaagagagacatactgggtgtctggggaaagaacctctctcgctcttagctgaagccagcattgcccttcctgtttgaaggagcaaaccgatggctcctgacagccattcctaagcaccagcacatccttcttcagctgaagatgaccctatgccagtaaagcaaacagacaaaacaacctaagtattaaataaaattagtcatattcccattttctcccatccactattaaaaaaaaaaaaaaggcctggccatgccacctgatgcctgtctcccctccctggtctggaggcacctacagagcagggggccaggagttccacgggtctcatttcctcccgtcagagcctagcacttagtcaaccactgcaagtcacatattttgcaagaacggaaaagcgatgaacagagagttatcaatctgttgttatactcaaccccaaacatttttaaaagcagattttaacggagaaaaaaaattacctacaggcctttcctattaaaacagatgaacatagttgcctttattgattcaagcaaagaccacattttactgaggaaaactttctgtcccttgccctctacctattcctgtggtgccaacatagaaaatgtcctggacttctagggaaggtaagctcccggggtggggacgccgtaggtgtgatgtaaagtgccaggcatgaggctggcatttgatgttaagcgctgtagcaacgatcacaacaacagaaccagcggggcgtgtacaggctggcggttacgacatggaatggtactggtttctattctcagcatgtgtcactgacttactgacaagacagttaaacataaaaggggtccattatcagtggtaactgggatcaagtccttgggatagcaggaataagaaaaatccagcagtaatccccaaacctcctgtttctcaagagtttcaatttcctgctccaaaccttttcaaaaactgctattaccaaagtaaactgatttaagttgactgttacttcctttccgtgatgtgacagccccaaaggatgagcagggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactactcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcgtcatgatcgctatagaataaacctgaaagggtttacttactaccctaattacaattactcagggtgaagcactggattctcctgcaccatgaagaactttcaaatgtaaccatgcacacctcctcttcccctaactccacacccccgtcaatattttggcttcattaactagtcaaaggaaaaagagtttgccaaatggcaaactcatatttcacacaggtatctcagccaagacaggaaggaaacatcaaatccatagcccagtgtataaatgttcagcactgaaatgaatgaaaacgaacaggacacttgtggttacgctttgacttaaatccttagttaaagggaaactaaagctgatccagttcagtttatcaacaggagagttcataaggaattatcatgagcaaacaggggcagccacccccgaaactgtagttgccttaagcagaaacggaggtgcaagtgaacttagctgtgaaagggtccctctggatggtcacctccacagaagcagcagctgctcaagccccaaggcacactactaaagttaaggagtgaaaggctgctggggtagaggaagaccgaaattcttccaggaaggaattctagtttaagcctgtattactgtcactgcagttccaggaccctcccactgcaggtccctctctcccaattccctggcatctagtcagaccaggaagagcaggtgagggacctcaaggactcctcaatgcagtgagtgggtgtttgaagctttaaggctaaagctgacttatacgtacgtgaaggagtccctctttttctgaccatcttcctgggcatgtgtcctgctggcaaatcaccaatgccagcactctctacctcccaaccccgccccctccaccatgacacctgggccatgacccaagcagacatgcagtaacaaggcacagtgtggctgggcacgatggctcacacctgtaatcccagcactgtgggagggtgaggtgggcagatcacttgaggtcaggagttcaagaccagcctggagagcatggtgaaaccccgtctcttctaaaaatacaaatattagccaggtgtggtggcacgcacctgtaatcccagctactcataaggctgaggcacaagaatcacttgaacccaggaggcagaggttgcagtgagctgagattgccccactgcactctagcctgagcaacagagcgagactcgaaggtcttcaaaaaaacaaacaaacaaaaaaaaaaaaacaaggcatggtgtggggaagagagccacaggatggcatcagaagacccatgcactggctgtggttctgacaaagtgacaccaaagggcacatatgctagaagggtccagccatagaatcatagaacctgtgaataccagaagcacccagaacatagcagtcccctcaaaggaagctctgagattcaaagtgtgctccaagatgatgtccatggctcaccaattcccatggagagttaaaactaccaaggatgctttggacacaagaaaacaatcactatgaaagcaaggactctaaggggacaacaaactccaaactcagttgttccagacaaggggtttttttttgttttgttttgttttgtttagagacaggatcttgctatattgcccaggctggaatacagtgtctattcataggcacaatcccactactgatcaggatgggagtttcgacctgctccatttctgacctggccagttcatctctccttaggcaatctggcagtcccctgggagtccccagggaagtcaccacactgacgctgaacttagtgcagacacctgattggcatagtgcactacaacagcccagaactcccgggctcaagtgattctcctgcctcttgagtacagacccaaatgatcgttacagtttacataaaggcagggcctgaaataaaattttcaaaaagctagatctttggtactcaacactctttccatctaaaaccagaactagaggccagacctgagcaatacaaggctgtgttccaaaaactgccaatactagtaccatgttctttgcctctgtctttctctggcataaccaagatcagctcagcctggcagggttatgcttggtgaagagggatacaggcaatcgggacttggtgctcgtccccaagggcagaatacttcctggctacttgtgtttggtatgtctttgttttggtttagccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtacacacaggtaaaaacttctggactggagtcccaaaggtctcttcaagttagaaatcatcaccattgtgtttccacctccccaaggcaagcctgtccaaaggccacaagatctgctagacctcacaagctggggcacaacctgcaccatgcccacctgcctgggttgttcatttgttaaaaccagtaatagtttgtcttttactctgcaaagtacagcttctgtcctcaaggtagatcatttcagacaaaaacaatttaaaaaaaaaaactgcactataaggcaggtcctcttcgctcttgcaaaaccaagtcaccttggctagagcccaaggaagctgtaaaatagaagtgagcataaacgtcacttagtctttagactcattcccatgttaacatggaataataaacattcttcgaccccagtgccagttccagaaataagtgatcatttaaaacttaagcaaaattaaggtttaccattcccagaaacatatgcttctgtctttatcaaccatgaaccaactaaaccactacaaggaaaggaaaatggaaatgaaaggtccctaattcgcagtgtaactcaaaggtaaacctgcagatttgggtcaaacacgcaaccaggacccaaatgttttatacacaggattttttgtgttatttccaccactgtagtttattacaggccagaagaaacctaaacagttaagaagtttgtccttaggcaaatagttcaataatttagacttcaaagactccatattaacctctgtttacacaaagtaatgtgtttcctttgcctgctgaacatcaaaacacgtaacaattaattacctctatttttgaaaacgacgtaagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcattttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggttccaaaatcgaagggagtttcttctcagagaaaactctgaatcggggtcacgcatggtggctcacacctgtaatcccagcactttgggaggccgaggcaggcggatcacatgaggccaggagttcaagaccagcctggccaacatggcgaaaccctgtctctattaaaaatacaaaaattatataaaaatataaaaatggtacatgcctgtaattccagctactcaggagactgatgcaggagaatcacttgaacccgggaggtggaggttgcagtgagcccagatcacaccactacactccaccctgggccacagagcaagaatctgtctcaaaaaaaaaaaaaagccaggtgcagtggcctataatcccagcactttgggaggccaaggcaggtggatcacagggtcaggagtttgagactgacctggccaacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaacaggcctggtaacccacgcctgtaataccagctactagggagactgaggcagaagaatcacttgaacccaggaggcggaggttgcagagagccaagatcacaccactgcactccaccctgggcgacagagcaaagctctgtctcaaaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccaggaggcggaggtttcagtgagccaagatggtgctactgcagtccagcctgggtgacagagtgagacttcatctcaaaaaaaaaaaaaggaagaaaaccctgaatcaagatatcccaaggaatatcccagtgagatctgacctaaatatatgtcctaattctatggaaaactcaagtactaacatattaaagaaagaaagaaacaaagaaaaaaggaggtccagatttccttaatcatctgctcagaattctcaatatcattttaactctacacatattttctacattgtccaatattctttgcaaattacctaagaaaatgtttaaagcctccagaaaaaggaactatttggacattatatactggaattttcactacatttttttcctacattgtaatgttttcatggttttttaacaattcatgtttctggcaaacttgttcttttaacactcaaagctaaactcatgtaacacatcatgctggctgcagtttgaagctactatccagctgggctgattttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagagacccagccactgcctatcccctgtctggctcacagccccatcataggctcaatgaggcaaaagtgttcccaactagatcaggatagctctaaccacaaatctgagccttgcttcttttaccaacagggagcaaagtcctctgagctccctcaactttgacacacaccatccggccacttttatacaacacttaaattgtccagaattcatttgcttcactgtcaccattcagatgggttatttgttagacaaaaattctatgtagctctacaaggaagaagtaagggctgggagaggaggttacagccagatgaactgtagcacaacacaaggaagaatttcccaagagtcagggatgttttaaattcaagtaaaggttgggggcttagtcaacaggatattagaaaggtagtttacatatcaggctgagtttgaccagataatctccaaggattcttaaaatgccaacacaggccaggcgtggtgctcacacctctaatcccagcactttgggaggctgaggtgggcagatcatgaggtcaggagatcgagaccatcctggctaacacggtgaaaccccgtctctactaaaaatacaaaaaattagccgggcgtggtggcggatgcctgtagtcccagctactggggaggctgaggcaggacaatgacgtgaacccggaaggcggagcttgcagtgagccgagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgtaaaatgtagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacgacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggtttaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatacttacaaatattcacataagtttacacatatacattagagcagaaaaattctcagaaatcatgcatttttaaatttgtgatatacataaattgacaaaaattttcagcaataattaaaaatctttcccttgctcattacagtaaaatctaataatcatgaaaacttctattcttttaaaggagcagtgaaagaaataattttacaggcccaaaaagaaaagtccctggagtccctgcttcacaaatactactgcattatatccttacatataaccttcatctttaacctagcaaatagcatactcgggagattgctgcataatgcccatgctgacaatgatagtgatttgaaatcatgtagtttggggtttaaagaaacttggagatagtacaaggcaatccccctcatctgccagctgagtacactgataattgagtgacttccctgcaaggaccaagagtccttggtggagtccttcattaaatctttatttggtccagaagaaaagattcccctactaagatatctcttctgtattattcagaaaaaaagcaattctgaaactttttgttgttaggatccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcaaactcggcgcactgcaagctctgcctcccgggttcacaccattctcctgcctcagcctcccaagtagctgggactacaggcacccgtcatcacacccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtatatgcagttggaagtttcaaatcttaagtttttttatgtttgtttgtttgtttttgagacagggtctcactctgtcacccaggctagagtgcagtggcatgaacatggctcactgcagtcctgaccttccgggctcaagagatcctctcacctcagcctcctgagcagctgggaccacaggcacacaccaccattcctggctaatgttttagtttttcgtagagacacggtctcgctgtgttgaccagcctggtctcaaactcctgggctcaaacaatcttcccacctcaccccgtgaaagtactggaatttacaagtgtgagccaccacacccagccaaatcttaagtctttttatatacttgtggttatttcttctttactattacacctaaactcaacaaataatcatttcttaagtttagttgcaaggtagcatctgaattacataataaatttttcatactccgtaacattaaaatcctttgctttccccaaaatactgcgtaatttcaaagtgaaaaatagtacctttacaccagagaattctggcagacatcactctagccaagtgaccaagattaacgtcactagtaataattcctatcaacataacatatcctcgatttgatgccctgaaaagaggacatcacctctatggtattcttccaaatgacacataacctcaatgtaatcctgagagaatgtcaggaaaaaaattaattgagggacattctccagtagttcccaaagcgtcaaggtcattgaaagaccagggaactgtcagcctggaggaggctaaggagacaaggcgactaaatgcaatgtgagatcctgggttggattctggaccagaaaaagaacattagtagaaaaactggtgaaatcctaataaatattatactttagttaataatattgtaacaagattaatttcttagttttgatcattgtactttggttatgtaagatgtcctcataaggtaaagctgagtgataagcctaaagaaacgctgtactacttatgcaacccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccgagaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtcatctgaaaaataatggtttactgccaaataagacatatttcattatataatattttaaaaatcacatttgttaatatctcaactgatttcatcagaaaagtatttaaccattgagaaactgtcataatcatggtaatggatgtaagttttccaaaattttaacttgtgtgaaaaacgaaattttattattggcaacaaatactgttgttttccttgaactaacaggttcactttgttcattttcttttttttttttgaaatggagtttcactcttgttgcccaggctggagtgcaatggcaccatctcagttcactgcaacctccacctccagggttcaagcaattctcctgcctcagcctcctgagtagctgagactacaggtgcatgccaccacacccagctaatttttgtatttttagtagagactgggtttcaccatgttggccaggctggtcttgaactccggacctcaggtgatcggcccaccttggcctcccaaagtgctgggattacaggtgtgagcccccgcgcccggctcactttgttcattttcaaaaatgtctgccaaatactgaagtctggataaccatcagttgtctgtcagtcactctttcacatcaaatggtgttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattataaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaaaaaaaaaaaaaagtagttttaggccaggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcacttgggttctcctgtcccccactggtcctgatcctcagcaccgccaccgttcttgagcattcatctttaccctgtaacttccagttaaagaccaagtcactgcctcaaaagaaaacaaggtcttttccatccaggtgctcagttcaaatccacctggctcagccaacagctcctcagccatctcccaaggacattccccaacctgctttttctccattgggagcacaaagctaaacagcaaatgcattctgcccataataaggttgttctagctctctctccccctcttttcctacacatatatattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttacggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagagaactctctagtttgtctttttgaggactgtatccatgtgaggatacaatgaaaagtcatcagtctgcaatttggaaaaggccctttccagaacctaaccatgctggcatcttgatcacagacttacagcctccagcactgtgagaaaaatacatttctgttgtttataagacatacaatctatgtgtgacttatatgtgactttgttatagcagtccaaactaggtaagtactatggtaacattttcaaagaatactatttccagtagtttcattcataataaacgtgatcctctggtttatatgcattatctcatttataatcctcacaagaacacaactgagacaggaactactgatacttcaattttacaaatgaggacactgagcctgtggtcacacagcctatgatctggacctgaacctgtgtgcctgaatccaaaacccaaggtcacaactagtgcacgatcctgactctctgacctttcatatgtctctgtcaagaccactcttgacactgtggtggagaattactttccctaaataaaggtgcagcaacccaacaaagttactcttcatcttgataaagccctcaggtattacccacattcagagggtaaaatctctacaaaatccttttgttacaagtccaaaatgaaagttcactggagtgactctgttccagcgaaactctgctgggaaagcccaacggcctgatggaaaggcacaacatccaatctttgggttccaagactgcctctaactctgacatttagtccaaaggaacaaggatattcattttactacatctcttgctcagcaacactagccttcagccttaaagaacatatctcacagtacacactgagctttgagttcctacaacttagagcaaaggcagccaggccgataactcactttagcaatagccttagttacacacccctgagctcactctccaggaaagtcagagggagtatcagttttcatcattattaatgaagagtagattgaagaggatagcattacagctctaaaacagaggttcttaaacataattctaataagacagacatgatgaatcttgttcacatttggacacactagagtcttcaaaagaaactagtgaaaactacaaaagcagtgctgaaagaaattaaggaaaacctaaacaaatgaatgggtgtaccatgttcatgaatagcaaaacagatactacaggcaacaaattatgagcacttttcattctatcacttgtaatcctaacttctctttctccctttgaaatatttttaaatgcaaataaccatacttattttagaataaccttgaatttagttttatctttttgaggaaaatcatttaaagtcttcaatttaactatcagttgtaatgttattcatgatatctcacaacctaactgggatatacaagtaggtcttgttatacagaattacctctccaaaataaaagcataatgagaccttttaaccataataaagcagcaaagaaaaatcatagtcttttgtcagtacaaaggctttcataattcctcatagctctcagatctgtgtttctatcaactcaaaaagttggctgggagtcatatgacagaaagggttaaaaatactaagctgctactctagacctgctggctgaggagcaggcaggttgcccagggtttcaggatagcccgcctcacacagagtaaacgtaggggatgctgtacacccaggaataaattcctcaaccagtgcatactctcctgaggcattcttgtaagctttttccaagttgagtaataaacagaaataatagatttttgggggcctttcctgagttcagggagatctgacaacatcacgaaatgtttcggcacagtcctctgaaatttttcattagaattcttttcttctgaatcatgttaataaagtaagatttggtctgggatttgtacataagtacttactcacatgttgctcaagcccaaaaggacaagaaaaagacgctgaggcctgtcaacaggaggcagggccaggctcaggaactggaagattactggatggatgttttcaaacagagctacacacagctcccttatataacactcaattggcttttagataagtctgaaatatccttctatactttgatcttcagctgtctccgttgccttcagagtcaacagaaactggcacttggctccaaaagcctcaaatctctctcatctataagggacagggacttctattatttgtctacaatttgtcaagctgagttaattataggtgttatcattctatatgtcaaatgtagcaaaataatgcaaacctgtttacctgtttcttcctttcctgcatgtagtataccctgaccttaaattggcatgcacttgatttcaaatgaagatttttttaaacagcatcttccaactgcagtagcagttggaaaattcactttttgctgacctgggccacctaaacagaggacatgaggaacctgacttgttttattttaagaagaaaaaactatttaaagccctgatcctggctcctttgaacatttaacacttaaaacctgaattgttacactacaaactagagttccttttcctctatttaagaagaggcccttgcgaagaatttatttagttaatgaaagttaaacaattgtgtttctctcacaaaacaaaaataaacaaaacctcttgaagatggtctctgggctctctaggtctgcaagtgtccatatgagctccctcacggagagcctagagcagtacactggcagtttagaaaacaatatagccacaagcacttctccaaaaagaaaagcaactcccctcttggcccaattccaaaacgcaattgagccgggtaaggtccaagctaatctctgtaccgtctctctgccaactttctcctgcaggcattaggtttttcagcatgggctttgcaaataatctaacaattaattagtgcttttgaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacacatttttgggagggctagaaaaaagctagcaggggggcaaaaagaaaaaatattgttacattcctcaggacttttctggttcaatttcaaaagcagaatgaccaccacctgagtcttgcggcgagctccagagctgtacataggttgtacgctgcctctccaaaaacagtgatgaggccagagaaagcaaatcagaaaaccttataaactactcaatggcagtgtaaacaaataaaagttagtttaaaacacaacttttcaggcacagagcttaaatattctcagtcttatccccacttataataaatgtggtgtcagggtgcttaataaacatcaattacaacttacagaaatttttcccttctaaaaaatgttaattttttaaaagctctagactggagtgtgattataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcaaaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaacttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattctcatgcatataagaaagcactggcctaatatttgtttataacctcaaactccaaaagcaaaacttcctattccataaacaagatggtatattccacctctggcaaaaccactcacctctggcaaaaccactatgaatatccttattataaaatatatttaaaagtgattattttctttatagaaaaaaatctgttgtatcatgctccttgctcacatttaatatgtagtttaacttataaaaataggttgacctacaactcagaaacatttactatgtaaaactggatgcaactgtatttcttcgaaactgtaatttacaacactgtaagaagcacttctgcaaaaggtggtaagaccctcaaaactcatgatcctgaaaaccaggccccctgagaaatgaaaagaacaagacttggaaatcaggagggtaagtaagcaaggaaaagagggtttaggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattttctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatatccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttaggaaagttaactgtattagaaaaaaatgaaaaggccagcgaggtggctcacgcctgtaatcccagcactttgggaggccgaggcgggccgatcacgaggtcaggagattgagaccatcctggctaacacggtgaaaccccgtctctgctaaaaatacaaaaaattagccgggcatggtggcgggtgcctgtagtcccagctactcgggaggctgaggcaggagaatgcatgaacctgggaggcagagcttgcagtgagctgagatcgcgtcactgcactccagcctgggcaacagagcaagactccatctcaaaaaaaaaaaaaaaaaaaaaaaagaaagaaaaagaaaaaaatgaaaaaactcattatttgcactaaccccaaagtctctcccctttctgtgcctcagaagctagcaaagtacctgaatcttaggaggtacttaacgttgaccagactacaagtcttcatctaaaacatagtagttatttaaaagtataaagaaaaggcaaaataagtggttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcaggaagatctcttgagcctgggaggttgaggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcaagaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactagattgaagttcaggataaatgttttttaggccattctggcagagatcgttttaaagaaaatgaaagtcagtggctgccatggatgtggtgcgggatgggccaatcatgcgcctcggtgctgagcagggtcagtcctaaaggaaggcctcttgctggcacgcttcccggaacacttcccagaacactccctgctcctacatcacttccaaaatcagcgtgctcagagctcgaagctctatggggtgataaagatacctccagagttggattaattaccaaagcaaacaagctgagaaagtctaatttcctatatacacaaccgtgtgcaagggtaagcttttagcaattaaagagctgtgtaggcacatacagataaagctgtgtcttgatggaagtgttgatcactgtaaaacacaccatcactgctgtcctaaaataacccaaatcaatcagaaatccagaaagctgggtggcaattatacagcctacgataaggatgcaaagcaaagagaaacctcgattctcttgacttggctaacatcacatctagcaataatcttactcattcttggtaaacatcctcccctccactatatgcacattcagttgcccaactagctattagtaaactctccttgaaaatgataaaaagggccaggtacagtggctcacgcctgtaatcctagcactttgggaggccaaggcaggtggattgcttagctcaagagtttgagaccagcttggaaaacatggcgaaaccttgtctctacaaaaaatacaaaacttagccaggtgtggtggcatgtgcctgtagttccagctactcaagaggctgaggtgggaggatcgtttgagcccaggaggccaaggctgcagtgagctaccgtgccactgcactccagcctgggcaacagagtgagaccctgtctcagggaaaaaaaaaaagtaaaaggccttgcattaggctatccaccccacctccacacacacacaggtccatacagggcaagggaatctttgagaaatgaactcacctttctctcaactactgcctcaactcccgtgtgtgtgtatgtgtgtgtgtgcgcatgcatgtgtgtgttgtgtttgcacacgcatgcacgcacatgctgtttctgtagaaaaatctaatggagaaggtaggtggggaggtgcttcatcacacttggctgtgcacaatatcctcaaagggaatacactctaaaatgcaggctaccctatccactctgggtctttcttttatttttgagacctagtttcgctcttgttgcccaggctggagtgcagtggcgccatctcggctcaccgcaacctccgcctcccaggttcaagtggttctcctgcctcagcctctcgagtagctgggattacaggcagccaccaccatgccactctaggtcttttaatagcagttatttgctctttaaaataaagtttggcactctggtgataactggtatcacatttgacaatatcctttccttgtgtatcaaaaagcagaattaaacacaaaactggttaaaataaccagctaaaggccaggcatgatggctcacacctataatcctagcactttgggaggccgatatgggtggaccacttgagctcaagagttccaaaccagcctgggcaacatggcggaaccccatctctacagaaaaaaaacacaaaaattagccaggcatagcggcgtgcacccgtagtcccagctacttgggggtctgtggggggaaaatggcttgaacctgggaggtcgaggctgcagtgagccatgatcgcgccactgcactccagcccaggcaacagagtgagaccctgtctcaaaaaaacaaataaaataaaaataagataaaataatcagctaaaaacaataataatcacagaccaaatcaactagctgtgttctaagacctgagggttggcaaaaaaaaaaaaaaaaaaaaaaagaagaagaagaaaaaaaggggagggggctttttttcagtttgctttgaacctttgagcctatccatcttctatccttacattccctggtggtagtcccctgccagcaccctccagccttcctgcccttatgagtattacagcctttgatcactcgtttggcagacaggagataactatggcagaaccacctctgaggttcacaggccgttaactcacatccaagatttctctttcaagtacaggataaatgaataaattgaataatgaaaatgtggtatatatacacagtggaatactatacagccttaaaaaagaaggaaatcctgtcatttgcaacaacacagatgaacatggaggacattatgctcagagaaataagccaggcacagagcgacaaatatcatatatgatcaaacttatatgcggaatcttaaaaagccaaactcatggccgggagcggtggctcaggcctgtaatcccagaacttttggaggccaaggcgggcagatcacaaggtcaggagttcgagaccagcgtggccaatatggtgaaaccccatctctactaaaaataacaaaaattggccaggtgtggcggcgcatgcctgtagtcccagtcaggaggccaaggcaggagaatcactcgaacccgggaggcggaggttgcagtgagctgagatcatgctactgcactccagcctgggtgacacagtgagactccatcccaccccctcccagaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagatggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggcccccttcctacagccccctataaaaatgtgaaaaaaaataatatattttacacatgaaaattgttaagagagtatattttaagtgttctcaccacaaaaaatgataagtgtgtgaggttatgcatatgttaaaaagcttgatttactcaccacaatgtagacatgtataaaaacatcatgatgtacaccataaatatatacaatttttatttgtcaagaggtgctaagggtgcactataccaaaaaggtcacaggatttgttggtgcagtttgtctgcaaaagcatgtctaagttctggtccaaccaagacttgaattatctttctaaatcacttactttctctaagccctattattctcattctagaaatgaagaaaatagtgcctgcctacccccagaggctgctgtgaggatcaaatgaaatacctgttataaaaacatttttaagattacaaatacaatatggtattattagcctctactcaaggctgccagcttgtaccattccagaccaagtattaaccagctggtatctcagcttgctctcccacagacacaaagagttcagagctttctgagcaggaaaatagctcagactaaaagcatctcgattttcctgtggactctacctggaattccaggtacatccagtagagaggaaaagaaatgtgtttctcaatagaaatctgtgcacagtttgcaggcgagtttccaaaaggatacatctgggtactgaattgagacagtggaatgaagaagttagccattccaccaagagcccactggcatcaatgccagcagccctgctccagagctcacctcagcggcacccctctcacctggcacaaggggccagtgataactccagcccttccaataaaactgatttccctgaattctccatgcatgcctctttttcttattactaaaactcctggaaacatagccctgcctaatgttggcaagcctcagaggcagcagctaatatcttttaaagatgtgtagaacagttgggaggttgttttgtttttgtttttgtttttgccttttcaagtttttatttttatccattttttgtattaaaaagaaaagcacaattatcacaaattacaaaggaggaaagcagaactagaataataaatgaatcacttcagcctggaaagcagatattttcaataatagtaatgttataacacaagtatagacgagtttttaaagcaaaacttagacttaagcccatagtatcaagcacttattttttaaacttcccacttttcttacattaggtagcttacaggatctaagaggccaataaataaccttagataatttctttttttttcttttttgtttttaaccccaataaatctcttgtatttattctctctcttttttttttaacccaagtaaatcacctaagctaatttctaatcaagaggcattatggtccttacacagctcgtgttcaccaagagcacagtccaccctccatcctcaacagtgctatatgataacgaaggaacgagggaggggagggaaagcatgagttttttgttttttgagacggagtttggctctgtcgcccaggctggagtgcagtggcgcgatctcagctcactgcaagctccgcctcccgggttcacaccattcttctgcctcagcctccccagtagctgggactacaggcgtccgccaccgcgcgtggctaattttgtttttgtacttttagtagagacggggtttcaccgtgttagccaggatggtctcaatctcctgacctcgtaatctgcccgcctcggcctcccaaagtgctgggattacaggcgtgagccaccacgcccagccgaaagcatgagttttgtcagaacaacactaacactgggacatggatatcccccgacccacccggccccgactgccttcattcactctctatcacaagcagagaaggaaagaaaggttttcactgaaggcccagacaaacctatggagctggaacaagcaggctcctattattctaacttgggctcaatttacgtgctcccttgtgctctgcccctcctctggccacataaccaaaaggaggcctttgacaaccttcacccctctgctgccagacctccacaccttcccaccgatttacagctttaaggccactttggttaagtcagaatatgaataaagaaggcccactacttgagggtccttctgctctgatgacctgtgtctgtctcttctgaggccaaaggggcttaatctggttccaggatgtcacactggtagctactcacctggtatttaatcaatcaagaagaggtttattcatcccacacacagggtctcctccctagagaaggatctagtggttgatgggctggattctagagccaaactgccaggttcaagtctcaactctgccacttattagttccaggactttgtacaaattattaaccaaactgagtctcaatttccttgtttgtaaaatggaggtgatgataataataatacccatctcatagagttgtcttaaataaattagctggcagagatcaagcccttgataaatgacagcctgtgagccaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacctaaatgccacattccgtgctaggccaggttttcccacctggtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctttaatcccagtgctttgagaggctgaggtgggaggatcacttgaggtcaagagttcaaggtcaacctggacaacacagcaagatcccatctctccaaaaataaaaaaaatagggtgggaacgaatcttacatttctttgcatgtatatccctaagtgactactactgtgctttgtactcagcagggatcagtgaataaatgatttaatgtttcaggaggacataaatggctcaaaacctattaccattctttccaaacaaatgatttccttcaaatcaatatagtagagaggcctaaaggctcaatctccagacctggactaagtaggtttatagttccacctgccatttattagctgtgtgaccttaagaaagttatttgacctctctgtgcttccatttcctcacttataaactatggattattaaagtatctatatttcttagagtatttatgaggatgaaatgagataatacatgtaaagaaatttggggcctgacacacagtaattatttgaaatattcatcattgttataactacccagatgagctaaattcagctcatccagaatgcccaaaaaaccattttgtaaagtatgctgggcctacagagaaaaatatcagatattagcatataaaaaattttttttgcagccaggcacagtggctcacacctgtaatcccagcactttgggaggccgaggcaggcggattgcctgagctcaggagttcacgaccagcctgggcaacacgatgaaaccccatctctactaaaatacaaaaaattagctgggcgtggcagcgtgtgcctgtactcccatctactcgggaggttgaggcaggagaattgcttgaacccaggagatggaggttacaatgagccaagattgtgccactgcactgtagccggggcgagtgagactctgtctcaaaaaaaaaaaaaaaaaaaaaaacaaaatttccctcttcttcattcatttgatctattatgttgtgcaaaagggaaacaaccaacaaacttctacaccaaaaaggcatccatacctctgtgctatttatcagttgcctcatgctattataaaatctgtaattcatccagcggtggtggctcacacctgtaatcccagcgttttcagaggctgaagggggtggatcacttgaggtcaggagttcgagaccagcctggccaacatgacaaaaccccatctctaccaaaaatacaaaaattagctggatatggtggtgcatgcctgtaatcccagctactcaggaggctgaggcaggagaatcgcttgaaccaggaggcagaggttgcagtgagccgagatggcaccactgcactccagcctgggtgacacacagagcgagactctgtatcaaaaaaaaaaaaaaaatctgtaactctactgtcccttccacctcagcaaagccttgagtgtgtattcaactcaaatatatatatacttgtgtgtatattttcccaaaggcttcaaataggaaaggaagatctgaagcaaaactgattcactatcaaattcatcaaggctggacagggccattgaactcactcctttcccataaagtgccttcttcagttgtgtttttcagtctgacccaggcatcaatgaaggcagaaagcccagcctcaaacccacaaggtgagactagacatcttgtcatcaaaacagcatgttttccatcaagccgcttctctccctctttctctctctctttttttttgggaggtgggggtgggggggtgcatttctactacttttcgatgagattttaagtcaattccattttaatacacaggctaaaaggcaaatagcacttcaataatgagacaaaatgaaactgctgatagacaaaaatagagaatgggcagttgaaattcataaactggcattcaaaaaacaacaacaacaaaaaaggcctagcaactttctttcaagatatttatagccaggggaagtggctcacgcctgtaatcccagcactttgggaggctgaggccaggagatcgagaccagcctggctaacatggtgaaaccttgtctctactaaaaatacaaaaaattagccaggcatggtggcacacgcctgtagtcccagctactcggaaggctgaggcaggagaatcgcttgaacccaggagacagaggttgcagtgagccgagatcacaccagtgcactccagcctgggcaacagagggagactccatctcaaaaaaaaaaaaaaaaaaagatacttgcaatgagaggaacattctactttccaatccataaaccagtttctgccagctgactctcgcttagtctacgtctgcacacaaccccagatctgagtctattggagtcttaagggagatctggtttcttcagtataacacagaggtgaagagcatagatgtaaaatctgaatgtaaaatctggctcttccactttccagctacatgacactacgcaagttacctaatctctccatatctcatttcatcatttataaaatgccaaattaattctacctccaagttgtgattaagtgagctcattaaataagaatatccttattcatttttatattctttaattgtttagcccagtgcctggatatagtgcccactcaatagatgatcattactatcactctcatctgtatgtgcaattcaacagccaaaaccaagcagctaatcacttttcgagtcaatgcttttcttgctgagacctgccagtttccagaactggtccaacaaattagttttatgtagctcattacagaatagacacaatggaaattataataaaatagagcaaattaagcttccaaatttactaagtaacccctcacagtaaacacactaagatggtggtgtgggagatccgatactcttagttaagcaacaatgttccaagtcatttgcatcttttcatctccaatctcatttggcctccaggaagctcagtgtatttctctactttttaaaaagttagtaatcccagcactttgggagaccaaggtaggcggatcacctgaggtcaggagttcaagaccagcatggccaaaatggtgaaaccctgtctctattaaaaatacaaatattatccacgtgtagtggcaggcatctgcagtcccagctacttgggaggctgaggcacgagaattgcttgaacccaagaggaggaggttgcagtgagccgagatcaggccattgcactccagcctgggtgacagagcaagactctgtctccacaaaaaaaaaaaaaaaaaaaaaaaaaaaaggttacatattgaaatatgtgaaataggcaaaactaaatacctcccaagcagcctatgtcaagagtgtcacctcaatctagaagatctatttatttgctaataaaggacaaaaatgctttcttgaaatccttattcagggacaaaaatgtaaatacaggtcaggcacagtggcacatacctgtaataccagcatgctaggaggccaagaagagaggatcacttgaggtcaggagtttgaaaccagcctgagcaacataggaaaccctatctctacaaaaaataaaacattagctgggcatggtggcacacgcctgtagtcccaactagttaggaggctgaggtgggaggatcgcttaagcccaggaggtagagcctacagtaagccatgattatgcctctgcactccagcctgggtaacagagtgaaacttcatctcaactaaagagactgggacaaaatatatccaaaaatatataacaaatatgcaatttatattatgcaacttacctgcagtggctaaacaggagctcatcagggcaaagatggcaatcacataatgggaagtcatttttatttctccaacagtgcgtctcgtccagtcacttcagcctgctcagagcacagacaatctttgcaaatcagaagtagtcttaaagtccctccttgcaattttcaaactgcctgtaaaacaaatttcaataagaaaacttaatgaagaaacttcataaacaaacagacactaaaattaaacagagaatttctgaaaagcgtaatgtaagaaatttatcttaaaagatgcaaaatagcactcaagcaaactagactgagggcagtgactatctaataaagatttttatagcaaatacttttgcaaatgacatatttgttattggctttttttttttttttttgagatagagtctctctctgtcgccaagctggagcacagtggcgcagtcttggctcactgcaacctccgcctcctgggttcaagcgattctcctgcctcagcctcccaagtagctgggattacagacatgcgccactacgcctggctaatttttgtatttttagtagagatggggtttcaccatgttggccaggctggtcttgaactcctgacctcgtgatctgcccacctcagcctcccaaagtgctgggattacaggcgtgagccaccacgcccggccctgtttttgacattttaaatctttggttttatagagaattttcagaactacagaagaaaatcaaggtgcacctgaaatataacaccaccagttaagttgtggtaccaaagtaatcaatgacacttgatacatgcaaccctagtgccagcaagaaaacaaaaccagcactgattagagactcaatctaatgttataataacagggttatcacaaggatcaaattaagttgtgctaggaatcaatctgaaaaaaataaagaaacataaaaaggcaaggttcttatttcaactgtttgccaacattttaacaggaaaaaagtcttccctgtctctcagcccatctgagactatctggttactggactcaaggatctagaaggttctttctaagcttttcctatccagagtcttcaatgagagttttgtggtggtttgcctaacttgaatattcctcacacggccctaatggtcactgatttagacactccaaagtatatttctccagccctctatccctgagcctggcacaactcacagaagttcaattaacaaacatgtactgagcatttactatgctccaggcatggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatggctctttgcaattgtaactttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaatccactctgccccttaccaaatggtaatgttaggcagcttactcttcttgaatgaacatatcctgtggtaggaaatgtatggtaggctgttgtgaggattcagttagttaatatacatacacaatgcttagaacagtccctagcacgtaacaaccaaccaaataaatgttagctacaattactgtactgtatcactacttgtccattctctttgagctatttataccaataaagtggagaaattaagatatagctatttatgtaattcttagctactgtaaatccagttcaatcttttgtttactgaaaaataaacattacaacagtcaaaaggagataagctaaagagtggactcactaaaagaacaaaattaccagtcaagttgaggcataagtcatcaatgacacaacggtcttgtctcaaaagctgactaaattatagagataatttgggagccattaaactgacttattatccctctaagtcgaacatttctgtcaccataattccacatcaactctgatcatatggaaatcttctccgttaacttaaaaattcaaccaccacaaagaggatctgtctctatttttttcccttcgaaatattagattccctaaattagtgaattggttcacaagaactatagtgcctcctgcctatataataattttgataaggaaaaacctctctgaaacaatatgctatttcagcaaatgttaaagacaacttttataaagcaaatccctgtaaggagatctcagaagaagatgacttcccagaggattttatgaagcacataaactgtaagcggcacgaggcttgtgggaatatttaatgagcttgcgtcaccctgcccacagctgcagtgggtctgagggtctgtgctgcgttaatccaggggcttaagccaggtctgaacaaacctgtggaaaagaaaggcaaatggttccattaaaaatataggctgcaaattgctgacaagaatattgggcaattattaaaatgcagcaattacagatataatagagccaagctaaacagtttgatgcccaaaggcaaaccacagcaagtttacaccggatcttaaaacatctctgaggaagtcctggacaagttgaaactacacactgctgtttgtaacaaaaagggagcttttcttcttttagcttaaaagtctctccataatgtaactgttcaaaaagaaaataaactgcagaaggtttttgtctaatctccccagtgtggtgaaagattcccaaggcagaggagaagcaaaagggaagtgtgtcattctcattcagctgaactccagttttggccacaacttgtacacctcagtgccttaacacccgacttaggaatcagttccctggaatgctggatggactgaaggcttccgaaaagttgtagctttgataaaactaacgaaatacaaactcctctttcttctgtgaggttctaccacactgactgcaaacatcagggactcccaatcctgactttttgacctcaaagaatctctggactttatgaactaaatgctttctttagaaatatgggttctggctgggcacagtggctcatgcctgtaatcccagcactttgggaggccgagctgggcagaacacctgaggtcaggagttcaagaccagcctggccaacctggcgaaactccagctcaaccaaaaatacaaaagttagccaggcgtggtggtacgtgcctgtaatcccagctactcgggaggctgaggcaggagaatcacttgaacccaggagagggaaattgcaatgagccgagattatgccactgcactccagcctggacaacagagtgagactccatctcaaaaaaaaaaaaaaaaagaaaaaaagaaagaaagaaatataggttctgtctatggagtagccattcctttattcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactttgatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccactgcactccagcctgggtgacagagcgagactacgtctcccaaaaaaaaaaaaaaaaagaaaattcttagaacttaatgggtttaaaaaaaaagcaaacaaatgtgctgctaattctgctaatttcagagatcccctgggtttatttctgagtccattaaactgagcatactgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaaccagtaagaaaaaattagtagcttccccttagatggctaacatggcctggctacatccatgagttgattcagaatcagaactaaactaatccccatcttcagatagatttggcacaatgagagaaaaagtcctagatttggataagaaatcttcggaatcacatccaagcacaactgatattcaataaatattactgctatatgccaggcactgttcaagatgccagggatatagcaatgaaaaaaagacgccaaaaatcctgccctcagggagcttatatccgagtaaaaatatcatttactacttctcacaagacatttaatttcctgagtttctcctttcaacaaatctttattgcttactctgctaagcagtggccaaggagacatgttttttgcccttgtgggcttaaaagctggtgagataaacagacaataatcacaaacatgtaactacacgatataatcagagctctaaaggaaaagtatacgcaacctgaggataagcgaagattttaaaagtcaggtgatgaatgacactgcaggcagaggaagcattacaggagggaggagagctgcagagctgaaagggaaagagaagaggaataagttcaaggaggggtttaaacagggaatagcgtgatcagatgggattactaaagatttccctcacgctgtacagagaacagactgaagggaggccagactgcctggacaatcagttgagattctcacagcatgtcagacaagaaaggatggaggtttagatcagaatggagcctcagtttcctcctttgtaaagagtgtaacagacaaaacttagctacatcacagagttgttgcaagaatcaaatgagattgtgcatgtatagtattaaaactatcatttatcattagcaagctgtttctaccaaagagatttattatcctgaggtatcagattaattagtcccaacattctgtggctgccagtggcaggaaaagaaaggaggaagattactctggaaccacctgtactggtaggcacgggggaagcagtacgcacagatggtacgaggagagcagagaagcctgactccactctgcctgttctgtgccggctgccttcagaggcaaggtgggctgtccctccagagcaggcccaccctcattcctggctgggagcatgatcaacaaatctggccccagcagccttggtttccttggggccgaacttcagtccgtccttaagagcccttccatctatcccaagcacaacacacctcactcccaaggaaaatacaggaaaaagggagggtgggtgttgacacatttcacaaagttggaaaagaccatgttttattcaaactcacaaactaggatggctttttcacccacccttgcaatactctaagaaccaccttttcacatttaagatttttgcatccaaaggtttctgtaccttttcatttataagggtgtctgcttttaagctagaattaataaagaactgtatttgggggttcaaaacctggcttacccagctgtgttacattggaaaagtcatttagcccctaccacgccctcatctgtaaaatggtagcaatattttgattataatataagacagaatataggcatggtacctaaaacaatacctggcccacacagtctattttattttattctttcttttttgagatggagtctcactctgccacccaggctggagtgcagtggcacgatgtcagctcactgcaacctctgcctttgggttcaagcaattctcttgtctcagcctcccaaatagccaggattacaggcatgtgccaccacgcctggctaatttttgtatttttagtagagacagggtttcgccatgttggcccagctggtctcgagctcctgacctcaggtgatcaacccacctcagcctcacaatgtgctgggattacaggtgtgaaccactgtgctcggccccacactgtctattttaaataaataatagtcattggtatttttatggttaaaatatacctagacttccaaaaagaaaataagcaaactactagtagcaaggcaacagaaatagttgtttatagcaaattttgtattatttttgagattagactttatcatctagaatttcaaaaattccctccatcacaaaaaaatgattccaaattccatacaaggtatgggttctaaagatactcataatgtagcaaaactgtccaaatggtggtgaagccattgcctcaacatttctggtataagttacagggatctggctgcagggcccttctcgattctatttgatgattcccaattagctgcaggggttcagctgggggctgtggaacttggtctggcactgccaccaaaccaaccaagctacctagaatgaggaatcagctgtcatcaaaaaggtttaaatcataaagctgtaattattcgagcaaaattcagcatatcagaatattctcaggacaacagtcatcctccctcaggccctagcaagcacctggccattgaaaaaagcttttgatagcctggacaacatagtgaaacgctgtctctacaaaaaatttaaaagtgcaccaggtgtggtggtttagagcccaggcatgtgaaacactaagaattaaaactcttcaatggttgcccactgccgtccagataaacagcaaaacttcacatggccaccaaccatcgtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcccactgtcttaattccagcaaggcggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatcacatctctacaagaaatacagaattagccaggtgtagtggcacatgcctgtaatctcagctactcgggaggctgaggcaggagaaccgcttgaactcggcaggcagaggttacagtgagctgagatcacgccactgcattccagcctaggcaacagagcgagactccgtctcaaacaaaagaaaaaagaaaaaatagtacagcaggatgataaattagaacatttctcaataacaagagttatgtataagaacctcaggcatcctcaaaggaaaaggaggcaggagtgcgaccatcagcatgttttaccagctcagaccttctgcatcctacttccctcatttctaatatgaagaaattaaacaagaaaatcttttattctatatcatactataattgtcattacatggactaataatcctgaatcccttctagaaaatgagacttcaaacacacttgtggaaatctgaaatgcataattatgtaaaggctagcaggaataacttcacaaaacagaaaagtgttatccaagaaaaatattcaacttggcaacataagaataaacagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaatttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctataccttattccccttcctgtcagaagctgacatctctgctttcttctgaacccacaaaatgtctgttatcatctactgaacacctatcatgtatatcacaatttcccatttaatcttctcaacaatacaaggagacagatgccctttactccattttgtagtgagaaaggtgaggcttcaagatgctaagtaaggctgggtacagtggttcacacctataatcccagcactttgggaggcagaggccaaaggctcccttgaagccaggagttcatgaccagcctgggaaacatagaaaaaataaaaataatttgaatatcaggagtttctgaaaataaataaataaataaatacaaacacaaatattagccaggcatggtggcgcatgccaatagtcctagctacttggaaggctgaggcagggggatcacttgagcccagaagttcaaggctgcaagtgagctacaatggcaccactgcactccagcctgggcaacagagtgggactctgctctgtcaccaaaaaaaaaaaaaagatgctaagcaaccccaagtcaccagcttataaatcctggcaccaggacttaaacctaggtctgtctaattccacgcccatgctcttaactactacaaacaagagatcctccagaaacagctgactttcaaaaaaaagatagggactgtgcctattactaagccactgtagacatcaaccaggccctgcatggacactcactttctggtggtgggtagtctgatgagatctggcacaagggacaaattattttgttctgaaaccagggtggcaggccttgatcagcagttttagtttacttcattcattcactcaacaaacatttattagcgcctaccctgtcctgggcactgttcagggaggtgggcacatagcagcaaattaaacacactcctgttttcacataggttaccttctaaaggtggggacagacaagacaacaaataaataatatgtcaaggcatgagaagacctaggaaaggaaaataaagcaggttaaggagagagagtgatgacaggagggatgctattttagacagggtggtcagagagggcctcccagacaaggtaacatttaagcacagaggtaagagataaagctatgacaatatctaaaggaaaaacctcccaggcagtgggaatagtgagtgcaaaggtcctgaggtaagagcatgcttggtttgtcctagaagcagactacagtacagcatagtggaaagtgcggggcccccatagcctacctgagttcaaatcccccacctgccttttctaagcaatataattttgggcaacttacttaaagctccatgcctgatctataaagtagagataatgattctacctccttcatgggattgttatgatgactaactaaattaataaataaagcacttacttcctagtatgttgttagaattcaggaaatggtagctttgattatttttaactactcactgataactcagctccattctagacaatttattttcaatgtgatacctttgaatcccagggtgaatgacactgcaggctttgtacatggccaatagcttcctcctaagcctttgcctttcttggctgggcttcctatccctgtaggaaccatgccgatgttatctcaataagagcaggaggcaaattcctctaactttactattacactaatacaaattatgtacttcattccacataatccctacccataagagtctgacacttcttcagagctgaatttattgccctgaggatttacggtattggtttcacaagatggggtcctgccaatcctgacttcccactagcatcatcagcagaagcaagcagaaatttcagggacaaccccttatcttgagaagggttaaaacttcacttcgaaagatggtaatttaattttaaagaatccgttctccaatgtcctttttgcctaaaattaagatttctcttcaaagaaattacaacatcaaagcaaaactcaagagtcatctggcctaaaagtctcaagactgagcacagcccccaagcaaggcagctctggaagggactgtgtaaccagacaaggggatgggcacagaaacaaggcaagatgtcagggctgcaaggaaattctgccctgtttccccctgccctcttccctagctcttttctttaacgttgtgtttgcttttcatctttgtagcctgctgggttaaagggcaaaccacaggcagagagaaaccgcagcaagcccatgcctgttagaggtaaaatgggagtcttcccaaaccacttgtaaggatggggggacccacaggtgctgctttgagtcagacatgaaaacgaggtcagtgttctagtccaacgagtcttaaatgaggctttttaaaaatcagattctccttccccgagattgatggttttccctttttttgacggggtggtgggagggggggatagggtttcactctgtcactcaggctggtgtgcagtggcatgatcatagctcactgcagcctcgaactccttggctcaagctattctcccacctcaactacagtccctttaagcagggactacaggtgtgccccaccacacccagctgactttttaagatttttttatggagatggggtctcactatgttatccaggctaatcttgaattctttgcctcatataatcctcctgcctcagcctcctaaagcactgggattataggggtaagccatcacacctggccaattttcccttcttttttttttttttttttttgagatggagtctcactgtttcccaggctgtagtgcagtggcactatctcagatcactgcaacctctccctcccaggtttaagcaattctcctgcctctgcctcccaagtagctgggattacaggtgcctgccaccacgcccagctaatttttgtatttttttttagtaaagatggggctttaccatgttggccaggctgctctcaaactcctgtcctcaagtgacaggagtcctcgagactcctgtcctcggcctccaaaagtgttgggattataggcctgagccaacacgcctggcccaattttccctttttaatgccctgagtgcacctataactggggctataagaaatccataaaatgggctgagcgctgtggctaacgcctgtaatcccagcactttgggaggccaaggcgggtggatcacttgagatcagaaattcaagaccaggctggccaacatggtgaaactccgtctctaccaaaaatacaaaaaaaattggctgggcctgatggcatgtgcctgtaatcccagctacttgggaggatgaggcaggagaatggcttgaacccgggaggcagaggttgcagtgagccaagattgtgccactgcactctagcctgggtgacagagtgagaccctgccacaaaaaaaaaaaaaagaaatccataaaatgcttcttattcatttaataatgtttatcaagtgcctgcttcatgccaggactgttccaggtgtgggtattcaacagagaacaaaacataaaaatccctgccctgatggagctttcattctagctaaaggagacagactataaacaagatacataattatatattatatagagaccaatgctaagaaaacaaagcagaaaagggagagacaaagtatgtgtgtggggttttggtttggtttgtctgttttgagtaaggacctaacagaagcgaattctgtagctatttggggaaaaacattccaagcaaaggaaacagcacatgcaaaggccctgagacagagcgtatctggcgtgctcagggaccaacagtcaggtgcggcagctggagcagattgagcagcctagagagcacaagagggaagtcaactgggtcaccagcataagagtggtgggctggttgggcagggctttgcagatcactgtaagaattctggcttttattctgagaaagacaagaataaacagtagagtggttttttggttttttggtcactctgtcaccagactggagtgcagtggtgcaatctcagctcactgcaacctccgtctcctgggttcaagcgattctcctgccttagcctcccgagtagctgggattacaggcgcccaccaccatgccaggctaattttttttttagtagagacggggtttcaccatgctggccaggctggtctcaaactcctgactttgtgatccgcctgcctcagcctcccaaagtgctgggattacaggcgtgagccactgcgcccagcctagagtgttttaagcaagggaatgaaggaatctgacttaggttttatcacaatcattctggctattgggtgggaactaggctgcagaggggcaagaagagaaacactgctctctggttgttctcatctttagagaaacttaaggaagattattctaagccccactgtaaccctaaactctatgattctgagttgattttctgtgtcttttctatagctataatttatatcaactgtaagcctgatctttccccaaagccataactgaagtgggctgaaatgaagaattccatttgacaatatatctataaaccaggcccatgctacacacctagaataccaagatggtaagactcaatcctgctctggggaatctgccgaaggaaaaacaacattctcacgaggcagcaagagaagcacctgccaggaggagccacatgaagccccactggaggagctggcagcagtgagagcctggaagagtaagcaggaacccccatagagaaggagggacatgggaaatacagaaggtgacactgtggaggctgtggaccacagagaagtaatatggtggcttttggactgtaacagaaaaatctacagaacaaccagatggcactgtccgataggctgttggaaatatgggtgtgaaaaaacagggagctgctgatattgaagcacagaaatatgagcaactcaatgtagactgaaaagacaagaaaaagaaaagaagaggggagaggagaggaggaaaggaaaatgcaaccttggaaaatgtcaacccatagggatcaagcattgaaaaggaagactgggctgggcactgtggctcacgtctatattcccagcattttgggaggctgaggcaggcagatcacctgaggtcaggagttcaagaccagcctggccaacatggcaaaaccttgtctctactaaaaatagaaaaattagctgggcatggtggcgcacacctgtaatcccagctactcgggcggggggggggggtgggagtgtgcagctgagggaggagaattgcttgaacccaggaggcggagactgcagtgagccaacgtcgtgccaatgcactccagcctgggcaacagagtgagactccgtctcaaaaaaaaaaaaaaaaaaagaaagaaaaagaaacaaaatggaagactgaagagacatccggaacataagaggaaaaccaggagaactcgtttcagggaaaccaagaaaaaaaatgggggaaaaaggatagtaaagcagcaaatgcaactttgcactccgtacttcacacctcttctagcacctcatgggggtgtggtgggggtgtggtgggcgtgggagccagcagcaggcagaagagtaaatgggaggtgagaagaaaagcaccaagagctaaaacacattagcctcagtgacaagactaagagttatcaaagattatgcagcatcaggaaagtcttattcaacactctgtggaggtgtaaggtgtgagaaacaggaactaagacctgccggggctgatcttctggcagtggaaaggagatttcttagttaacacctaggtctcacaggaccactaatcctgaaactagcagtaggcatcccgaaaggctagttgcttctgacaagtgctgaggacaatatattcacccacacatcatccaaatgctaggcttcgcacctccatacctttcccacactaacatccctagttttctcctccagcagaataatgctaggcagcagggactacatttcagttcaaagcatggtaaaaaaattcatataacaaaaaccatagcaccactaccaggtatgatgctgtgagcccataacctgggaccattcaggcaggaaaaggctttaccaaaaacacaagctgggtcccggaacactggacccaaaccctttcatgtcagcaaaaactgcctaaatgctcttctatttgctctctgagaaacaaaaagaagccgaaggaggaaaaggcctttaatcctaaaattattcttaatttccaatacagagcatttgagaaaaatctgaaagccaacagaaaaactagcagattctttaaaatgtgtgtctacagtcctttctcctttaccctctgcaaaaaaaaaagcaacccaactcccaaatgatcatttttcttggcttaatttcactattttttgtgatacataattggaaacagactgctttttcctggctttagagaacaggatcttcagggttataagagttgccaactacagaacctcaaccttagcaaaatttttttgcaaacctcttacctatctacctacttgaaatacatattaactccaaagaaaacacgtaaatcccctattattatgcaaaagtggattttctcccaacaaattagacactcctctccttttcctagcctacccattgaaatcctgctctgtgttcagctatgtcccattcaaacatgaccaaaagccctaaccagcatggtatctagatgggatactttttggaagcattttcttttttcttcatattttctttttttgtgtgtgtggtgggggtagggacaaggtctcactctgtcacccaggctggagtgcagtggtatgatcatgactcactgcagcctcgacctcctggctcaagccatcctcctgcctcagcctcctgagaagctgggactacaggcacacaccaccatgcctggctaatttttaactgacattttcaggaatttagtagaattggttctacaggaaagctccttatttagcccacacagtgaatgaaattaaaacctggaacgtcttagagaacaaccactctaacaatgaaataaagatgccacaaattgaaaaaagatataaatatggaaaaatgtgaaatgcaacaagtaggtcatccttcccctagctcctgtgtcaaaaacatgatacatccaatggctgtacagctattgtaacgaataatgagtatgacagcttaaaagctcaaagacaagtgtctttacaaaatgggctgttggcataagtatttttttcaggattcagatgatttatcacgaatacataacaagtagcaatctctctaaagtctcgaaaataagaaaatgaataggaatgtctattcagaaatgctttggctaaaagatagaccagcaataggaaacatgcccatttagatcagaaacttctcccacacacatagggaagaccttacgctgcaatgatgcaaaatgtatgtaatgagtcaatggtgctttccctcaaagttaaatttaatttgccagccaactgcacaaaatctaatataacaaaatgagatacttattctttatggagactcagaagagttttgttttaaagaaaaaaccataaaagagataactcacagcaacacagtgagtatcttacaaaagtactcagggtaccacatgaacacaagcctttgtgattagaatctaagtttttcacctcaaataaccttccagaatgaaaagaaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgatccacaggaaagctcaaggactagtatctgtaaagatcattttctaaagatcatttttcaaggactaatcaacttaaatgtgtttttacaaatgatccatcagcaattttacacaaaaaacctgaccttcggcatataccagagaaatgaattatgtgcctggaaggacagaaaagcaggtgtttcgtcctcctgcaaacaacacccaactccaaaggcccccttcactaggagtccaatgtccagaaagtatacgcttctttataaccattttttaagtaaagatagagctaacatttcagacttaattctaaattatcttggcaacagtttaacattaaagtgggcttgcgggcatggtggctcacgcctgtaatccctgcactttgggaggctgagggggaaagatcacttgaggccagaagttcgagaccagcctggacaacatggcaaaaccctgtctctactaaaaatacaaaaattagccagatgtggtggcccccgcctgtaatcccagttacttgggaggctgaggcacaataatcgcttgaacccaggaggcagaggttgcagtgagccaagatcacaccactgcactccagcctaagcaacagagcaagactctgtctcaaaaaaaaaaataaccattaaaatctaattctaaaaatcaactttgctaggctctacatataactgaatcctcttcccaggatggaagaagatttcaacataaaagaaccaccaccacaaaaaccagacattaggctccctgccctgccccccgacaccaaaaaattatcttcagcagggcacattaggatggcctgaaggcatggttctggggctcttgttctagaccttccattttaaatatggtctctatccctcataagcagttgtcagcctattaagtcttcatctttggcctgaaaaactgaagaataaaaaatgaagaataagttccaaatgacagtagcctcatgcagaatttatatcaatgttgtttcaaaaacacattttggttgagagagcaagacatcaaaatcattattcaagtggggaggaagaatgcttggaaatttgtgctgattcttaagcaaggactttgcaagcagagaaaataaagctcaatgtcagttaacaaacaaatgtgctatttcaaaagatataaaataagaaatctagaaattttatattcctagatttatttattatatttctatatttcctggacagagcccaggaaatgaacccagatccttcttgtaaggcccttccaagctgtgttgatttatttcagcttgactagacactgaacaaattagcaacagcttgtgttttatgacatgctgcaaagaaacaatgctatcattccaagtgttactctgaagatgcagaaccagagaagttactgctatggctcttggtacacttaattttcttcctacagaaatgccctcactcaatctgctgaaggctcactattatgtgtttaaggttagcttttcatataacctagattcactcttaaattccaaattgcttatattcctagtggcaatacaagactgcttttacattaaaggcccctaaaaacatttatctaactcaagttatgcaaatttcaaaaaagttaacattttttaaatttacaattgttttaaataagtttaaaaatatggccgggcgcgatggctcacacctgtaatcccagcacgttgggaggccaagacggcggatcacgaggtcaggagattgagaccatcctagctaacacggtgaaaccctgtctctactaaaaatacaaaaattagctgggcgtggtggcgggcgcctgtagtctcagctactcgggagactgaggcaagagaatggcgtgaaccagggaggcggagcttgcagtgagccgagatcgcgccactgcactccaccctgggtgacagagcgagactccgtcccaaaaaaaataaaaataaaaataaaaatataagaaaaatgctccagtagactgatggaaatggcaataaaatcacttttaagtaactgttaagactgaaaaagaagactgtcctttagtagctaataaatctgacagccaggagcagtggctcatgcctgtaatcccaacaatttgagaagatgaggcaggaggatcacttgagcccaggagttcgagaccagccgaggcaacatagtaagactctgtctcaaaatatatacatattatatattatacaatatatagttatagattatatatatgtgagattttacatatatttacatattttatatgaataagtatataaataaaaataaaaaataaatctgacaattacaatttttatccaacagcaatgaaagcaccacaaaaagatgtttcaaaatgaactatcaagaagggaggtaattcaaaatgaccacagagcagaatcatccaggcaaaatattacagcaaagttattacttacacagtcacagtctaaactctaactgttctgtctgttaagcttaaaatgtaaagtcaggacctttcacagatttttgaagccaggaaattggtcttcacttatatactaaagaagtcagcagtgatcaccttcttaaaactcaaaggacagttgagttccctgggctcttaggctcagattctgccctcagaaaaacaagcactcacctgacttttacaagtcacaaccaagtttgcatgcaagagagaaaaattaattcttttgagtcttaaaaacaatggaacaacactttccttcaagccaacgaaaggctttctgtaagaaagccctaagcaacctgaaggcattttggcccccagtcatcagagcactgaataaggacaattaatttgccaagctccaagaccagaaaccatagcctagtagggagtaggaggttataagtgtttgttgaattactcgagtaaactagagcaaagcatagaagactaaatgagatcctaaataaatgccactctgtagtataagcgcaatgctaagatttaaaaagaagggactcaactaattttgaaagttattttaaaataggatccatgggaccctaacgtagtaaatgaaataaaggtaaatcaatactacataatatggggccgggcacagtcgctcacgcctataatcccagcactttgggaggccgaggcgggtggatcatgaggtcaggagatcaagaccatcggggctaacacagtgaagccccgtctctacgaaaaatataaaaaattagtcgggcgtggtggcatgcacctgtggtccccgctactcgggaggctgaggcaggagaatctcttgaacctgggaggcggaggttgcagtgagccaagatcactccactgcactccagcctggacgacagagcgaaactttgtctcaaaaataaataaataaataaataataaaaaaatactacataatacgcaagaaacaagaaaggaaactggcctacaaaactacagacaaaaattgaaaaccttttttttttttttttttgagacagaacctcgctgtctgccaggctggcgtgcagtggcacgatctcagctcactgaaacctccacctcctgggctcaagggatcctcccacctcagcctctggagtagctgtgattacaggtgtgcaccaccacgctcagcaaattgttgtattttctgtagagatcaggtttcgccatgttggccaggctggtctcgaactcctgacctcaagtgatccacctgcctcggcctcccaacatgctgggattacaggcgtgagccaccacacccagccaaaaactttttttaaaagtcaagtttggccaggcaccgtggctcacgcctgtaatcccagcactttgggaggctgaggtaggcggatcacaaggtcaggagatcgagaccttcctggctaacacggtgaaaccccgtctctactaaaaatacaaaaaaattagccgggcatggtggcgagtgcctgtagttacagctgctggggaggctgaggcaggagaatggcgtgaacctgggaggtggagcttgcagtgagctgagattgcaccactgcactcccgcccgggcgacagagcgagagactccatctcaaaaaataaataaataaatagataaatgtcaagtgtgattttttcaagcatattcttattgtttatgtttacaagtatgagtattcatagacacatcacacttatactagtatcaaatatgatacatctgaactactactatacttgaatattaacgtaagcctctgaggaattcacagtaatagaactgctgttatttaggattactgatcccctattgtcttgcacttagaagatgttaatgaaagatgatgacaggattgtgaacacaccaacctccctgagaacaaattcattatattcagttttctacaaaacacaaatgaggatcattacaaaaggattcacaacaaattcctctggatttccatttctcccaggtaagttgaaatattattcaaaccacacaaaattagtttacatacaaacttcactttttaaagagatgggggtctcactatgttacccaggctggtctcgaactccttggccaagtgatcctcctacctcagcctcccaaagtgttggaattacaggtgtgagccactgtgcctggcctacacaccacttaaggaaacaaattgaaaaaaaactatatgtgtgtttatctatctgtccagccaccatggagttcttgacatatattcaacatacaggccctgtcctcaaggtcattcttaatcagttcaaattaaatctagtcctccattataaactccaaaagcaacttagttattttgctagatattttgccctcccctttcaaactatatgtttaatactctaaaaacgggtttatgcgccttatagatatcaacagtgtgttatgctccccctattgactaatattcaaaataacaatgaactccccacgggttgcctttgaagtgctgggattcaaaactatgttggtgatttttatatttaaaaacatgagctgaatcaacagttgttaggcaaagctgccgtgtaacggtcagattccatcaaaacaggaaaaattaaagttgacaaatgtcaaactgaagggccaaaaaaaaaaaacgctcaagccttgaaacactaaacaatgcagaaataaagccaaaagcaaagaacagcaagaaatagagcaacatcctttaactgacacaatggcatgaaatcaatttcatgttaatagcccttaagggggtaagaattatttccctgcctcctgtgccaaccccaagctgtttcctaaggaagccaagtaatggtgatcaacaatgtctggagaattaataaaagaaattaagaataaagatccatgttggccaggcgtggtggctcacacctgtaatcccagcactttgggaggccgaggcaggtggatcacgaggtcaagaaatcgagaccatcctggccaacatggtgaaacgccgtctctactaaaaatacaaaagttagctgggcgtggtagcgcgcgcctgtagtcccagctactctggaggctgagtcaggagaaactcttgaacccgggaggtggaggttgcagtgagccgagatcgcaccactgcactgcagcctggggacagagcgagactctgtcaccaaaaaaaaaaaaaaatttccatgttaattaatacaagtcagagttctatttataattatttggggccagtttcagaggaactttaattgggcaccctcataagtatgtaaaatcgcctaaattcatcacagataccttatgtgtgtttcaagagatatgcgttcagctcaaatagaaagctgaaagatgggagaagatgcatggactatgcacacaaatctatgtacacacaaatcggcctgcacttgccgctctccgctgaggaaggaaggtagctttggagtcagaactaacagaaagttatgtatgatcttggacaagtaacttaacctctagtgtcttatctgtaaaatagggttattaatagtgcttttcccatagagatgctgtgaggattaagtgcacacagtatgggcttagaaaacgttagctgttattattatccaaaagaaacaactgagttcacactgaagtaactgtttgcactctgcattcaggaagaagaaacggtcttgacgtgtgtttttactacctgtggagacttctcccaaaccgctcacttcttcggaaggacataaaactcagaatacgcctggttccccagcacagcctgtcactcctactatcctctgccctcgccgctcctatcctgccaccgcagggctagcggcaagcagcgctaacctccgtgcggtgcttactcggtgccaagcactgttgtagcacctcacacacattaaatcattagatgctcacagcaactttacggggcaagtactactatcctcacttcacagctagggaaatggaacggttttcttcttccagcttttcgtgaggacaccaaatccactaagttctactttgccaaggtaattcatgcttgacacgtcggctcctgacactatgcgattctgcaaagcggggcaaatgccctaataagatcaagtctgcaagcagattcttctagcgacagtccaagatttccaagtttgtcctaaccaaatgaatacaagaagagagccttcaaaataaaccggggcgggggggggccgagctgcagcttgcggctcagcccgcaaggcaccctgagggcgcggccagcggggaacgcaaaccgcgtccgtgcacgagtccgggagccacagcctgggccacggcaattgactgcgaacccacaacaaaccattcccaccgaagctgtcacgcgcccggagggaagtggccgccgcgccccgcaggggtcagaaggacccgcggagaggaagagtgagggcgggcgtggagaattcctccccagcactgcgcatcgccgggggcactgcctgccccgtgcggccgctgcccacgcaccgctggccaccggtgcctgctccccggagggtaaacaccgccccaccagcgcctccctcccaaggccggaggtcctggcggctggagcgaccctggccggtaagtaggcactggcagcccgcgccgcgccgacgggcacccgcgcagcctgcagagcccacagcccgggcgggctgcagcgccgcggggctgggccggcacgtacctcggaggcggtgtgtccagcggagatccacccgcagcaagttggaggaaagcggcggcaagtttccccgcccagcgctcggcggcggcgagctccggcagctgctgcgccgcggcaaaactacgccatccggacccgctggggactctcacctcctgcagggagctccgggaatcgcgcagggaaagtggccggggcgcgagagccgccgactgccctccttcactcgctgggaagaggaaagtgccgctcggcgtccccgaaaccctcgattacccccatcaggccgacccggcgcactcgccctccctcgcacacacgcgggcggggacgggcaggacgccacagcaatcagcgcgcggggggaagggcgctcctccgccggccccaccgggggctctc

SEQ ID NO: 1428 - DNA, 205938 bp, Homo sapiens; identical to SEQ ID NO: 1427

SEQ ID NO: 1429 - DNA, 205938 bp, Homo sapiens; identical to SEQ ID NO: 1427

SEQ ID NO: 1430 - DNA, 105885 bp, Homo sapiens
gtaaatccaaatacaaaagtgtttagaagtttattaaacattttattacacacctgtattgcctaaagtttctataacaaacatcttacattggaacgattttcttgtttttattttctacaaaaaaaaaagcggggggacattaaaattaagcatagaaatggtggaactttgggatttcctgtccagtcacctgcgagtcaggttttattccaattgattcaacgtggcagattaaatgtgaaaagtaaaatggtgggctcctttaggcagcaagtcttgcttctctcctggttacctctgcctacatagatatttggttaagcaagatgtttatacccccacacatattctagatagttctggtcatgaagtaagtcacaattttccatatctgcacaatttttaaaaaatggaactacccatctgcacaaaatctttgggagtgcagggtaggccaggcagtggaggagaaattgacaccaacttccctgagagcttccaaagtaagaaagcatccctttttcctacgtcaactcctggttgcatgctggaaaatgcagcaagtgaggcacaccaagcatagacgcaaaaatcggaacacaactgtaaggtagccaggctggcaggtgtagggccgaaatggctgcacaccaccacactaaaatgtctgctacagccgcacatttacaatcagtttggtgatatttccaacacaggctgggggattgagtttcccccatataaggcaatgacaaggatttcaaatggaccaaacattttatattagtgtcaacagcactaacacagcttcagctggcggaggagagggaaaccaagaatatccacattatttactccagagaaacttcctgacaccatctgttctctgttaccccccacccaccaatgtggccctttcctagtgcacccttgcctagctctgcgaacccctcagttatgtctcttggcccaagaatttcaaaaccccatgttttcctgaataaagagattcggaaagttcatttcaacagagtgactggtaacacagaagatctcttaatgctgcaaagtattattagttgtccagctgcaaagatgatttgttgtatttacctttattctaggattgaatgtaatgcttttgctatacaatgtggtggctgggggacggtgaggcggaggggacagagggattgagctagattacacagcgtagaaaatcaatgctcttacactctagggtctgagaactggttcagggtcacagaagtgaataagaaagccaactgaactagcaataggaaataggttacacagagcaaagaaaaaacaagtttctgaaacatgtacaaactacatatgatgtctatatttgtgtctagctgatgtgtatacaaacattggcctttctggagataaactgtccccctctgaaaatcagggtaacactattagtaagtcaagaccaaaacaagagccaacagtaatgacagtactatatttgatctatacggcctggaaaagggaattaaaatgagacccttcaagagagaaaaccccaataacttttcattaaaaataaaaatgacccatttatacagaaggagttcaaaatttatttataaatttgtgtaaaagaatataagacctttttcttttgtacatatttgtaccataaagaaagtagggattaaaatctaaaaagacccccaaagctttcaaaacctgatctgagaattagataagaatatgtcacttagaaagacaagcctgtagcacccatagctctgattaacctgaaagcatcaagtgactccctctttttctaccctaccaacatcactctaattatacttccaattagaaaaataatgtagcatttccctggcagtagagattaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccctggaagaaaaagaaaacaaaaattactgcaagcagcaaaataaaattcaaagcctttgtagtcaaaaatgaagttcctgcaaagaacgctcttatgcatcaagctgaaatgaccattttttaaaattaacaacttaaatgaccattgaaacgatttgattttcaagtcacattgcatttgattcacaaaatagtcttggtcaataaggtaatggcttgtcaagtgatgtcttattggctgtgttcttagagatagactaacagaggtgacaaatatacagttcgaaaatgttgtcacccacctacacagttacagcaaggacaggatgaacacatgtggaacagagcaatttaaatggaaatgtctcaagtagggttacgctgtattatacagcagaaaggtgacttctaagaggaccttgatgtagggagatagattggtgagtctccactcctaccatgtgcaaagggtcaagaaacctccatcaagccttctgcagtgctgggccacgctacgtatggaatacacaccattgctgtttcttctaacactttgagaaattaaaatctcaggttgcctcattggtcataggaaatgcttaactgcccctgaagacataggatttagagtttccacagcatcccaaagagcctcacctattgtatcagaggaaatattatttaaagggatgtttttaagtgacccaccttaggtgcctcgaaaaaactaatagagaaccctagaaaaataaaaaaatatattttttacatataaaagcaattattgaagaataaatgtatatgttaagaaatatgagaagactgatttaaattaacaatgattaaaaaataaaaatcaatccacctaacatacacacttattgggggcctactgcttaagtgtctatatgacatttcaagaaaccactgcttctttccatggcttggttttatcataatttctgccttcctccttgtttactctgtctctggctttttactggttccgatatttcctccaagcctctgtgaattgaggcatagctttcctctttcattctttggagaagctcagtcctcatctatcagtctttaaatggtgacatatccttaatttaatagtaattcaaatatattgatataatttaagttgctaattctatatattaattttgtccacttgttatttgcagaacatgtcctaaataaaagtttaatttatggcctctcctcttacttttgtatgatattcttttatgaacagatgttttaaaatttaatgtagatatagttatcttttttgttattgttgtttataccttgggtcttacaaaatcctttctcagctctattttataaacagcctcttttattttctaaaatgtaaaagtcttccttcctacttataagctttaatccagttagaatttttttatgaattatgtcgggacctaatttcatgtaagtactcaattgtccccacagcatttgccagagtctgtttccccccagtgatgtgctctgccccgtctgtcatacaaaaaactaaaaaattcagaaatgttgggtgtgctgggccaactgcataccgcattaaatacacaattaagtccccatatatacttctttatctttaggagtgaattggttactctcagttctttgctttgattccaatttatgtgaatctatagcttatttgagagctcattcctatctattaacaaggtataactctccatttatttattccacagcatctttctacaaaatttaagaattttttttcttttctttttttttttttttttttgagaaagagtctcgctctgtcacccaggctggactgtggtggcgcaatccctgctcaccgcaagctccgcctcccaggttcacgccattctcccgcctcagcctcccaagtagctgggactacaggagcccgccaccacgcccggctaatatttttgtgtttttagtagagacggggtttcatcttgttagccaggatggtctcgatctcctgacctcgtgatccgcccacctcggcctcccaatgtggtgggattacaggcgtgagctaccgctcccggctaattttagaattttttaaaaagggtcattcatatttttggttggatctttttattagattttttatttattcctaatgtgtagaaatgtagtttttacatattgatcttatatctactaacagtgccaagcctttttttcttctaataatttgaatgtaaattcttttggattttctacgtaaataattgtatcatctgtgatttataaaggctttttttcccccttttcaatccttatatcttaacggaaatgtttttaatgtatttttattattattatacagttttgatccctttatgaggcaaagaaatttcccttctattcctagtttcctagaagattttaccacaagtgagtattgtaatttagcaaatgctttttctgtactaattgagatgatcgtatggagtttcttttataatttatgaggtgaattatctcagtaggttttttgttttgtctgcaataagccaagcttgcaattctggaacaaattctatctcatcaggatatgttatgctttttcatatttattctgtcaaaatcttgtgattgttttgaatctatgtttatgagtgatagtctattttttttctatacggtctttgtctaattttaattcaaagtcatgtttacctgcttaatcattttggataatacttccttctttttaatcagaaaaactttctagacatttgaaataatctgttccttgaaagtttaatagaatttggctctaatatgtataggcctggtcttcgtttaatgggaagacagtaagacatagatgttgatagtgtttgtatcattttgcatgcccaccaataatgtgtaaagtacccacttccccacagccttgccaacagagtatattgtcaatattttaggagggttttttttgccaaataattgataagaaatggcattttggtttaattctttttgaagtctgcttggttgtctttcattatctcctattttttcctcattatttcaaatccaatttttatttcatcaaacgttttatacatcgtgattttaaattcagtatctaatcattttagcatgtgaaatcatctggctctaagtctttctattgtgtttgtgatgttgaatcacaaccacttgtttccttgtgtgtgtggtaagttccagttattgttttatgcctgggatacaccactgaacacaacaatccaatggccccacccttgtagaatgtggaacatacatcaccacagggagaggcgaagagtaaacagtcaacaaaacatacaaggaaattatgttttaaaagtatgttagaagttgaagagtgctatagaaaaagggaggggagcctagaaaggggactgcaggagccagggtgagaggacaggcagcagctttaactaggatgccaaggtaatctcactgagaccgtggaattcaagaaagtaaatgaaggaggacaaaccatatggatattttggagaatagtgtagacagagcacccagtgctctcagcaagaaagctggtgtggctagagagaaatgaagaaggagagcagcaggagagccagagggctaagaaggagtctggatcatgcagcacctggtaagctgctggaaggacttcggcttttactccaagtgatttgggggtggcgaaagccattggaggggtatgcagagtcagaatctgacttctgtcagtcttgtatcgagaacagactgtaggtaagtaattgtgggagtaaggaaaccatctaggagactactgcaagcatctggatgagcactgagagaggctggaagcaggataatgatgataagggtggtgagaagctgttggattggatgtattgggaaggaagagtcaagaggatttgttgatggctagctgtgtgggtgtgagagagggattgcaccgttatggaaacaggaaaatgtgcagacagagcactagggtaaaggggatcaaaggttaggttttagacatgttaaggctgaaatgtctattacatatcttggataagtagagatgtgttgggtaggcaactgggtacacaagtctggagtttggaggaaggggtctgggctggaaatagaaacttgggagtcatgaacatatagatagtatctaatttcataagaatgaatgagtatctaatttcataagaaagaatgtattaagtgaacatcagttcagaaagtggtccaaggtagatccctgaggcacttcactgttgaaaggacaggcagatgcaaggaattcagcaaagagggatgaaaacgggttatcactgaggtatatgaaaacccaggagagagtacagtgtcacagaagctaagtaaagaaacagtttcaaagaagagggagtgattcaccatgacaaagaatggcgatcagtcaaaagaggaagattgagaaataatcgttggattttgcaatgtgaacatttttagtgaccatgaaaagaacattctttttgatgggtagattctaaaaccttgtaacagtgggtttaagaaaaaaataaagaaattagagatagcaaggagaggcaccttttgatgttttactctgaaggaggacagagaaacagggcagtagcaagaaggaaatgtgctatcaacagaatttatgttgatttatgttttatgctgatggaagtgttctagtcgagatggaacattcagcaattcagtagagaggagagagtattattagaacaaagtcccccaggaggtggagaagaagataaatcataaagcaaagcaagcacagaagtgcagatgtctggaggtcaacagaggtgaaggtgggagcctgaggaacttcccaggtttctcttgctgcttcttttaagtaaggaaagcactgataacccatttggacttggatatgcccatcctactaaaaatttcacccaatcagcctcactattacatcatgaggaaacaatgctcctctctttgatctgtgaggagtctaagcagagatttatggctcactaaggcctgccaatagtcattggtgagccagattgccacatcctcacatcctcagcagaagcctatgcaatatccatttatgctctcccatcatcttcccctcagtcccagataggtgctttctaagttttaagagcggttccatagagaagaaatgacaaccatacagtgtgtttccaagccctgaccaaaatctaaattccaattgtgtttcacaactaagttatacaagcttggataatgtcttcaactcacaatggcccattttccacatgactcctactcacatactgttacaagacactatgtgtactttgtatcacacaatgcaaagatcctgcgtttcaattattttctctgttccatactgtccctattctgaatgccagagtgtaacaaatgagcatatattacggataaatagacacatccaggcagtgttctctgcaaatttgcttctgttcaattatcttaaatatgtatacatttataaaatccactcatcaatgtaaactactagattactagatgtctttcaaaggtacatgctgtaagatttctaacagattgacttctcaaacatgatcttttgtctgtcaagtatttattaaaggaagatcttctctagattttctaggtcagcaagcacttgattattttgttgtattgtgaccaatttacagatttctatctgatgtgtgtatataaagggagtgagtgagagagagagaaggtagttatacacttgggcttcaattaaactgtaagacctatggtctttagttttgattttgtacacattgcaaacctcacaattatatatgttccaaagctttggtgctcgttcaataatatatcatgcacacaaaatacattaaacacatattgcaacacagttgcaaggttttcatcacagaaataggtaaggacatttcattttttaaaagtgccttttgctatagggtttctaaaaaatcatttcatagtgaaaaattaactactggtttctttgatgtgttagtttgactgaaagaatatattactagagaatgcttattatttttataaccatatttctgaaaaaaaaaaaaaaaaaacgttcatttgtttttttgtaggtctgggcaagggatgataaaaacccttaaagtccaggcaatcatgctgagaacaaagggcaggtgtcattttttactgtgattggccagagctgaaatcaggactttctccctctagcagaagctattgtggaatttacagtaatccccctggctgactgcccatcacactgccaaacagcacaacaacaaaaacgtaatatctggggagaaggccaaaacatatattaaaaattctcattgtttttattcttcaacattgaaagatgatttaagagaaaagaaaaaactcacccagctgttaccgctattcatattccaacagcctccagattgctcgaggccacctggttgacttttgccttggagtcggtccagaaaagcattatttaccctttaaaacaatgaaaaatgtgtgtgagtagaaaacttgctgcagggctgagagatttctgagaatctaatgtgttgtatgaactgaccatggggatagcttcctggcttcagcttagaagaaatccacagaaacttctcttcacactaaccatatgacatgctgttaacccctctttactggagctggtgccaatcttggctcaagccaaaggggatacgaattcttaacctgagagtttcaggcactcatctcctgccagttcagcaagaccctagttcaagaaagaaactacagccctcagaatcatgccaggtatgaacctcagaggctggagagagaaagaagcctcagcatgaaccaaaacatgaagaagaaccaaagatagctctatggcattattgttgcaagatagatgtccttcctatattccctgcactccactgccagtcttgctaaagtaaaccccatacatgaaaagcagaaatggaaggtgagcttatattattctatttctggagcttgctacctggttgttcactttataattaatcactataaatatctgttttgtggacctttctgtgtttcatattacagtttttaaatttaaaataataaatcacaggtaacgtcgtgctctgagttgcccacgtatggctgagtagagtcagggacttggaagctgaagaaatggcactgcaataggtaccctatgacatcaacagattatttaggaagtgcagaaataagactataagcttctgggaagcagaaacacaatgcctggtgcatagcagcaaatatacatttatggaaggaagggaggcaggaaccagtcacatgagcctcttgttcagtcatgaagattagcagaatgtggtcatggtgagtggctacaggccagtgactgtgggagattagggaactttgaggcaaataaaggctgggtagcaaagtgaaaggctggagggggtttctggctgtctgcgcttgctcagtgctagctaagatgccaggcgtgtgtgggctcagttgctgtctctcaacaactttaggtcccatcgggctgcggttccacctcagctattataaagcttctttcctgtcttaccataaaatctacccaagtgccatattctagtcagcctgcttcactgccaagctccatgtttaagtcaccttctctgaatctctcagcatgcagatagaatagtatcctacttcgctggagactcaactatcaagaaaaggaaagtgaccctgctccccagtaaacaacacaaccactggtatcctggactgcctgcatgcctggagctgttcttatccagtctttttgtcattaacaaagatgggctttcactcagcatcctccaccccacacccaaaccgctacaaggcttgtttgctctacctcctgaacacaacctaaattcactcatttctttccatggataccattctagttcaaattactatatcttcaccttgctagtgctttcactcccaccttccgtaatctagtccccatacaacaaccttactagattatgaaagaaatgtcttccttttgcttaaaattctcccacagcttcccattggtcttagaataaaactggcttataaaaggttgtgttatcttgctcctgcctacctttcctcccccactgagtatcattctcttcttcactcactataatcccatcacatggggtgaggtgtggtggctcatgcctgtaatcccagtgctttggaaggctgaggctggtgcatcacttgaggtcgggagaccagcctggccaacctggcaaaacctcatctctactaaaaacacaaaaattagcccggcatggtggtgggcacctatagtcccagctactcaggaggctgaggcaggagaatcgcttgaacctgggaggtggagtttgcagtgagtggagatgatgtcactgcactccagcctgggcgacagagcaaaactctgtctcaaaaaaaaaaaaaaaaaatcccatcacttgggactcaaacagtccaagctcatttgtactttagagcctctgcacttgctcttcccctcttcgtaggccatctaagtccatgcatctgcccctagtctctatgtggctggttcttccttgtccttggatgtcacctctgcagtgaggccttcctaagtaacctatcatctccaatttcttctttaacgtcaccttgtgatattgtcctcacagtacacatcaccatctgaaataacagtgcctttgattgttgacttccatttctctcctccagattataatttccacatggtgaggcaccccttctgccgtgttttgccctattcccggagcctaggacacagcctttatggagtgtagcctgataatgtagttactgaatgaaacaaatcttcctggcacacgttcttcacccctgaaaacaacatggatgatgagtgcagactgcaaaacagctcactggcaattgctctcaattcactcaaaccctgcgaagactgatgccttgtcatgaagacataaggtaatgtgattcacttttgagcatcagttactaagaggacatcagagtggttgagcactctttgatactataggagtgtcctcaacttgcctatgtccacagcagtgtgagtcaaccagagataatgggtgggaaagagtttgtttctctcaattcctatcaagaatctaaatgggagggaaaagaaccaatttctatttttgtttaatagttttagaaagtacatacatgctactgcagtcaaaattgtgctctgggttttcttctgagggttaatttggataaaaactattattcagggatggttcaagtttgaataaatcaattcagttcatccagttttcacttcatggcccaaatcctttcaagtccttgacccccatgctctgtcgtttctctctggaatttctacttgtcttctcctactcaaatagttacaacgggttaggtgcaggtgcactcaagctcattacaggttcattgaaaagcttgtcaggaatctcagtgctttctattataatactcagagttgagttttctgcaatgtgaacttttaaactgtagaaagcacgttgtccttttgatgccaataaaattgtgcctttggagaaaacctaatttacatcccctacacacacactatatagcttgtgttgttgccttgagtaagaatggacacggctattttattaagagttcattgagtatgtattctcacatgataacatgggaaagctcatggcacactttaaaggcaatacaaacgtaagctcttttcaaaaattgatgaagagcataaaatatatatttaatgacttgatcagatacttcaaaactaattactgagtttattatctagaaaaatctcttcttggattaaatttggagctatacatttattggatctatttaagtagaatcaaaagaaagaaaaaataacgtatagaaattaaacagccccaccaatatttaggtattcagtagtatggaaataaagaatgaaagccaagattcctataacaaaaaagttatcttttccacctctaatcaaatagcttgggtgtttattaggtgcccatcaaagataaatatttcagcaatggagcctattaatgtgacacatcactgtgtttaagatgcttaaagtcttacaattcaattaatcctcagaaatccagagaaataactggctactactagcaatcagtttataaatacaatatcaagtgttttttaaacaggaagtattttaaagagaaaatagggcaggtgcggtggctcactcctgtaatcccagtactttgggaggctgaggcaggcagatcacctgaggtcaggagttcaagaccagcctggccaacacagtgaaaccccgtctccactaaaaatacaaaaattagctgggcatggtggcacgtgcctgtaatcccaactactcaggaggctgaggcaggagagtcacttgaacccgggaggcagagtttgcagtgagccgagatcctgccaccgcactcccacctgggcaaaagagtgagactctgtctcaaaaaaaaaaaaagaaaaaagagagaaaataataaacagcaataaaatggctaaattatggcctactttataataaataagtagttagcatgcttccccaccaccatcttacccaacaatatagcctaaccgacatatcagagttttgatatttccttaaataagagaaaaaacatataattcacatttgtagtttcaaaactattttgactggactctggggacaacatagttcagtcaaataaaagtgagctccccgcccacagttagaggcaccatcagaacagggagcttccactgaatgctttttaaagtctctcatttagaaaatgaaaccaacataacttaaaaatacagtttagtgacagtgggaaggttaaatacgttcaaaaaaagccattcactatcaaaagaatttgtccctttaaattgtgaaaacccttacattcttctccaagatactcaagtacacccctaatgaactcaactcgtgtccccctagaaatcttagcataataatggcatacaatatggtgcttattagcactgtcccaacagtaacatgatattttactaggtattcttaagtctgatattaggattaagatggagagtgcttagactatttgaaaattacttaatggttctaagattttttttctctaatgtgtcaatattaaataatgttagtgagtttttgtctgagcttttgcactcaagtatgggtatctgaccatctatattgatctaagtgttataactaagtctataaatggtagactatcgtctcaaactaggatgttttgtcctacggtaggcaaattaaatataccttaattgaacacacaagaacatgagtcagttttctaatgtgagtttataatgccacctatccaagaaaattgtgcatgcacatatgtacacacgtgtgtacttatatatgtagcagttggcatacctctacatatatcacgtcccaataacagatttaaaggtaacacgcattccaaaaccatattaataatgttatcgtaatgctttcctaaaacactgtacaaactttctaggtaattgatttaaccaaggatgcttattttattagccagttttacctcctgtgttcagtctggtggattttggctctttcttgctcttgctgctgccgtttcagttccagtaattcactctaggaacaataaaagttttaaaatatggttttcaattaacacagttgtacagaagatacccaaatcaattacatatttaaacctcaactggtacaatatttcatttttgaaacttttacttaagtactatttggatgtgaaattattttcttatatacgtaggtagcaaataactgtggcttagtcaaacagaatagctctgtgagtgtaaaattgctagattaaaagccagtgtgcatggtcaagatactagatcaataggtacaacacaaacagaaaaaaatacaatgtaagtcaaactcatctatgtcttacagagaacaacaaatcaaattagttccttcaggaatatcacacaatactatttcttggtatttctctagcatttctttcctgataaattcagagcaacttacaaataaatattggactcaatcttatagtgtaattctgttaataaaacattctccatcctggagagtaagcactcacctattattgattagttacttctaataccagcagaactttgagatctctggaggagatactttgcttcatataaatcacattattataactaaatctttagcttccaacagtctgcttatcttcttggaagaggcaacttaacttccagacctagttactatgtttacagtattataccgaagaaccaatcccaggatttctctaatttccaactgtctaccctaaggcagaataaattttaatcccatttcaaagacaaaaaaaatgcaaagagaagaaaattattaggcccaagtcatataccagtgcctgagtcagagagattttctggtagagaaaatactgtcacgtcttaacacataccaataaaaggttgctattgttgttttaaccccaaacttccttgatgaaaagtatacaaaaaaactcaaagttcaggctgacattttattaactttgttcaaagaccctctaatattccacagtcccccaaaataaaaagacttatttcttatactgtgatattccaaatacattgctcatcaatccctaaagcacattacttaaccctaattcctatataacactaataaggggaaatcattgaataatatttgagtttttgaaatcaatgaataatatttgtccactcaataagcatttgttatacaccttgctgccaagctttatgctcaagtctcactcttgcacaataggatcattttttagtctaccaaatattagtactctttattagtactaccaagtataccaatgtgaaagaagctcctgtcctctccctcgtctccacaatcattttcaattcctgcatgtggtttcataagtaattatcttcttcttaatagtatgcatgtttattcatttcttaatttttttttattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatttcttaatttttaaaaaactgtattatcttttgactacctacaatggaaaaaagattgatgtctctattactaccttcaccccaatcccaacttcctctcatagtacagccccatcgtcattctcttacaacttttttttttttaacattcaatgtggtaggagagggatctagaaatcctgtagctcctcattcaagtttctaattcatcctcctgttttcaactctaggcttcaaaggtaccaggtgcctctgattcctcaacttaaccaacttctctgtcttactgcttctttcagatgagtactggctttccctgctccactaaatcagttaccactgaccatctagttccagatttaaaattttggcttatatctttgctgcagtctactagtctgttcttttgctcttgttggcttatggctttttaaaaaaattcctgtatttttagtggtatatggggagagagtgataaaacataagcaaatgaaatgcttttgatatgcaatgtttaaccagaaaaccttaatattttcaaatacaagttttaccagaattgtattatttgatcctaacaacaattgcaaaggtaggcaggcaaacaaagtattatgtgataaatgaatgagcaatatcatcctcaccttacagataaggaaatgggatcagagacacagttttagtaacttgtcaagagctaaatagcttattagtagcaaaataaagaccagggcttacattttctcgtatctaataatcttctgcaggatgcattcaaaataaatggttggaattaaggatatcctcacggtggctcatcataaagtatacacagtcatgtccagaactacaggacccattcacattcaaaagttttagcagaatatatataacctaagcacaaatctaaatccttcttgccaaaggatgctgattattttcactttcattaatcctatttctccaaggagcaacttctggtatctggcccattgtgagtttaatacaatgcattctgaacaaactaactctcattagttctggagtatgacacaaagacaaaaaaagtataaaatacatacatatatatatatgcatactatgacatgttactttaaaatttttaagataattttttcagacttggcaaaatgatcatgcaacttgtctgagaaaaaaaatacaatcacagccatacaaaaatactggaaaagaaaacaaaaaatgagaaagaaccagcttcatcaaacattgaaagatatcatatgagaacacatggatggggacaacacacactggggcctgttggagtggaggatgcagggggagggagagctaatggatgctgggcttattacctaggtactgggttgatctgtgcagcaaaccaccatggcacatgtttacctatgtaacaaacctgcacatcctgtacatgaatccctgagcttaaaagttgaagaaaataaaactatagtaattaaaacaatttgagtctaggaagagacatgatacatatggaaatgtagtttaccataaggttgtgctaaaccaatgcaggtgacagagtttcatgaatgatgatggactagccgactactgtaagaaagatcaaaactagacccttaatttcgattaaataaattttatagaagtctaagatttgagcctagaagatgggaatagaagttttcaaaggtggcacaggtgaatttatttataaacttggagtgaggaagttccagaagttagaaaaagaaaaagattaataaatttagctgcatgaaaattcaaacttttcatttggaaaaaataccataaaattaaaaaattaactgttaatgaatgtttaggatatgcataggctaattcaattttcatttattcattcattaaatatctgagtgtctattatgagccaggcttgcatctacatgataggctatagtagtgaacaagatagatgagatctttgctcctttagagtttatattctagagaaaggaaacccataaacaagtgagaaaaatatccaacaataatcccaggcagaggattaaaacacactgatgtgagattcagtggttcagtgactattttaggctgagactcaggaaatgtcccagaaagtgggtaaggacttcacataaaccaataaggaaaaaacaaccaaaaagaaaaagggccaagggataggaacaggcagttcacagataaactacaggttgcctgtcagttcaaaatggtcattatcttcactcaaaatcaaagaaatattaaaacgatgagataaagtgtttctattgtattgacgaaaatcagaaaagtttgacagaaaacactctggtatagcatctaaattagtgaaacctaatttagtttttggaagtcaatttagcaataagcatcaaaacgtaagacgtatacatctcttgcagaagtgttcaaagatgtatgtatatgaatattcacagttatattattgaaactgtaaaagttcagggaaacatgttaatgcccaccaacaaaacacttgtaccataagtgagaccatcagcgcaatggaatacaatggaacagttacaaagactaagatggatgttttgtaaggtagagcaggggcctatggagagatctctaagatacattaagtgataaaagataggttcagagccgttttcttaggacgcttctatataaatagaaaatatatacatacattcattttgacttttatatgctgatgtgtatccaaaacatttaatgaaaaactacacaagaaaatgttaactgtaattaacactgggtagcggcgcttgaagtgtgaatgggcaagaaaaggatgctttactatcttacatagtttttgttttttaacttctgaaccatgtgtatatattatttcctcataccatcagtaggaatttattatcagtgtgagaggccatttctgttttcttatgctttcctttatttaaaaatcccaataaatatgtaatttttaacacagagagatataaaagagcgaaacaccacacatgaagctaagaactgttagggaggaagaaaagacgggaagagagcaacatacatcatcctattacggaggcaaggaaaggggagaagagataaagaccaggagggaaacgcggacgggagctgatgaggcatcaccatgcaagaacattgctccagatggccgaagggaaggtgctggcatcgctgcactcaggattattatcctataactagcaaagcatatttactaaggagaggctggtttttcttccgtactaagaaggataatttcagctaattaatttgttctgctgaactgacagccaccgaggatgtgtctgcatgccttataagcatattcttggttcatttactgagatcccacagagaagttcaatatctagagttaagcaaataaaaaataagttgttcttgtttcaaggaccaagctcgggacatgaaaagcatcaaagtgctctaagcaggaggacaatgacatgcaacatctgaggcattgttaaggcctggcctactcaatgcatattgtcacacgccaaccattttccagatacctaggttcatgctaaaggtacagatatcagcacagctccaccctgaaataaatcacagtataatgaggcagacacacccagaaacaactctgacacagggcaaaaagaaatgagttgctaaacacaaaattaagctacatgacatgggaatacaaggaaggaatgcaaacaggagaagggtgttcaacactttgtgtttgtgcacatcttatcactgtgctatgcaaatctctacattcatacagagctgcatacaaacgagggtaggttggtgatatgataaacaaaataccatcctagagattgaaagtatggaacttcctacaaacattggccaagtggtatgtggtaaatgaggacaacactgcaaatagcgccactgcctgtggccacccgatgcagtgctcacccaggagggctgctctgctggggagctgcaggatggcaccaatagctctgcttcgagcccaggtcaataataagaagaggggttgccatttccagcaagaggttgcaaacatcatttctctgggctccaattgtctgatggtgccctgttctacagaagggtcaactatacaacagacaggtgtgtgtaaagctggatgcttaagaaatgtgacaaggttagagggaaaacatgctccaaagcaaagtttcagtgtggtaattgaagatgaacatggggtcattttaaaaccatgtctgaatcccaacagagcatgttccgacatggttcagcttgactgctttatgtaaacatgaaaatgccatcgcctggcaaaacaaacttctcccaggagagcctgttctctcaacacaacaagaggaaagggatagtggaagcaggagagttgagaccatgaagtcatgaagttcaagaatgccttcctttgaaggtttaatacagaaaagctttcgggggaaggaggagagtttaaagaagtcctggttctccggcatccacagtaatacctttgccttgaaggagaaagatggccttggctatcaagaatggggagaaaaggcagaagctaccacccaaaattttcagagcaccaaccaaatcaaaggaaataaatactaatgggtgaagtagagtttaaaaataacacaagtaatgtacactctccccttactattgtttttaatttttaattttttaattgacagtttgtacatatttataggatacaatttgatattttgatacatatgtatgttgtaaaatgatcaaatcagggcacttagtgtgtccatgatctcatgcatttatcatttatttgtagtgagaatattccaaagcctcttatctagctattttgtaaggtacactatcatcttactgtcaaccacagtcactccactgtataacagaacatcaaaacatattcctcttatctaattgtaactttgtatttgctgttgctagttctatcattttaacagagagagaaataaacttccagctacaacaatcatggaatcacagctctatgtctcccacctaaaaatatttcctacacaaaatgcaaggtagacgtaggtttcaaaacttatctgcactctattttatgatctttgttttcattttcatatatgtgagcatatttctattatgttattaaaatgtggtagtaattgctgcatggtatttattccaaactccaaaaccttcaaatcctgtatcactgaacaaactgtttcaaatttcccattaatcttatgttaaaaataaacaaccttgtacaaatatcttgtctgtatctctcattatttcctcagaataaatgtatacctttagatctaatatttttacttttaggaaactcttcagaatttgatgttgccaaagtgcctctcagtttatcctctcaccagtaatagtacttcagtgtttgtggtatatattgacgtctactagtggaagttctccttaccccaacaaatacacaaattattattcatatttttctaaagtttaaatttcattatttttctctcagttgaaatttagaaacagtattttcaaattacctcaaattccattgaaatttattactagaatttcattaaacttacaagtaaacttggatagaactatagttactgaaatattgagttttagcattcgggaacattagccatctctgctttattcgaattgacttttatgtataataaccaaaacagcgtggtactggcatacaaaccaatggaacagaatagagagtccaaaaatacatccacacatgcagagccaactgatttttggcaaaagggccaagaacataggggaaaggacagtctcctcaataaacagtagtgggaaaactgaatatccacatgcagaaggatgaaattaaacccttttctctcatcacatacaaaaaacaactcaatttgacagttttcacaaaaggcgttaaaaaataatcaactcaaaatggattaaagactttaaatgtaaaacctgaaactaggaaagtactagaagagaatatgggggaagctgggcacagtggttcatgcctgtaatccccaccctttgggaggccgaggcaggcagatcactgcaggctaggagtttgagaccagcctggccaatatggcaaagccccgtctctactgaaaatacaaaaattagccaggcacggtggcacacacctgtaatcccagatacttgggaggctgagtcatgagaattgtttgaatcccaaaggcagaggccgcagtgagccgagatggtgccactgcactccagcctgggtgacagagagactctgttatgaaaaaaaaaaaaaaaaaaaggaaaagaaaatgtagtggaaaagctccatgacattggtctgggcaaggattttttggataagactttaaaaggacaagcaacaaaagcaaaaacagacaaatgagattacatcaaactaaaaagcttctccacatcaaaggaaacaatcagcagactaaagagacaatctacagaatgggagaaaatatctgtaaactatacatctaatagggggtcagtatccaaaacacataaggtactcaaacaactcaatagcaagagaacaaataacctaatttttaaaattagcaaaaagggccaggcgcagtggctcatgcctataatcccagcactttgggaggcctaggcaggtggatcacctgaggtcaggagttcaagatcagcctgatcaacatggtgaaaccctgtctcgactaaaaatacaaaaaaaaaaaaaaaatagctgggtgtggtggtgggcgcctgtaatcccagctactcaggaggctgaggcaggagaatctcttgaaaacaagaggcagagtttgcagtgtgccaagatcatgccattgcactccagcctgggcaacaagagcgaaactccatctcaaaaataataacaatttaaaaaataggcaaaaggcctgtgtagctatttcttgaaagaaaacatgcaaatggccaacaggtatatgaaaaaatgctcaacatgactaaccatcaggaaaatgcaaactaaaaccacgatgagctattatctcacccccattacaaggctatcatcaaaaaggacaaaagataacaagcgatggcaagaatatggagaaaagggaacccttacacgctgcttgtggggggtgtaaattagtacagccattatgaaaagaggtgtaagttctctcaaaaaattaaaaatagaagtaccatatgatccagcaatcccactactgggtgtctatccaaaggaaataaaacaagtatgtcaaagagatatctgcacccccatgtttattgcagtactgttcacaatagccaagatatggaatcaacctaagtgtccatcaatggataaagaaaatgtgggatatacacacaatggaatattattccaccataaaaagaaggaaatcttgtcatttgcaacaacatggatgaacccagaggacattatgttaaatgaaataagccaggcacagaaagacaaataccacatgatatcatttatatatggactttaaaaagctgatctcatagaaatagagtagaatcatggttaccagaggctgggggggttaggaggaaatggtgaagtacagggagatattggtcaaaggatatgtaattacagttagatatagggaataaattcaagagatctattgtacagcaaggttaatgacagttgtaattaatgacaataaataatgatcatttattatattcttgaaaatgcaaagaatgttaagtgctctcaccacaaaaatagtaactgtgaggtaatgcatttgttaattagctagacttagccatttcacaatgtttatatacttcaaaatatcatattgaacattataaacacaaataatgttttctgtcaattaaaattggattttgtggattccaggaaagtttttaattttttttagttgttgaacaattatttatatagctgctttttgattagatctttttgtcccataacgtattttctaattaagttttgcttgtatttgagaaagttgttgattcttgtatatattttttaaccaaatctttttttttttttttttttttggaacagagtttcgctcttgttgcccagggtagggtgcaatggtgcagtcttggcttactgcaacctccggctcctgggttcaagtgatttgcatgcctcagcctcccgagtaactagaattacaggcacctgccaccacacctggctaagttttagtagagatggggtttcaccatgttggccaggctggtctcgaactcctgacctcaggtgatcctcctgcctcggcctcccaaagttctgggattacagaagtgagccaccgcgcctggtccaactctcttattaaactccatttgttctcattatttttcagttgattctcttagtttgcacaggcaaattgctcccatgcataaataacaacctacttccaataattagaaaagctcttttatttttagttttatcaagttggttaaaaaatatccaaaccttgttccattcagtaaaaacagggaatttttttttagttaaaaaaataagttttctatcaaataactttgagtagcatgaggttggaattcccagaataatactgggtaacaaccaagtttggtaggggttgcaaacatccttatgttgttcatagttttagtatttcaccactgaatataatgttggttattggtttagaagactacaagtatgttaagaaaatattatttttagttcactgaagtgttttttaattgatagtaaagattaaaatttatcaatgtctttttgtgtaactaaagagccaaatattcttgtcacatgacctatcctattgcagtgataagatataaaaagttttaatatatagctacttatctttgcattcctggaataaactctactttcctttggtaaattgctattaagagaaaaatttcatcagctagaattttccttcagatgttaatctctgtctttataagattggtctatctgtgagagagagagggagggagagagagagagtgtgtgtgtgtgtgtgtgtgcgcgcgcacgcgcgcacacgtgtgtgagtgtgcacatgcttcctttatcagattgtgacatcatggggatagtgaaataaacttctaaaatgtttcatcttttttcttactctgaaataatttgtaaagcatagggaaaaaaaatctgttccttgaaaatttgaaggaacttgcttctaaaattatccaagttcagcctcctgggggaagtaattctcagaaaacttcagaaatcacttgcattttcattggtctttatgagttttaattatgtgagtcattagagttatatattttcctagaaaatcattcacttaatccaaatttttaattcattagcatagcattgtttatagtaacataattttaaacttttccaaatctatggttctagtccctcatttctaatgccgtgtatttgcatttttactaatctcttcttgattagacttaccaaagatgtgtgcatttgttgaccttatcaaagaacaagctgttagatttttataacagctgtttcttagagttttattattaatttctgttcttatcttaattactttcttcaggatcatttattgtttttgttctaaattcgtagatcagatgcttaattcatttctttttttagtattgaatggattaaaatgttgtaattttgagtacagctttacatgacttccctataaaagtctctcactataattttgtatgtgttctataataataattttctctgtcacccaatagtttattttctgactttcagtattttactgattcttgtatatattttgactgtaaaatcaatgactttctaaatgactataaaaccaataaccatgcacaatcaataaatgcaatcagcttatcacatattttaagaagtttctgaaagagagaaaggagacaggttacattaccagggaaaaccaatgtgcaggataaattggagctaagtccacctgcttctgaaggagctccaggagggaatactgggacagtcatttagatgatcagttagaaaactgcactaagagcagcttggtggtgggttcttttccctcccacacttgcactacatagtaggcagcactatcatggcccataaggtaagaagtgaatgagagaggcatggctgggctcagggaaacagggcaacgtcccaagtacctactgactataagagaacacgagtctactccacacagaagacaagctcctacatacctcattcagcagcatatccaaatacatataagaataatcaaacatttgagaaagaattccatgggagataaagattaaaatggaaagaaaaaaacagttaatatggtaaatagaaaacttatgtttgtatagttacaaatatacaaacattaaataagatgagatgagaaagaatattgcacttacaaagcagaacactgctacttaccaaatcagcaatcttggtaaataaacatattcaatatgtgccaaataagcagaatgaaaagtcaagaaaaaatttagtgagcaggatgatctagctaaagctttcatccagaatccaattaaaaaaaaaaggccaaagggataagaagtacaagaaaacaatgaagttatatacagaacagatctgaaatgtccaaagtccatttgatagatgtcccagaaatggagagcaaagacaataagggtaaagagacataaaagaaaattaggaagaaaaaaggaaaagtgaagagagacatgtattttcagattaaaagagacaaccaaaggctatgcaagattagaaacaaaaatagaaacactgtgaaatttcttatagtacaggaagggggagtggagagaagaaaaaaaacagtaaataaataaaacagagaattcagtgtcagtaaaaaaaaagaaaactaataaaaagtaaatcatgcagtaagaatacaaatacatgcaaatatgctactaatcataataaatgagaacacatcaaatctacccattaagagattctgaaactaggtaaaaggaaaaccagacatttctttccactcaaaatctactttaaacaatgacacagagatgttaaaattaaatgattaaagaaatgtcatgtaaatactaaccaaaaaaaactggtagaggaattactagaatcagacaagatagtcaaaaaagaaatcaagctaaaaaatcattaaatacaaaaagtagtatacttcatattgataaaatctatcctaaaatgtaggcttcccttagtctcattggtcaaaactgtatcacatgtccacagagaaaccaatcacagtcaaggagaatggaattctcatgaagagttagaccactttgggaataaatccctggagctggggtagcacctgccttttctgaaacacagttcatgcaaagtaggatggatacttgaagaaaaatcagagctgtagagaagcaggcaatcaaaaatatttgacacatcactctgaaattatcacaacgcctaatttatttccttgcagcattagtattatggtttggctctgtgtccccagccaaacctcatgttgaattgtaatccccaatcttggggaagggacatgatgcaaggtgattagattgtggaggcggattgcctccctgctgttctcatgacagtgagttctcaggaaatatggttgtttaaaagtatatagcacatccccctttgctctctctcctgttggccatgtgaagatgtgcttgcttcccctttggcttctaccacgattctaagtttcctgaggcctccccagccatgttttctgtatagcctgtagaactgtgagccaattaaacctcttttctttataaattacccagtctcagatagttatttatagtaatgagataactgactaatacaattagttactacagattactacaaggtgatgaatcactataaaatttaaaagtataatgttgtatttctaagtctccttttaattgtttactcctcccttaaaatgtaaacttctggagagctggaaccttgtctatcctgatcttaattatagcttcatcaacttgcacaaggctcagtatataataggaactcaatacatgtttgccaatagaatgaatgaatgagtgctgggagagattactctgagacagatcaaccagaataatacagttaaaaaaaaaaataaaagccagagaaggaaagctttaaagtggtgttagtgttacagagttcagggagaagataggaattacaaaaagaccaccaaactgtatgttcagaagggattttacatttaggaagcaatttcagtgacagcatttgtgaatataaaccagatcataaggaattaaggatgaggtgggtaataaagaagtggttacagtaaaattacctttgtctttttttaaatttgctagaagcagaaaaggtaatatctctgaggatagcaaaatcaaggaaggggttagctggtttattttagaatggtaagatgagatgagaagttcacgtgtgctctatcatcttcttcatgacctactgtcaccaactgtggcatatttctgacaaaaaaaggaagcatccaatggagaagaatgtattgaagatatagaaaaaagaggaattacaaataagtttctagaagaaggaagtgaatcacaggtaaaatatttagagtttaaacttgaggaggctccttttgtccccagagccaagagtaattaaaaatgtgaaagtcagagagacacatagaacaaaacttatgtgctgtcacctaaacttaacctagattatttacctaagaattattccatagtaggtatccaataaatatttgcggaatgaatggaataaacaaacacataaatggatgcaatgattaaaatgtgttgtgttttgtatctttttacagtaaacatgatcctcctgttttcttaaggtaaatcattcaagtgataaggaatgaaaggttctacaaataaagaaatgcctttggccaggtgcggtggctcatgcctgtaatcccagcactttgggaggccaaggcaggtggatcatttgaggtcaggagttcgagaccagcctggccaacatggtgaaaccccatctctactaaaaatacaaaaattagctgggtgatagtggcatgcacctgtaatcccagctacttgggggctgaggcaggagaatcacttgagcctgggaggcggaggttgcagtgagccaagatcatgccactgcactccaatatgggtgacagagtgagacctggtctcaaaaaaagagaaatgccttcaatgaacgtttcccaacaacaacacgtcaggcaaaaaaagagagaagcaaaagtaaggtagaatagatggataagtatccttgtgtagtctactgttactgaaatccctaaggatggaattatttgtatattaaagctattaattttactgaaagctacagtaagttaaacgaaataatttatgtaaaaggatatataataaaaatatgttcaatcagtaaccagaaaatatgtgtatatcaatatttatctaagtctagaataaaaacaagattaagaaataaaaagtttaattttcactgtttaaaataactgctcaacctgaaaattaaatcccagatctagtatcctaatttgttaagcattctgtttgtcaaatgttctacttttaacagtttttatgttccaaatatatatgtcaaacttttaaaaacactatttaaaatccactagaagttatttaaaaataaatcatatctacaactgactttgcaacattcaccttagtatgctaagtacctcacaattttatgttaagttaaaagctcatagaagcaaatgaacacttttacgtcatttagcagacatcattaaaagtacaacatgactatgtaccagatttagcttctacttgttaactactagaatcttaccataacattgcctatttgattgtagatttcaagattaggatcttgccaagacaaaaagatatttatttaaaaaaaaaaaaaacactaagggataaaaatgtttcatgattcgtctttcttacacaggagctaaataagtaaatttacaactcgcatgatttctttcaatgatttaatgacaacctatggtgcccaaaacagcctagggacacatttataccatatgctgggcgaaactatgaatgagaaaggggttccacactgttgggaagaagatagcactcaaaagggtcaaattatagcaacactaatgaatacaaatagttcatttttcaatggaatttttacacacaattgttgtaataaattaccttgttggggaaagacaaagaaaacataaattaaaccaaatcaaggaaatcaaaatgggagttagaattctagttaattatagaactgaatatacagatttgagaaatgttctataagaaatagtgacaggatttgtcaaccactagtatgacaagaggaaaagttggaaaataataatgatgggaaagataaatcatttagttagctggagccccaccccactcccttttcttctcgtttaaaggatctgaaataaagtggcactttggagctaaccatgggtctttctcatcattctcatttcatgctgagcagcttctggcctattaaaagcaggtatgaacatcaagtatgccactgactattttcagttaccataccagaaatttcacattgtaatgaagattattctttaagcacttttcttagaaggctctgcattcacttcactgatttccattgctcaaaacatatggaatgcctcacatatttttatacccatgtagtgtaacttggttttactgtatgtgtataactatttttagtgaacatttatgccagtttcataactttgcatgcctactttcttatgcattatcacattctctggataccatctctaatttcatatatcttcggtttaaaaatagcagtgatggtggtggtgttttgttttgcagatgagaagttcaccagtgctctatcatcttcttggtgacctactggcaccaactacagcagatccactgtgcatccatgaggctaggtaccatgaaagttttgaccagaaggagccaccaccatactcttaaaacacatccagaaactcaccttttattttcaatgcttgtattcttgttttcaggattttcatgtgtctaaatatttctgttcagaaattcttcaaaattatctagtacctcaaataaacagttagcaataactagtaggggcttgtaagtaccttttgatgttgttcatccttcatcttttgcaattttctgttttcttctgcctttagagaatctctgtaagcccagcttctggcctgtaaaggtacaaagagaaaaaaaaaaaaaaaaacaacttgataggataaagggttgtcacagtacaccaagctgcctactataggcccggtgctaataactcaacctccgtactgagcatatagtaagctctccatacacacttggttattaagtgatttatgcatatgtctgaaaacgtcccttggaacatataaaaagaaaactagtgtaagcacaatcatcctgcacatttgaaaggatgatctaaatgtttaattaagctttaaaaatatcccctcagagataatcaacatagtttattccttctagtggaaagtttaggacattttcaagaatattccgactagctgatcagtcaatattaaagacaagcaatagtggcactgtctttagaagaacgggcatgtctactgctcattaatgatatctgattaagcagcttgtcaactagtggttgataccatataatttcaaggatgcatattttctaagcacttgcatccctaatctggatgaagttttatttctacctctgaaaaggaaaacaaagcctattcaggaacacatgacaacaaagcctttggcaagccagcacatgagggagaatgcccttcggtgtctctgacccaccacaccagagttccacaccctggcatagtgaccatgtgttctgacatttatggcatttcaagtgttctgtttatttgtcatatgctttctctccttcacattgatttgcagccccagcttctgtaaggcaaagagctaatgcttaggaaattacatggatctcataaaaaactatcagcagcttcatggcagcaggttacatatttcagacctagttctcaggactaataatccataaagttcaggtaggctggttccccctttttccagcctacgtgaacttttatgtaacttttctcaagcacttcttagttcattctggcatttctgtcactataaaaacccatatcccatcaaataataagaaccacttcccagaaaaagagagaagctttcaaaatggtatcatctatggcagtgccagttagaaaactggagcttcctgtgttcagaaatccctggtttatccaaaccctgctgcattgggcaggtaaacatacatcatatgactttctcttatttgcatcctaaactcaaggggactgtgctaagacatagaaggggaaaagtgattctctgacaagcctttctttttatctctgacaaccccttctttttatattagagaaggctagcctttatcacaaatattccatataagacctagtgaggaagggaagaagggagggagggaaggagggtgagaagagaggacaggaaggaaggaaaggagagaagaagaaaggaaagaagacagcttctactcaagatattaaaaggtagaataaaatatttagttaaagcaaaattacaacttgaatgagagtatctaaattctatttgaatagcctccctttaaacttgtcattttgttgttcttttattagaatacatgtcttagtttttgactcagaaaaaagtggttattaaataccttattattaaataaggtgccttataaaggtccacagaaactgggaagtcacatggcatccaaacttatgaaaagttcagttacttgcaatcctaatgtttgcttacccagctgtgatccctaggcaggataggaagtttctgttcaaaaataatagaagggaataaattgatcactatttttcttagctctaaacaccagaaatttctaagtcactgtattcacataatttgtctaacattgaaatattcatttaatacaataccaatgctatattttatcattcaaccaaaatacacctttatttatcctccccaaaagctatgcttataatgtactcattctattaacagtgtttaaggctcctctgtgcaagcactgtgtcaggacacgatcccaggcctcaagcatttacagcttagtgtgaaagtcaaacgagaagactaatggttacagtacagcatgataggtgatatgatagaggaagccaaaaagaaggatatttaattaaactagattgaggagactttccaaatcaagtaaggctaagttatatttcaaagagtgagtaggaatcagactataccgggagaagagcatcacatgagcaaatggaaaatagcagtgcatgagtttgctagggcttccataacaaagtattgtgatactggtggcttaaagaacagaaatttactatcttatagttctggaggctagaagtccaaaatcaaggtgtcttcagggttggttccttctgagggctatgtgagaaatatcttttccaggcttctctttttggcctgcagactccatcttcatcatgcatctcttcacatcatctcccttgtatgcatgcttctgtgtcccgatttcccctttttataaagacacttttcataatgaatttgaacccactctaggagcctcattttaacttatttcctctgtaaagatgctatctctgaataaggtcacattctgaggtgctaggggtcagggcttccacataaattttgagaagtgtgggtctcaacccatgacaagcattaagttctcctttcaagatggtggagtaaagatgttcctgttccattctccccaaaattaccctaaacaaagcagaaaatgaaatacacacaagctctatcttccaaaaccaagagatccatattcacagagggaaatctatgaagaccaagtagataaagaaacagtaagtgacttacagaggaaaagagcaaacctgaagacttgctggaaggggctagaggacacctatggggagccagttctctccacagagcaacatgagggcccaagaaatggatgcaccagctattgaggaagacagatggataataggcaggtaaaaaggaaggaattactagatagtctcagtagaagcccttcacccccatatacctgctcctgctttgaaaatgcaggtgctaattcaccaaacaccaacaggaaatgaaaagtgtattttctggataaactaaaccaggcatatgtgtaaagacagcagcagtggacaaatgccaggctgagaatgaaatgactctataaagtcctgcatactgaccagtgagcctctgagtccctctctttgaagtttttttctgcttcctgtactgtttcttctgagaagtaagaagtgatatatatatttttaaagtaacaaagaaaaaaggaggagtttggagacatttttttaaatctccccttcttccccccaaaaaaaccaaatcagtaaaatatttagaagataaagtcaagaaaatatgccaaaatatagaaaaaaggtagtcacagataacttacaggagaaaatctctaaagttagaagataaatccgggaggtctacaatttgaataatagaaattccataaagagaaaatgaaaggatataagtcagagataacacaagaaaatcatctagaactagagatgaatttccagaccgaaaatgaattaaaaaaagactttcacactaaatcacatcattacagaatgccagaaaaagaaaagatgatattaaaatattttcaggggaaacagagaaaatccttcatataaagcctgaaattcaaatggccttggatttctcaggaaccagtattcaaagttagaagagcaatgcctcaaaattctggaggaaaattatttccagtttggaatagtcatcaataaaaatgcaagcaaagtatgagagctgaataaagatagtttcagacatggaaggacctgaacatgtttaccttccatgtgtcttctcttgggaagccactaagtaatatgctccaccaaaacaaagaaataaagcaagaaaatagaagaaatgaggcccagaaatcagagaacccaacatgggaaggcaataaaagcaattcccaagatgactttaaaacagggattctcaaccttggctgcacattagaatggcccggggagcttttttaaaccctgaagcccaggtcacaatacagcaggctctctggaggtgcaacccaggtatctgtgatttttaaagctccctaggtgaatccagtgtgcagaggaggctgagaactactgtgttaaaggaaagtcccagaacaacagctgtgcgccaggcttacaaacacccaggacaggttaaagcaggaggaaagagggatccaggagggagagaaaaaaaaaaatccacaagttatctgacaggcataagttggaaaattgtttagaaatttgcgtcaagaggcattttgtagaacagtcacaaaagctgtcagaagacagtcaaatgttcaaaggaaactaagaaaacgctaaaataaaatgtttaaagagttgtacagaagatataaccagagtataccgactggcttggcagtgagaaaacgtgtatatagtcataatagggaaagctcaaattactgaataattataagaatgagaggaagaaatgagttaataaggtctaaaattgattagtcaagagataccaacacatattaacagatattcggagctaactaagaaaagaaacaggtggtgggttgcataatggccccccaaagacgtcccaatccctggaatctgtgaatgtttctttatgtgacaaaagggactttgcagaaattaaggatctggaagtggagagattagcctggatagtccaggtgggcccattgtaatcaaaagggtcattataagaggaaggcagaaaggtcagggagggtgcagaaggttgggtgagatggaagctaaactggagccatgcagccgtgtgccaagggtttgcggggacaggggacagatgccccccggaagcttcaaaaggaaccattcctgttgataccctcattttagcattttaaaacccatttttattgctgacctccagaagtgttaagagaataaatttttgttctattaggtcactacattcgtggtaatttgttacagcagcaaagggaagtgttcaaatgttgcggtggaagtgggattcaagcggcgcaaagggacacatgttaagtactttatttgacttcttaatgaatgagcatgtgacacgtagataaaaattacaataatcaacctgcactgagtgctcacagtagtgtgagagaggagagctggagaggcatgagctatagagcttggcccctcagacattaacgtgcacacacatcttccatggactgtattaaatacaagctctgattcaggaggtctgcagtggggcctgagattgatctgcatctaaatctttgctcctgatttcaaaagctttgcttccccttaccttgcttgcaaaagctttgcttcccctcacccctttgcagaagcaaagatttagactcgaggccagtcctccagaccccagaggactagaaaggggccattctaaagaaagagacagaatctagaattaaaggagagacggagggacagagagaggaaaggactttgtgcctaagctaagacattttgattttatccttgaagatatgggggaccactgaatgatttggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctgctgcactccagcctgggtgacagagtgagaccctgtctaaaaataaataaataaataaaaaatgggggcagcaaaccagagactagaaaccatttcatatttgactagaaatatgcagcgatggtcgctgaggaaggtctgatgatgctggtacttctgcctacacacacaatacagagaactatattaatccacatgtaaaagtgaaccctgtaaatatctcttgtctgaagtcctaagccaaaaggaattttcttgtaaccactaaaggatttttcttgtaatcttttacattgacataattttctagtatttattaaatccccatctgccaatggcagatccacttttaaaggagaaaagtacaagaggaaaaatcttttcaggaaagttacattaggtagtaaaattaaagtattaaaaattatatataaattcttccagctcatcacatcccatatagatggcaatcacatagtgttcacattctataagttgaccatagctaaagtaaactgcaggtgtcctctttttacaaagaaatgttcttcacagaagtgcaatgtacatatttgattttcctacaccattagaaatgattctgcaaagcattctcagaagaattctatgcatatggatgagacagaatgagaagagtataatatgggtaaaaagtcaattaaatatattgaacactgaaaccgtattaatagtttggggtcaaaatcggagcagctattgcgtggagtttataaggaaccgtcctgggtccaatctccctccatattttctattaatagctctgaggatcctatgacaaatgcactaatcaatccacagaaaatgcagctctgggaaacattgctaatgctttggatgacaatattaaaattcaggacgatcttgttaaattgaagaaatgagccaaaatcaatagagcagcacacgcagttctgccaggtgttccacattgcaggatacagggagccctcgaacggaaaggaagaccagcctggtaggcgaaactccagctggtaaagctatccaactcctgttctccctctccctccctgacagccacaaggatatccagacaggtgtttagggctgtcatctacacatgatttaactccactgcctacagcttctcaactctttcccccagagcccagcagtgagggaagagagatgatgaatttcctttaatataagttgtagggcccacactgatgaatttagactttagaacatcacattagaagcagaaagaaaaaaattaggaaacaactaaagatttctaagtaggagtataatgacctcttcctaaggagtgtcataatatcttcctgacatttaaaaacatggtctctattgagaaaggggtaaggggagatgaagatgagggttctttaacaactcatttagctacccaaactctgagaaacctgagactttaagaaacttaaattcatcttttctttcagctacaacccttatccagagtcatccttaattacacttactttcttgtccccagttagcaagtcaataaacaagccctgccgctttcaccttctaagcagttttctgacctgcactctcttctccatcctctcccccgctgtcctagctgaagtcttcatcattctttacccagactgatacagaagccttggggggcctctctgcttctctattcctttagagccctccttcacaatgttgccaatgtgatccagaatgaaaacacaaatctaaccttgagttttccctgtttaaacatttccaataccctcagtgctcacagaatggggtttaggttttccaaggtggcatgcaaatttctgtggtggttttctaccaggagcaccatgagcacgcagtatgcggggcatttctacatgtctcattggtaagcactgtgtgggggcatttctagatgtctcagtgtctgggtggcgctactggcccttcatgcccagggcctagggatactaagcatcctgcagtaatcaagacaactcacacaatgaactgtcccacctgaatttccagaggtaacaccattgggaaagggtcctcaccgttcctgctcatttctatatccttctagctcacttttctgcactgcagctacataactcttcttccgcaacacaagccatgcttatttcttgcatttataccttaattcttgctctatgtgtctttattaattctgatacctggaaagactcatcactttactgattcatagtttaagcttctgctctggtgtcatttcccaagaagcatctaacgcacatggtctgacttagatgcttcttcctgataaggcagtagtgctttcttattgtgatatgctctgtgctcagcagtttgctttaaaaccattagtgttctcctttactaaggttcattgggcagaaactgtaggcacttagtaggccttatatagacctatgaatttaaagaatggaaggaaggatggatggatgcatggatggaaggaaggaaggaaggaaggtaggaaggatggaaggatggaagaatggatgggtggatgggtgggtgaatgaatggttgggtgagaggaaaaacttctctgaggctgttttagtccaggtgcccataaaataatacaagcattattttatagctcaggcaacagttgaggtcaaagtttcggatcaggtcatctgtctttagttccagcattctatgatgtacaagtcactctatatccctcatcttcagtcactaaatacctctataaaatgtgccaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcatggagcccttttggactctgaaagcaaaagtgaaccctctgttaacagacacacacacacacacacacacacacacacacacacacagtcctttgcattttgtttcagagagaggataaaccctccatagggtttatctatagaggttaaaaagtgctgctgattctagactgcatttctaatatctctttttagctctgaaaaattgacctagaaatgtcctcagtttaaataagaagttctctgtttttaccttaaaaatccaaaccaccaccccaatttcccctctcacttatgccaagcatagaacactggaattgtttcctagtccttacctcagtgcctggcccattctgcctacccttgattaatttctacgcctttgtccttttctcatgtaatttgtgtgatttttatctcttcattgcacattcacagccacatacctcattgagcactgacttactttgcaccagacttgcgcagcctgttcccatctccctccctcctcctgctagccctctgcttccccctaatattttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaacgaaggaaaacatcctcgtgggaagtccaactggactaagaaccctggactctagcactgttttcaccttgcccttgggggttcttggtattatcactaccgtgactctactgcctgttggagaggggtggtcctcttccactttgtcactctgatccaagcatgaaagatttcttcctctattctccatagaacaaaataaaatttacttatgtccaacttaggatctttaagggtccttcctgctcattcttaggttgatttctatggcatatcctgaaaggtcccttcaggaaaatctcgcctcaacagaatacagttgtagcagactgctaaatggtcatgaaaatttacattctcctcttctggccacacaacttggctacatttcctagcctcccttgcagctaaggttggctatatgattgagtcttgaccaatggaatgtgagaagtgttgaatgccacatccagtactaacttattagaaaattcccatgcatgtgcctccatacattgttctcctggctggaacagagacagccctcaaggaaatgctggaagttgtgcattgaaggtggtggagtctctatcagttttggttcctaaatacctgagtggaggaggctgcctttcaaattatgacacaatggtattttaaaaagcagtctatgctttttgtgaattcacttatatgtagtaaaattagaaacacttgccaagtgagaagagcagctcctggcatccaggaactgatctgatgctcacgtctaaatctcagtgttattataaactgatttgatctgacactgaagttaagccttgttccactgttggatgtaaatagtcacacagaatatctacttcacacaaggtcatcatgcaatctacaaagtaccaaacatcatctcctctaagtgaatgaccactacttcttcactaattacagcttcgtagtcactctaggtccttcctataggtaagatttattgagatacccaatcataaaactgtccccacattctgatggcactcaatccagagcaactccctgcctccgtagaccctccccaaaattacccaaccaaagcacaaatcctgtagtagggtctttctaacactttctccctgagataactcaccattccctatggtatgcattttcctttgctgcaatgagtaataaacccaacttgttcaactacaggtatattcctggtagtttttggttaacgcacattgacaaatattacataccaggacagtggttactgctagagaaagacagagaaggaagggatgagggtggagggacagctagctgtctctgtaatatttatcttttttaattaaccaaatataagtaatatcttaacaatatgagcttagtggttgatgcatattttctgtgtgtttgaaatgtttcttaaataaaaaggggataaaaaaccccacacagactatggtggtgtttactagggaaagacttggcagataccattccagatttcatagaacaatagtttccagaatgccagtgggaagaccagtgtggggctggctatatgagaatcatctgtggtgcttcctagaaattactggactcaggcctctgactctaattgagcatgtctggagtgggatctgggaatctgcgtttcttaaaagcacccctggtgatgttaagaactactacagtagtacagatggatattcaatatgcataattatcttaagtctacatgactctgacttatgaataattcatgttatacaacacatttggaaataaaacctcagcgtgtcttaggaactgtctgtataagtacaatctaataatgcattctacatgtattttgcaatagcttcacaaacctgaactttgccaccatgaggtttaggtaagtaatcattcgtacatgcatgcatgcattcatgcaggcaacaaatatttcctgagtctctgccatgtgtttagcaatatgggttataggacaatctaaagaagtattattttgcttaagtcagtttcacataactgggtatgagcaaatgacattcacacacctataagcactcacagagcctatgtaagtaagagagtgagagataatctattgggatacacaaaacccatttaagaaatcacaagaacaagatttacaaaacaaaacatgaaagtgagtagtaatgctgggagaactttgtgcttaatcaaagtaatcaaactattgcatacactttacagaattctttcccttcatttatctggtctttaatgatttaatttttaattgcaaaagcaatacataaatacgagtcagaaaatagaatagaaattagataaaaatataaagaaaaaaagtgaaggtcctacttaatacctctctcaacctgactcctttccccaaaggacaacatcatgaattgtcaggtatgtatcctgattttctattaattgataaatatctatttaaaattacatacaaatgaatagtggtttactttgggggaggataattaggataaggcagagaaggccagctgttctctaaaatgtgtttctctgcttcctgcatatatagctagactacgtttcccagctcccacgcaattagatgtgacataggagcatacatctgcattctggccaatgaaatgtgagtaaatgtatgggccaggctgaagtgatccacatcaataacctctcacagcattcttaatactctttcctccttctatctgatgatggtatcttaagtgagcctgcaaggcatttgcaaaggagagtagagctaccttttgcctacagctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcttcccaaagtgctgggattacaggcgtgagccaccgcgcccggccttgcctgcagcttttaatgccagggggcgaaagctaacctgactcaaacatcagccctggatcattccacaagaaagatataaacttcttgttctttaagtcactgaaattttggtgtttatgttttttaactacagcttttcctaccctaaactaacagacttttttctttaagtgggatactatattttgttctgaaaatagatttttgtcatctaaccacatctttgagatttttccatatttataaatatatatcttattccttttggcagctgaatagcattttatgatatggatataatacatttaacattcttatggatggatatttatagttttttccagtgagcatcctggtatatacatcttgtgcaaatacataaatattttttctaagatatacacctagaagtagaattttattctaatataggttcccataaatagatatgcaattttttgtttttgtttcttgagacagggtctcacattgttgcccaggctggacagcagccttgacctcctgggttcaagtgatcctcctacatcaacctcccaagtagttgggactacaggagcacaccacaatgctcagctaatatttttttagaggtggggtcttgctgtgttgcccgggctgatctcaaacttctggcctcaagtgatcctcccacctcagcctcccaaagcattgggattacaggcacgagccactgtgctcagtctattcacgattaaaccatgcttaatagtgccaagctgatctacacaaatttatattttcaccaaaagttaactttatgaaagtggcaattcagaaccatggctaacctcctgtaagtactaattctatcctgtcttacacattcctatttatctcggtcaccaccgagtgttccagtctcacctatcactcaatatgactcagtctctcaatcccacactgccccatatatctaccacttaagcccccacacctccctctagccttccaaacctttccaagggggcaaaagtctctcgatctttatccaagagttaacaactcaggattcttaacctcatatcagaaagtctccctcaaatacaaaatcaccattaggcaaacatccaggtaaaaaaaaaaaaaaatgttggcaagattaatttacataggctaaaatcactgggcaaaagtttgcagataacaggatattagtatagtcttaaaatatctcccccaaaacattcatcaattataaagagaaaaacaataacttaacagtggagaccaccttaccaaatgatccaagtaaatatcaccagtgataaggatactgatcatcatgtaccctctgatgcgatgcactgagaaggacatggcatcacttctgtaattttcttgttggaaattataacttcaagctattcatgagaaaacatcaaacaaacccaaactgggggaagtctacaaagtaactatccattacccactgaatgtgttaaggtcatgaaagagaagggaaaaaatgaggtactgtcacatattggaggaaattaaggaatcataatgactggatgttttatgtgatcctgaattggatcctgaaatagaaaaggagcactggagggaaactgatggaatatgaataaggtctgtagtttatattaatagtattgtaccaatgttaattttctgattttgatcattgtactatggttgtataagatattaatgttagctagatgaagattttattggaaactatttttctactatttttgtatcttctctctaagttggaaattatttcaacataaaaagtaaaaaaaaaaaaaaaaaaaagagtctgcctcattttcccacattgtctgaaacctgaccacctcttgagaacagtacttcccacaaccccccgaaatggaactattttacttccatatacatattccttggtgcctgaaaatgaagcagacatcctgtttgctcccaatctacttccagaccattacttcccccatcatttgcaaaacatgtttgcttctgtagtacccacaacacagaatacaccatcctctttgccattgtcatccttcaaccttctggtcaaccatctctcatttgtttaagatttcagcctttggtgcacccaggaggtgtgggtatcatgtaattggcagttggtcaaagctggtgccagacccagcctcctgaaggaaccatgtcctgcagctttgggtgccactcgtcatgtcaggcacacactgctgcccaagcggagctgctctttgaattctctgtgaatgctgggaggaggaacaccagagctgctggctgaaaattgtccaaacaagaggaatacccccctgcatggacttcctggttctcttcctgctctactggctttggtgctagttggttatgttatgacctgtttttgctagaaaactcatgatttgaaatgcctggtcagggcaggggcacagatattttcctgtataattccagaatgtcttcagaaagccatgtaaagattgcttcactacctcttccatacatgaaaccataccttcattatccttcacctggtcttgcaaggaatggtaaatactgaatatacctgggaaatactgggctaccgtcaaaagctagttctcctgtattaccttcttctgccctgtctgcttctgattgtaaacccgtttatttccaccctaacttgtgtaactgattctggcattataagaaaagcaaatgaattatttcttcaagtttatgaattcagtgatgtttctaaagaggtgaggtgctctacttatgagttacgaacaccagctcgatcaaagcactgactgcagtgtgtgcaccgttttgaccatcgttaggtttgggtgaacaactgcatctgggcttggaacgccagttattaatactttctcatctacctcttgatgttgacggctttggctgctgccatggccattgtgagcactgcgtttctggtcgatttggtggtattgttggatttgtactagacttacactgatgaccttggacacttccagtttatagacttgatttttcttatttagtacctgttcctgacctttctaacaattgtcttcatgctggggttgtggttggggggacgttgtaatggtcctgagctttctcctgggtagctacctgtgctttgctctgtacctggttgccatcaaccagactactaatgagtggtacagaggtgactgggccccatgccagcattgccccctcatggcctggcccccatcaggaaagctccaaatctaccagaacattcactcccatgggctctggagcaaactttgagagatctttctacctgccattccaaataatgagagaaagaagaaacaagaatggaagaagtgtcactgccttttaaatatagtatgcatttattatttaagaaaaaaccttcagccttcctccctatcttgactactgtcaacatggatatcctatgtgctgcccccccacaggctgtgtttcttgatttcttggtctccagtagctcttcttcactccacctcagccacactgccagggccataccctggacattgttgtcatgaataaatgtcctctctccaaattatctgacaaattccattcctgaatacagctttctgtcattccatgttcttctttcaagtactatcaatataacaacattccagtctctctgggatttctaaaccactgattccccacctctttctaaccatcagctcccatctattttaattcttgcgcagcttagagcccatagtccattttttaaatctttcccttacaaatgcctttcttcctcttctccctgcttccatcatatatgtctgtaaaaatctcaaacctagatcaagtcaaccatctgctttctctgagtctgcaccagaacaagtaaatcaaacttgggaaaaataatacatctggtgtttggggatgggaggtatgaaggaggagggagtggtaaagtagactggcttcaaatgaagtccattaactctagcttcatcctaccgaattcttctactccatttcactcataaattcttttttttattttttatttttttgaggcagagttttgctcttgttgcccaggctggagtgtaacggcgtgatctcggctcactgcaaactccatctcccaggttcaagtgattctcttgccttagcctcctgagtagctgggattacaggcacctgccatcatatctggctaattttttgtatttttagtagagacagggtttcaccatgttgcccaggttggtctcagactcctgacctcagtgatccacctgcctcagcctcccaaagtgctgggattagaggtgtgagccaccatgcccggcccactcatgaattcttctcctgtaccttttgtttgttctcagttctcagctgacaatctcctcatacttcattgagaatagagaaataagtctttcatcttctcaacacgaaatcttttaagtcttcctatatctgtacctatcttcctttaacaaaaatgtaaagactgcttcctcaattataaaaggagaagtactctccttttaatcattgactaatcattaagcattggttatgtatactcaggaacttattcatatattctttctcaagtttatttcttctgtcatccccttgtgtctagtcttcccctcctctcctggatcatttctatcagcatacaaacatgatcaatttaagaaaacttttgattccgcagcctcatccagttactgcctcatttcattgttctcattttcaaattattcaagagttactgataaatgccaaatctattcccatatctccatttactcgtaagtccaattcaatcaagctccagccccatcatcatacccaaatcatttatgtcaagatcacagccactgtcactggtccttctctcatttgaactttcaacactagtaaggaattgactaatttctcctttcggaaatatgtctgtcctgttttccatgataccacactcttaatttgcccgacttctcggatgtcctttcgtatctacccgaactctacatgatagagctcctctgtatttggtcctgggccctcttctcaaacctgcaatttcatcttaagtgactttgtccacttttatggctttatatttacatgctaatataattcctaaatttatatttcccacatatctgctcagtgagaccaaattcgtgtgtacaactgcccatttgatatatccaaaccatctcaaacttaaactcttgatatttttctaaatatgtaaacttaaacttaacttaaactcttgatatttttcttcccaaaccttggttttcacctagtagcccccatctcagtacatggcatcactacacctccagtacttcaagtcagaaacttgggagtcatccttgattcttcctccttcttcatccccaatatcaatatgtcctattgaacttacatacaatatgtagttatagtcatacgtcagagatattgtgagtttggttccagaccactgcaaaaaaagcaaatgaaatattgcaataaagtgagtcacataaatttttttgttttccattcatataaaagttgggtttacactagattgtagtctcttaggtgtgcaatagcattatgtcttgaaaaatgtacactttaatttaaaaatacacgttgttgctaaaaaaaatgctaacatctgagcctttggtgagttgtaatctttttgctgctggaggctcttgttgataacctgctgactaatcagggtggtagttgctaaaggccagagttgctgtggcaatttcttaaaataagacagtgaagtttgccacatcaattgactctttctttcatgaaagatttgtgtgtagcatgcaatgccgtttgacagccttttacccatagtagaacttcattcagaatggaagtcaatctcttaaaccctgccaccactttatcagctaggtttatacaatattctaaatttcaagtcatttaatcaatgttcacagcaacttcagcaggagtagttcccatcttaagaaatccctttctttgctcatccataaaaagcaactcctcatccgttgaagtttgatcataagattgcaacaattcagtcacatcttcaggctccacttctaattctagttctcttgctatttccacatctgcaagacttcctccactgaagtcttgagtccatcaatgtcatccatgagggctgggatcatcctcttccatattcctgttaatgttgatattttgacctcctcccatgaatcacaagtgttcttgatggcatctagaatggtaaatcccttctagaaggtttttaatttagtttgcccagatcaatcagaagaatcaccatctatagcctttaaaaatctatttcttaaataataagatgtgaacatcagatttattccttgatccataggctgcagaatggagactgcgttagcaagcatgaaaacattaatttccttgtatatcttccaggcatctcaaagttagcatgtttgaccttgaacttttgatatttttcttcccaaaccttggttcttggttttgatatttggtttagaaatactgccaaatatcctaataggtattagaaccaaggtttgggaagaaaaatatcaaaagtttaagttgaaatatgctaactttgagatgcctgggaaatatacaaggagattagtgttgttttcatgggtgattaggtgcattgtcaatgagcagcaatattttgaaaggaatcttttcttctaagcaggtcttattagtgggcttaaaatattcagtaaaccatgatgtaaacagaggtgctgtcatctaggctttgttgttccattcatagagcatacacacaatttagcatatttttttaagggccctaggattttcagaatggcaaatgaacattggcttcaacttaaagtcaccatctgcattagcccctaacaaaagttagcctgtccttagaagtaggtattgacttctcctgtctagctatgaaagtcctagatggcattttcttccaatagaaggccgtttcatctacattaaaaatctgttgttaggctgggtgcagcggctcacccctgtaatctcagcactttgggaggctgaggtgggcggatcacctgaggtcaggagttcaagacaagcctggccaacatggtgaaacaccatctctactaaaaatacaagaaattggccaggcatggtggtgggtgcctgtaatcccagctactcaggaggctgaggcaggagaatcactcgaacctgggaggaggaggttgcagtgagctgagattgcgccactgcactccagcctgggagacagagcaagactctgtctcaaaaaaaaaaaaaaaaaatctgttgtttagtatacacaccttcatcaatgatcttaactagatcttctggatatcttgcagtttctacatcagcactttctacttcacattgcatgtttatattatggagctggcttcttcccttaaacctcatgaaccaacctctgctagtttctaacttttcttctacagcttcctcatctctctcagctttcatagaattaaacagtgttagggccttgctctagcttaggctttggcttaagggaatgttttggctggtctgatcttctatccagaccacttgaactttcttcatattagcaatacagctattttgccttcgtatcattcacatgttcactggagtagcatttttaatttcctttgagaacttttcttttgcttcacaacttggctaactaatgcaagaggtctagcttttgtcctatcttggttttcaacatgcctccgcacagagcttagtcatttttagcttttgatttaaaatgagagacatgtgatatttccttttacttgaatgcttatgggccattgtagggttattaattggcctaatttcagtattgttgtgtctcaggtaataggaaaatccaaagaggagagagagatagacaggggaatagccagtcaggggaacagttagaacacacacaacatttattgattaaattcactgtcatttgtgggcagggtttgtgggtccccaaaacaattacaatagtaacaacaaagatcactgatcatggatcaccaaatcagatgtaattataacgaaaagtctgaaatattgtacagattaccaaaatgtgacactatgacacaaagtgggaaaatggcaccaataggcttgctcaacacaggattgccacaaactgataatttataaaattttaaaaaatgaaatatctgtgaggtgcaataaagcaaagtgcaataaaacaaggcacgcctgtacttttctctgcactgacatcacttaagctgagccaccaccaactcttatctggactactgcagtaacatctttagtagtttctccatttattctcttgccttctcaaatctattcacaacacagcaactagagtagtcatttctttttgaaaaataaaaattttctacaggttatccctgtggcttgaaaaacatgcagactctgtgccatggcctgtgtggtccacttgacctgcctagctcctgcctgtcttgtcaacttcgtcatctctttttttcacttcagcccgaacataccagcttcctttcaggttgctgagtaccctatatgccattgcctcagcctagaactttctttctggttctcagtatggctggttccttctcatccttttatcttcagttcaaatgtcattttcttggaaagtcgggtcctacctatcatgctaaggaggtgttgccttcctagtaccattatgttctcttaccctacctctaacactatgttccttcataggaattgttcgaatcctacacagttatcctacacagttctttgtcagcttgtctattttccacatttgctcatggagccatatttgctttattcataatagatgcctagaacctagtatagtgcttgacacacatttatcggtgcttatcagtctagaggatttttctgtttggggtttttaagagacagggtctcccctgtgtcacccagcctggagtgcagtggtgtgatcataactcactgcagcctctaactcctggctcaagtgatccacctgcctcagcctcccaagtagccaggactacaggcacgtgctaccacacctgaatcatgctcattgttgaataaatgaaagctcctttcctaatgtgaagtattatcaatccattgatatttttgccactgaaataataaaatctatatttgtgtttatctaatcattagtgaaactgaatattttgattcctatttcctcttttaactgcttgttcaagtaatttgccaatttttgagttgttattttcttattatcctataaacattctttgtgaaattaagcctttatccattatgtttgaggcaaatattttttcctagattattatttacttaaaacattcttcattatatcttctatcatagattttaaaatttttacgtacttaaagctatggtctctctttatggcttctgagatttgtatattgcttaaaaaggagtttctaccctcaaagtataaaatcatccttcactacatttttattgtgttgattcaatacaaattgtcaaattgtctattcttttgacattggtttgaaagaaatactttcattcatagttgaagtcctaaatactgaatttttatataaacatgggtctactttagattctctatagcattcaataattcaattcatagattgattacaatgccaataacagtttgttattccaaccagctttaaagtttttagtcttttatctcaaagtaatttcagttttggttttaatttttccccaatagtcatttttaaagatagtttaaattttttaattaaaaaattagctgggcctagtggtgcacacgtgtagtccccctacgtgggaggctgaggtgggatgattgctcaagcccaggaggtcaaggctacagcaaaccatggtcatgccactgtactctagcctgggtgacagagcaagacactggaaaaaaaaaaaaacagaaaaaaaattttttaagtaaacagactataatttcatattgcttaatttctaattttactccatttttctcaaggactgtggctttctaggatttggggtgttttttttttggaggttaccaagagtctttgaggccttgaacatggccaattttgtagtagattttagtcagtcttcttaaagtcagtatttataaagaatatgtgttttcatatattgggtacattttatgtctatacaattatgcttagcattgttattcaaatcctcctttctttacagagttttttggttcacttggtctgttaatttctatggagaattagttaaataaaaggaaaatttggcaaatccatagtctatattagagacaaatagtttttgtcatatgtatttcaaacctattttgataaagatttgtgacttgcattttcctttggattatatattttatctgcataaatatcttttattgtgttgaatgtttttcaccttgaattcaatttgtctcatactaatattgctgcttttgttaacatttacgtgtataactttgttttcaactcgatttatagatattctttgtaatcaaatatagctagatttgtatttttctaggcaatccaagagcttttattctaataagataatttagcctgtatacattttttgtgaatgctgacttattggacttaatattttgcttgttactttttattgaaaaattcccccttcttttctgccttttattgtaaaggcagaaattgacgatcaaatttttatttgttgtattatacttatatgtttttgtgttatttatcctaatttgtacatataattagcatataattaaacatataataagcacatttatttttctatcaatctctggaattgatatcaatatccaacattcactcatacaacaaaggaaaaaaacttattgtagttcatatccctgtctcttccttgtgcctcttctagtgctaaaatcctccatgattttaattagatcctgttgattctttttttttttttttttttttttttttttttttttttttttgagacggagtcttgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccaccgcgcccagccctgattcttatttaaacagaaaaacaagcacatatttgaccaaaaatgtcactgtcttctttgttcacaattgttctggtatctatgccttcctctttcttggatttactacttgtttgactagcattcattttcatgtaatttttaaaatacggctcttagagctcacatagaagtgatgaagttggctatgcagatggcttgtctccagaatggggaccacatattcccccaggtatagcatgtttaccagaagcactttctgggccccagggccttcttagtgaatcttatgcatcaagaagagttctcaggctctattgttgggggtaaaggctggagttggctgctcactttccttcacttcttcctctgctgtccttgttggagttacactgtattcagcgtctctttccaaacactatcctggatctcttatgtggattgtatcagttaatcttcttctgagttagcagttattgttaccccctaccccaggctatatgtgaggaaacgaggccccaagaggttaaataatgtcctattaatgaggaaaaatgttataatttaaactcaggcagtctaacccccagatcccctgccctcccaaaaggagaacatggatggtactaggttccagtgataagaaaaccaagtgaaactattttgtaaaaaaggaactagtcaacttttatttttttaccaattattaattgcatacagagaaagacaaaaactggcctggccaacctacagaatgggagaaaaatgttgcaatctatccacctgacaaagggctaataaccagaatctacaaagaatttaaacaaatttaccagaaaaaaacaacctcatcaaaaagtgggcaaagcatatgaacagacacttctcaaaagaagacatttatgcagccaacaaacatatgaaaaaaagctcactatcactggtcattagagaaatgcaaatcaaaatcacaatgagataccatctcatgccagttagaatggcgatcattaaaaagtcaggaaaaaacagttgctggagaggatgtggagaaataggaacacttttacactgttggtgggagtgtaaattggttcaaccattgtggaagacagtgtggcaattcctcaaggatctagaaacagcaatatcatttgacccagcagtcccattatcgggtatatacccaaaggattataaatcattctactataaaggcacatgcacacgtatatttattgcagcattgttcacaatagcaaagacttggaaccaacccaaatgcccatcaatgttgggctggataaagaaaatgtggcacatatacaccatggaatactatgcagacataaaaaaggatgagttcatgtcctttgcagagacatggatgaagctggaaaccatcgttctcagaaaactaacacaggaacagaaaaccaaacactgcatgttctcattcataagtgggagttgaacaacgagaacacatggacacagggaggggaacatcacacaccagggcctgtaatggggtggggggctaggggagggatagcattaggagaaatacctaatgtagatgatgaattgatgggtgcagcaaaccaccgtggcacgtgtatacctatgtaacaaagctgcgcgttcttcacatgtatcccagaaattaaagtatgataaaaaataaaaataaaaaactggcctggcactcacagctaggccttggtgttctcctgttgaaagtaaccaatgttacataatgtcaatatcagaagaggtcactgtgactataatagctcataacaaaaacaagatcactctataacatgtctgaacacagaaaaatacatggaccttgtagaaactataatagtgaccaaagatcccaaaattatggctaatatgagtgacttctgcttctttatcaattacagcatgagtctcactctggtcttccttccttctagatagaattgattaagacacctcatcatagacctacccctgcttcctgataagatccaattcagagcaaagctctgcttccttaaatcttcccctaaatcacctacgtattagtctgttctcacactgctaataaagacatgcccaagactgggtaacttacaaagaaaaagaggtttaattgactcacagttccacatggctggggaggcctcacaatcgtggcgaaaagtgaaggaggagcaaagacacatcttacacggcggcaggcaagaaacagtgggtgcaggggaaccgccctttataaaatcaccagatctcatgagatgtattcagtatcacaagaacagcaatgggaaagacccacccccatgattcaattacctccggccaggtccctcccacaacacatgggaattatgggagctacaattcaagatgagatttggatggggacacagccaaaccacatcaacctgacacagacccaaatgctataagtcctttctgacatctaagatggcccatggttccccacggtgtggctaaggagtctggaattcattttataggcagtaggaataggagataatcaaatctgtttgaccagtagagtgacatgactaaagctatgttttagaaaactaaacttgacaaaacatgtaagacaatgaagagactggttgcaaagatagtaacaaactcactgcagtagtccagggggtgacaagaaatcacaaaagacacaggccatgattcaagtggcatgtgataatactgacatcagggcagtggcagtgggaatgaaaatgaggtagcatacaccaggatatctgcagggagaattgatagtgggtagagattgtgatatggttctaaccatcaacataattttacattcaataggtaggaattcctctgaccagatttttcataagctgttcagtcttattctgaacaaaatagatatgagatttttgtatctataagttcactttattagcataagatagaaagttatgaataggatgactttctattcaccttacctggattataaaattcaaggctggatttaagcctaccatatgggtaagggatcaactgagcccttaagtgtctttcagaagctcccatgaagggcattagaagttttgtgagcatattggaaggcaaacttggtgcctatgtgtgcatattcagctgacttgcctggattctcagctctaggagactaaaatagatgaagatgtgccccataggaactaatcacactattattcaaatgcaagtaaagaagatgcatggtttcaatggcaaaaatgaagaaaactttccaatattacaatcggcaggctgagctcaaggtggtgcaaggcaatttagaaataggaagaccctattttggaatgcgcttggttccaagagcttttccaactgaggtttttagaactgagccccttgtcccctagaaacaatgttggaaattgtacgtaggaatagagtgcagccaggagaggtcacaaaagcccacctaccctacagtaagtttaattacggtactaatccatgttgggtctgggaagaggaggtcattcatatatgctgatcccagagaaagcagacacatttcctctctttacttttgcctattctagcaaaatccagatattggtaggaagaaatagaagtcaactgcccaagtctttctctctgagctgtctgtcccaccctctccaatagtcctctccacaggtagcctgtgtttctacagtgctcaccacccctatgtattttgaaggtcaggaatatctgagcaccgtctcctgtcagaacagcagcggtattagaatctcataggagaacaaaccctattgtgaactgcacatgtgaaggatctgggttacatgctccttatgagaatccaactaatgcctgatgatctgaggtggaacagtttcatcccaaaaccatcccccttgccccattcatggaaaaattgccttccacaaagccagttccctgtgccaaaaaggttggggaccactgctttatatacactataaacacagataagtaaaacactactcacagatgtaagggacaatagttactcttgcctcactacaggcacacgggcatagactctttccacttccccctcctccctcctcccctgaaacacaatgttgtattactcaagaggtggtttggccagtccccactaaaaacaacatttcatatgaatttcaacaaaaagatattcacaaaatgtgttattttactacctgtacttttaacacatatcaggcacttcagaacatctagaagaaagcccagacatttcaaaaaaaaagtacttagtattgccaaccatgtatacagtagtgaggaataaaatacacacacaaagcgatggttaaaatatgaaaatgtctcctaaatatgatcagtctagcatggagccttcttctcctccttctcaggtcttccaccccaagtcctcttatccactgaacaattgtggacatgtcatccctgatgtcacttccagaggtggtctcacaaatccatttcaaaaagtcatcccagaagacattttatatgattttttttaagaggtgagcatttgcaagatgtgtgattttatgactcttttatcataatttggcaaaacctatctacatctagaagggctagatgtagcaagtgctcttttaaaaccttggggaggtcagttgagagcagtttttcctatgacgtacacagatcttctacacagggcctgtacatttttccaaagaccagtgggcctttctgttgcccaaatgtggcttatctcctactgtttctcttctgatatgaaggtatgatagatgggagatcaaccccgcctggtggcttctagcagtttcatccgtcagggctctgctcaccttctggaccgttaaggccttggtccattgtcatcaataacgaggcaggcctcacccaactgggacagagtggtcaccccaggccccggtcctgctgggtttcaggccaacagaggtggcggagttgggtccgtctgcagacccaccttccaggcctcaccccacagcgctctccacggtgttcccgcagctgccaggcttcccaccctgcacaccggcgccacccaaagcggctgcatcctgaaggcttcatctaggccaggcagggttaggccgggaggcccagcagccagctgggtctgggctcagagaggcagctgcctgatggtcaaagaggtggagtggagagaggggccctcctctgcatcaaggcctgggccctgccagtgcacagccatggcaagggctccaggtgcctgcagagcagaggcttgcttgtccttggaccccagctttcctgggagggccataggggaagtggccatgcttcacttctcaccaagctctctgcaggaactccagagtggcttgttgttttttttttttttttgctgtttgtttgttttttgtgtttttttttttgtttttgtttttttcggtgagacaaggtctcgttctgttgctcaggctagagtgcagtggcggcatgaccatagctcactgtaacctcaaattcctgggcttaagagatcctcccacctcagcttcccaaggagctgggactacaggcatgcaccaccactcccagcaaatttttgtattttttgtagagatgaggtctccctatgttgcccaagctggtcttgaactgctgacctcaggtaatccacctaccttggcctcccaaagtgctgggattacaggtgtgagccacagcacccagtctcatagcagcttcttattactttatttgattaaaagaacaaagcactttgtattttaaaaccatatgaatatataatctgttacatttaatgtgtaaacaggagataaaatcccaagccccccaacagacttaatggattcccttgtagccaagtggattccagaaagaaaaactaaattccaaattctaaatgccccctcccttttggagtttaggcacaactaaccagcacattaaaatagacgtcatagactgccctaacactaacagactctttgtggcaataagataacaaattccaacctgactccagtacagcatcacacgacagatagcagaccctgaaggaaataaaaattttttaccccaaaatatatttctttggcatattttgaaatggccctgtaaagctgtcttttgtggggaaaatttgcatatgtagagacactcttaccccttccaggtcttccccagatcaaggagagataagtgagaatctgttatctttaagggttgaaaagagaggctttggcccaggcacgtggctcacgcctgtaatcccagcactttgggaggccgaggcaggtggatcacatgaggtcaggagttcaagaccagcctggccaatatggtgaaaccccacctctactaaaagtacaaaacattagctgggcatggtgttgcatgcctatagccccagctactggggaggctgaggcgggagaaatcgcctgaacccaggaggcagcagttgcagtgagctgagattgagccactgcactccagcctgggcaacagaacaagactccatgtcaaaaaaaaaaaaaaaaagaaaagaaaagagagacttttcttttttggtcatcaagtggctgttagacatgaattttaaattgttaatgtttaaaatgtagccaattcttatatctcgagaaaattcttaaaagaacactttttcctaatacccgcacacaaaatgaatctgtcctgcttcactcacattcctaccctagctgaaattcaaacctctcttaacactcatccaaaaaaacacaattggaaagatgactacaccccgcccccaccaccaacaaattaccaattaaaattttaaatgctgagatttattttacccaatgttttaaacaacctaaatcataaaatcctatcattgttttttaaaaaaggcttatcaactgttacttcacgtcttccatctaatagaaaagtccacccaaaggtatcacacatgaatttttataagtagtaaataattacagagactaaaaataaccttgaaagttagaccaaggctaactgccgatttctaccctctgttttcaggctcaagaatcctaaaacgaattctaaattatgaaattggagtctgtccctagccagagtagcagacttaatgcaccattaatctgttctgctctcagccgctcattgaaacagtcacagtcattcaatttttagggaaaagacagtactgcaaaagtacattccagaggtcttttcataaaaaccatcctgtgtgctccatctgcatgtgcaatctgcttgtgtattttcagccagcttgcacgggcagattaatgcgtacaattagaaagcaacctcacaggcattcaataaactgccttcattattacactcaggagagtccctttggatgtcaataaaagcctagttttctgcctgttagctaaataattgacaacactaaaaataatcagaagcaaatgaacgaagtcaagaacaaggtgttaagaaagagcacattaagattctcatggtggtgccccaggttgctatcatgagctttttctccagcaacttggatttatagtccgctcaagtccatggttgtcctctctacagaaaaaaaataccattcctggtttgctgtatgaatcacacattgcagcatggtgaaactagcaaagtattgactggtttgaaagaatttcttatgtacgtttctattttatgttccttcatttaacagtttcaggagaatctaatttgggaggtgggggtaggcagtctggttggtctggcaaaacctttgtgctgttaaaaatccaaagaggtggctgggtgcagtggctcacacttgtaatcccagagctttgggaggtcaaggcgggtggatcactggaggtcaggagtttgagactaccctggccaacatggtgaaaccctatctctactaaaaatataaaaattcattgggtgtggtggcattcacctgtaatcccagctacttgggaggctgaggctggagaatcgcttgaacccaggaggcggaggttacagtgagccaagaccaagccattgcactccagcctgagcaacagagcaagactccatttccaaaaaaaagaaaaaaaatccaaagcactttcctagacattttttccaccatacactgattctaaggaggtatgacaaaaacttgtcatatagacgatccatcttttataagtctcttttatatttctaactacatactcactgcttatttcatgagttattggtcttttaatttcaaaagtaattcaaaacataatactctttcaaagaagaacctcacacatatacctcttcttgtgtttctcaataggctttaaaaatcaatttgagatacttctcaattttagccaaactctgtttttcctggttaactgggacttttacaataagcagaagaaagagcaagagtgaaatgtgtgtgtaattgaattcagctccactgatagcaggccaggtggctgagggcaaacttcttttttctttatagaaaaagggtgattgatcttctgtatttagtaaaacacaaactcaagaagctggaactataaaagaaaggaggttggacgcacagcttctaatgtcttttaaaacttcaagaatctcttaccctttactttgccatatttagaactctccagagaatgaacccattcaactatccagtcctgtgcccaaggcccctcactgttaagtaggtcttccctcttccaatgtaaaactagtatgccacaagacaatgacatttgttctcatttgtgactctaggctactaaagttgagaggtgaagccagctggacttctgggccaggtggggacttggagaacttttctgtcttacaagaggattgtaaaatgcaccaatcagcactccgtagctaggattgtaaaacgcaccaatcagtgctctgtggctagcaagaggtttgtaaaatgcaccaatcagtgctctgtaaaaatgcaccaatcagcgctctgtgactagctagaggtttgtaaaatggaccaatcagcactctgtaaaatggaccaatcagcactctataaaatggaccgatcaacgggatgtgggcgcagacaaataaggcaataaaagctggccaccccagccagcagcggcaacctgtttgggtccccttccatgctgtgaaagctttgttctttcgctctccacaataaatcttgctgctgctcactctttgggtctgtgccacctttaagagctgtaacactcaccgcaaaggtccatggcttcattcttgaagtgagcgagtccaagagcccaccagaaggaaccaactccagacacaaagccaccagcccagcccctaatctctctcaactcttccggctgagcctcaaaataaattctcattcattctctacccatgaaaggagaggcaatgatacattcacagtcttcatctggtgcctccctcccaccatatctctctgcaagacagacagtttctcctggtacttagctccttagcttcccaccagctcctcactcaaatgccttctttagaagaagagttgggacagacaggctaaggattctgtgatgaaaatgagagtgatgctccttttagctaaggaggatgacatcacttaccaacactttcatcctaccccataccatctcccatctattttctggcctgggtagcagaaacacagtacctaacttgctaaggagcaaagcagagggttgagaaacgtctcttccattcctgcctctgaatcttaaagcaagaaggagctgcttatgatagaggcaggataattttagtggcatgagaaatcagaagatactgtgcttagagggggaatatgttggaggctgtcacaaatatgctcaccccaacatctgagtgatcttaaattctgcaaacaaggaacaacaatggagtgagagaacaggcggcaggcagtgaatatttcatatgaaagtggagggcccattactggttctggtgggaccagaaatttgtgtacagcctccataaaataaaagttatatgatcctattcaataaggatctctgtaagaaggatcatttcaagtgcctgtaatagtcaggcacttttatgtcatttacatattttatttaattcttgcaaatggcctataagatagatattatctgtatttaagaaaaaaaaaaaaaaaacactgacattcaaagagttttagtgagagctaggactttgaacccagatctgcttggttctatttctaccacatttagaattaatgtagggccagaaaggacatgagcttatccttaaagcctacataacaaagtagattacgttataaagcatgtagtagttgccctgtatctgttagctgctgttgttcacaaatcatactgcaaattaccttggtgtatgaccaccagttgagacttttgccaataactactaaatgatttctcaattcttgtctagaaaaaaacacaagtgtatagtggtcctcagtccatcagataaatccctggtcagtttagacgctgcttaggcacttcagtgcaaacaccctattccttatattggtatcctggacgtcaacatgagcagaagtaccttggatcaccaaaggatcaagtcttccaagttatttataatggggaatttctcaaatttagtgttattgactactaaaggatactttggtgagtagacatgtctctcccaccttacttacatggtgaaagagttcaattacataattaatacaacagccaataatccaataccaggtgttttgacaagttagcatcacctgaatttaaaacctctatgaacaatctgcctataaaggcacgaagttctgaaaacattaacttactattgctgatgctctctaaatgcttctcttctaaggttttcttgaagtctttttttctcctccagtttattgctctgaaattgcaaatatcaaaacataacttattaaagatgctttaagcagagtcatgatgttaaagttacccaaggtccaaaatcctaaggttcaactggccttgatagtctaatacagtatcctgctagaggctccaagatggtactccctgtcagacccatgggcactgcactgaaagccaggagctccaagttctttccacagctcccctctcccaacttgattggtataatcacagaaccagcattttgcgtttttattctttagttcaaatgatagcaacatttattttttaagcagtgctttcaaaatgttttaatgaaaacatgaaatttccataccaagtatgttaaattaaaattataataaatggttaaacagctcatacaaaatttatacatacactcaaattctactaaagtatttgagaagagattttcagtaagacaacccaactcccttctgacttagtatcagatacttaaagctgttgagggactgaatagcacatgtcataaaaaaagccatccacttgaatagaaaatagttcttttttttaattagctgtttggagagcctggagataaaggccttcatatttgatattactgtcaccatggctctggcatattttaatccaatttaaataacccaggaatgtttgctttttgctcaccatgacacactgtcattttttaacttgctatgacctatgaaaaacaagtaaaattcctagacaacaaatttaatggagagttgaaacacattctactatccaggaggatcatgaagttttaaatgaatccaagagagacagtaaggagctggggttgctttaataaaaattggatttgcccagaagaggaccagtgaaaggagaatattggaaatcatcactttcaagcccaaacataagtctggttccatctttcaaagaaatgaagaaactgcttgtattgttcatttccatgaaagtcttcattcactcaaaactaattactagtcccattttgaaaggcaaaatggatgatgatttcagtttcagaaaaaaactaaaggaaatttactacagtcaaagaaaatcaattataaggcaagcaactggattattaatgaaacacagaattctaggaggcaaactaatggaaaattgtaaaaccaaataaacatgattctagtctaggaaaaaatcctgactgatgagcacaaaagtgttcaattgtgatgagttccctgccctccagggtggggactggggggtcgtggtggatctaaaagggtgaaagacagcaagcgagcagtaagtgttgattaaaccagtattcagaatgctactcagagaacagtgagaaagccaaaaacagctagagacaaaaggctggatccctttagcaaggttagaaattgagaccactgattttaaccttttcactaatagattccaactcacaaacagtcatacagtagctaaattttatccaacaaaagtctgtttatggcaggacgcggtgactcacgcctgtaatcccagatctttgggaggccgaggcgggcggatcatctgaggtcaggagttcaagaccagtctggccaacatggtgaaatctcatctctactaaaaatttaaaaattagccagtggtggtggcaggcacctgtagtccaagctactcgggaggctgaggtaggagaatcgcttgaactcgggaggcagaggttgcaatgagtcaagatcgtgccattgcactccagcctgggcgacaagagtgaaactccatctcagaagaaaaacaaaaaaaaacaaaaaatgtttgtttatgcctcagcagaagttgatagttgatgaagaagtatttggggggggggggaagtagtagtagtagtatttctggagtagttgaaaaattgtattcaatccctattcatatcaaatgcctgttatatgctcggtaccatgttagatgctgggaatacagctacgaacagagaagtgcccattctggaaaatgttacagcctcgttggggacacagacaaaaaagaaatgatggcagtatgctaaacacattaggggacagcagtttgcaaataacagtaagaatgcagaaaaagcacttatatggattgtcaggaaatgctctcaaaagttccacagtaactcaatgcctacttaatgttagactccatcctgagcacgagagccaagaagcggaataacactgggaatgtggtttctaactttgggtaagctgcatgttatgagggtgcttctttctatggagagtggactcacagctttcttcatattccccaaagagctgatgaccaaataaaaggataaataccatggctctaatgagagagagaaattctatatccaacccaatcttaagcaagagtgtttcaggaggaggagaaggtaggaacagggttactacactccattatatgggttgttcagcccatggggtcccagcaggcaggaggggagtaggaaaggaaaaatagagccagtgttcagctcaccaagatttgtactgcagcttgtggctgctttagcgcagaggaggtgtctttttctgtgtctcacaaaggcactatctatcaccagtctgagcacccacagaattgaccgcctggatggagaattggtctctaatttgcacaaaggcaaccatgggctggtagtaaccctggacaggaaaggggcattcccagaacttaacgtttttaatatacaaaggtacaagagaatatgttagctcaaggaaacccaagaagctcatggataaattgaacaacgtttatagagaaaggagtagaagataaggatgagaaagtaagaaggaataattatataggaatgtatgtgccaagtaaaggagtttggactttatgaaacccaacagtaagccattatattaagcaggaaaggaagtggctcactcttatagcaacatggaggttaaactgcagcaagggccacaaatacacgagaacccctggggtgattctcacagtaatctaggccataaattacaagccccaagttaagtcagcaggtacagggaagaaagaagaaaggacagtcttcagaaaaacttaaaggacagaaataataggaagcatgatgatagggatatgggatgagtaagaaaaggaggaagagtctaagattactatcatttaagagcaccagaatgaacatatgagttcaattttgaatttattggatttgaggtatacttgtggaatatttagggagaaatatcaagcatgcagcaaaatatatggttctggaatttagaaatatggtctggcctgaagatatggactgcagaaatcagtacaaacaataactagatccttaaatgtggaatttttcatctaaggagagggggcctaggcccagcagtatcagaggagaccacgggatgggatctggtaagcatcaatagtggaaaaacaagtacaaggaaaggatcccagagacattcaggaggtggaatttgaaggacagagtacttaatagttaattttaaattttaattttatttatgtatttatttatttgagacaaggtcttgctctgtcacccaggctgcagtgcagtggtgccatctgggctcactgcaacctctgcctcccaggttcaagtgatcctcatgcctcagcctcctgagtaactgggattacaggtacgtaccaccacacctggctaatatatgtgtttttgtagagatggggtctcaccatgtttcccaggctgctcttgaactcctgggatcaagcaattggcccgccttagctcccaaagtgctgggattgcaggcatgagccaccatacccagccttaatatttaattttacacagagcaaaaataagtgaggaatttaagaatctttactgggatcttttctttctttctttttaagagctggggtttcaccatcttgcccagactggtctcaaagccctgggctcaagcaatctttccttcttggcctcccagtgtcctgggattacaggcatgaatcactccgcccagctggatttttcagttaagaacaccgttggtgatcttaggtagattagaaccagagaagcattagaaacaaaagccaaattcagcccaccaacaaatgaggaatcagagaaggaaaggaatcagagaaggtaagttcttaagctagctgatccacacatctcctggggaacatttttttttttaaatagagattctttggttcaggtgattgtccacagactgacatttgggaaccaaatatggtagaggagtctttcaagaagttcgaaccataatgcttgggacagaggagttgaaagcagaccactatatggaaaatttgtttttaaggtgagagatttgagtaagattaaatcctgagaaagaaaaacaaaaacaaaacaaacaacaaaacaagaaagtgagaggagaaagggagcttaactgatagagaagcaaggtccctggggagaccggagggaagatgaaatggtgaacacatatggaagaatccatggtaccaatgaggaaaaggactttctgattcctcctgagataggatgggggtaggtgcagcaaagggagagtaagaaaagagaaaaataaagatacttaaggctggcaacctttatttcctatgaagtgagagacaaggtcacgtgctgcaaatgaaaggagagcataagaacataaagccagcaaggattttggtaattgggtttggttcccagttacaatgcaaagaaaaaaaatgctgggcattgggcattgtgaaagacccagctgagatcaaatctcagaaatgtagtgtggcaaaagaaaaaacaaaagtcacatatgtttttctctccagcaacttcattcatgtgggtttagtagaaatgaaataattgaacccatccaattcatgcataaaaataataatactctctacgccccccttccaagaggttgatataatagattccaacgagatagtgttaaagcacttctttacatttataattaggttagggtactttactgagtgcttaccaagtgctaggtattgtactaagggctgtgtatatattgcatcctctagtcctaccagtctcactattacattattatacccattttacaaataaggtaagtgaagcacagaaaagctatcagcctacactcttagtaccacatgtttattttagagatactaacattaccacattatggggttaattagcgagatcctattacatttcaataaccaaaggcttaatgcttccaccaagtcatccacaaagaaatgcatgatgtaggagccacatttcttggaaacactgatgttccctgaaagttttcagaaatggaaatgtttcccaatttatataaacaacattgaaataacttcctcaatgttgagtttacccctaaaattgttcttaaactgttagcccttgctactacttgcttcctagaaataagaaagcaacaagtgtgatcccttaacatgtacctgtatgcagctctgcatctaatatgcataacttattttctaccagttagttcctacttcaccgtatagcattaaaactaactgtgcttctcagtgtctgcatgaaacactgtgacttccagtgcttcaaatgactttcacagccatggcttactggaaagagcaaggaaaggtgttggaagccactcagatctttagctggtttcctgaattctctgaggttatgataccaagaggttggggaatcaaatgaagtatagttggtcctccttatctgtgagttccatatctgctgactcaaccaacttccgatggaaaatattcaggggatgaggaatagacggttgcatctatactgaatatgtaagactattttcttgtcattattccctaaacaatatagtataacaactatttacacaacatttacatcatattaggtattataaataatctagagatgacttaaagcatacaaaggatgtacatatgctattgcaaatactactccattttatataggattttggtatccattgtgttgtggggggagggggaggcagcaaccaatctcccatatctaaaggatggctgtatctggaaactatataataccgtatattatctcaaacatatgtagatcgaaggcagaataagatgaacccaggaaattgagagagtctttaaaatggagttagaagattttcatattttaggtttgtgggtattatgaaagtctgggaaaataaaattattatttatcatgtgattatggggggaaaatgtgatttactcccatagcactaaatttgggtgaaatgcttgctgtggggagttaggaaaacctgtctatttatactgaaagaaccagtggcaaaacacttgcatctggtagactgcttttttactctaatgctctaatgtcttagagacgttgtctctgctttatagatttcttggaaaagaaattaatgcatcattataaaaccacatgagtagtattagtttcctattgctggtataataaattaccacaaagttaacagcttaaaacaatacaaatttattatcttacagctctggaggtcagaagtacaaaacgggtatcaatgggctaaaatcaaggtgccagaaaggctgtgttccttctggaggctcaaagggaaataatcagtttcctggtcttttccagcttctagaggctacccacattcctgggctaatggccccttcctacatcttcaaagccagcagtggtgggctgagtctttctcctggtatcatctcttcattctctatctccctctcccaattttaaggacctctgtgattatattgggcacctggatattgcaggatacgctctctattttaaggtcagttgattagcaaccctaattccacctgtgaccttaatccccttacccatgtaaggaaacatgttcctaggttccagggataaaacgtggacatcttggggtggagcattattctgcccactacatgaattataatctatttttaaatcaataaatatcatacacacaataggccagctatttccccaaatctttactctccctagccctctgaggtttggctttagaatatgggtggtaggggagggtaagaaaatacctttttcatttagtgctaagcagtggtgtgctggtcaacatttaatcaggtctagcaggtaggagcaggaggggaaattaatctgtagcatttactgatttccacatcgtaaatattttccaccacagtcggtttcaaactgacaatgatgaagccaagtagctcaaaaaaatcctgaaaatgtgacaattcccacagtacaaggcagtacaaggaagctacagaacatcactagaagtatatatactgtgacagactctagtctagggaatgcaagttacattcctgaactgaatacaactcaagtataccagtgctgtctccaaatttccctttgtacccataggattaactcttcctgggccccactgacatgactggatactaaagagctggttgactttcacacctgtctgtctattaaggatcaaagaacatgcacaaatgctggcaaggaatccagtctattcttccctcactaaatgctgcacacagagatgacgaccaatcagaatgagacccagtgtcccctgacttcttttgggagagaaggaaatgaagggcagaaggggaccagcagccagtgggggaagaccagagacaaggctagaggctcttgggtggcaataggctgcttggattctacttggctcagagtttactgggcagcagccatttgcctggggaggagggcagcgtgtttgcaggctgatgtccatgtgtgtgtttgctgtgcattttaaaatataagtgctccataagcacagccattatcacttccctcggccatttccacactggcaatgtgaaatatgtcatttctagatggctaatgttcatttttcttatctgacacaagctactaactaggctcacatttaacatgaaaagctacagatttatctacaacagggaaggctaggatcatggtgacagtgcaggccaatcagccagagaaatcacatctgtggaagaacaaggatgggtcaccccttcttttgcaaggtcatttaaatttatgctcctcgagcttttatgtgcacaggaattacctggggagcttgttaaaatgcagattctgattcggtaggtctgaggtagggctcaagattctgctcttctaacaaactcccagatgatgccaatggtgcttgttcaagggccatattttcaatgggaagggtctacagatcaactctctctccccatctctcacatcctggcaaatttatgccaacagaattacagttatcatattaggaaagggaaaaacactacttttagacaatgtttaaacagtttaggccaggcatggtggctcattcctgtaatcccagcactttgggaggccaaggcaggtggatcccttgagcccaagagttcgagaccagccttggcaacatggtgaaaccctccctgtctctacaaaaaatacaaaaaaaaaaaaaaaatagctatagtggtgttaacctgtagtcccagctactcaggaggctgaggtgggaggactgcctgaccccaggagactgaggctgcagtgagctgtgatcacaccactgcactccagcctgtgcaacagagtgagaccccgtctcaaaaaaaaaagaaaggaaacagtttcaaccacaaacatttatgaatagcgtacattattgacccatgaagaaattagctgtaaatgacccacacgccagccaatgatgggtattaaatgacaacgaataaatgatctttaggacaagaggttgcaatacaataattattaagggtctgcaagcctcttcaccctgttcctggtgatgacttaacaattgtctttgttctacctgaaatacaggctatgctccgtaaagagagtgcctcctctagaatcacaagacctaagcatgaatcttcctttgaaggataaaatggaaggaaaaaaactggatgaggaaaagaagagtggggaatagaaagagagagagagagaaagatggataaatttttaaagttactataataaaaatcttctacaacgaaactataattgttgatcagcaaatgtgaactaatcctcctcctccttaccttctctctctgaattgccttcattttttggagttcagcttcttcagcttccttcttgattcttacagattcttctctttttagctaaattgtattgaaattacagagaacaaaaacagttaccatttttcagtctgaactctggaacacaaaattatgatgaaaggcaaattacagtattgtttgtgctatacctcaccatgattataggttgttacttcaagctacttagatcacagagaatggccgggctacgtcttctgcccgtgaaatttctgtctttgtgtttcttccttggtctgtctctttttcaacgtctctgtctttgtctatctctgtctctctctgtgtgtatgtgtgtgtggtgtgtgtgtgtattggggagggaaaagggaaaataatttttcctgattacaaaactcagtgttcattgtaaaaatcgctgggaatcttaaatattttttgtactacttccatgactgccatgcagtaaacaaatccatattcttagaaccaaaacattccaaacatagtagactttaaactatagttaaacatagttaacttaaatgaaaaaaataattcccttaatcgagggtcatgctgagtgataaagggcttaggtaggaattgaaggtatccatctcttcacttctcacttcctgagagctttgattctgaaagctgccttttgcaactggttggaaggttttatacttttggtaaagttactgtgttatttcacagttacttgtaagagctggtactcatattccttaccaaaattcaactaaaagagatgaattctgaccttttgcttgtatttagattgcatcagctggagttgttgtttctgtctgacttcagtttctgactggcttccaccttaggaaaaaaaaatccatgaaggtgaaacataaatattaagctgaaatgtcagccatcgaggactaattaatatataataaatctataacatgagttcccttaacattctcatgctcttgcaaataagaacataaccagttttccaagaagaccttaaagaaggggaatcacttagaagaaagagctggatagaaagaggagaccatatttttaaaacaaaagagcacttttactaaggtttttcaatcatgtaggtattaaagttttcacttggattgaaatcatacctaaaggtctgtgctaaacagaagaaatagtgcctgtcttggaaactgtagaatattcctcctgcttgaatatgaccatgcccgaacctagtaaagatggtgatcaaaggtgcttctattgcttttcttcttctaactctattgccttatattcaagcagcaaggctcaggaggctctcagaggtcttgccactagacaagcatgtagtctttataacccagtttctaaaaatacaatgggaatattctagttagtaactgatcatcaatccatactatttattgttctttccttatatagtcaaaataaaaatatggatgttagattatttacttgctctctcttaaacctaaaagaatttggggccagaaatcctggcagcttgacaatcatctaagaattaccatttagggaattctcagtgtttatgcaagcttggtgtgcgtattataaagattcctttgaaataattctctggtgctttggtcactaaaagtgtcagctctctgaaagattcactctcacagaagatgcattaaaacaatttgtgttcactataaatcttataattgaactgagaaagataccatagggacttttcttctgagatctgaaagatatataaggcctgtttggtgttggccctttgactgctattgtgggggatgggggatgtttctttcaaaacagtaaggaatgttgacatttttctctaatgttacagcaacttttagtatctcctgcaaccattccaatattgtaaggggtagagaaatagaggaggagttgaaaattagaagaaatggagagagccagatgtctaagcatttacaagttttgttcaaaactcatctcaaagtttaatacattctagaattttcttttctacccccaagtccctcccacacacacatacctgactaaccctagataatgcatataacaggaagtcaaaatgagaatcctgctcattttctgctaaggcttcaagacaacagatgccgagcgcttcaaattccaaagggaggtaatggcccctcaaagcaggatctgcaaggaggtaactgaaacctaccttggggaaccttaactaacttcagcctataaaagaggttggttaggtcaaagggaggcagaaatctgaggaaagatgtcattctgaattctatgtcttctgtgttttgaggaaggagaaatcttcacaccagatgagcaggagaagtttaatgaaaatcagctggagtccctgtccctctccctctccctctccctctccctctccctctccctctccctctccctcgtctccctctccctcgtctccctctccctctccctcctctccctctccctctccctctccctctccctctccctcgtctccctctccccacggtctccctctcatgcggagccgaagctggactgtactgctgccatctcggctcactgcaacctccctgcctgattctcctgcctcagtctgccgaatgcctgcaattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacgcctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcatctccgcccggccgccatcccatctaggaagtgaggagcgcctcttcccagccgccatcacatttaggaagtgaggagcgtctctgcccggccgcccatcgtctgaaatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccgccccgtctgagaagtgaggagcccctccgcccggcagctgccccgtctgagaagtgaggagcctctccgcccggcagccaccccatctgggaagtaaggagcgtctccgcccggcagccaccccggccgggagggaggtgggggggtcagccccccgcccggccagccgccccgtccgggaggtgaggggcgcctccgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggaatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagaaaatcagctggagacctcaacctgcatttttaagagtctgagggtcttattggattcatgcctagaacagttagagcctaaaggtataaggctgttgtccattggccactgagatgagtcctcaagaagaggtagctacattacaaatggcccacattcacagtttatgaaaagaaagaatgcacaagtatttcctgtacttttaatgtgattctcatgaaagagaatgccaacctaaagccatctaaagggacttgcctatgagggccatgtcaagaacaatggaaccctaaaaggagtctaccaagagccaacagtgaggccaagccctgccgacaggagaggaaatcgtctgtatcagggaaatccaggtgggagatgggtagcagagagtgggggatgctgaaaaactcgaagattcccaggaagaagaacgagcagtcagtgtaaacctaggctcaaagaaacaaggatcactgcattacgaaccccgaactctcttatctccctccacttcccccttcaatcccagaaaggtcagaatctgggaacagagccatgaatagagaaaagtccagccacaccctgttctacttgctggattcctacctgaaacaggcctgggttagagcaggggagaagctctcatctccattagtaacagaattttgatcagtacctaagactgaacattaattactgaaatgagactgttttaggcctagaattagctaggtcactctactgtttgaaagagaccaaaaagctttaatttcttacatcatccaaaaagcctgagaaagactgttctcacatagccaatctcaggggccaagctaggaaagattaaagctgttttctgattgtacccttcgagtctggctcatttgcacaaaggaggcacttgagattagcccttttcacgaaatacagtgggatgatgataatattactattacttcctcccattaaataatttccaaattagattatttttacctatgttcttggtgggggggcagggtgtggggagggaacttctctaaaactatcacaaccgtaagtggcccctgacacaagacatgcttgtattaactaaatctgtggacactgtgtgtccaaccctttaaattttcggctgctgatagaagagaaaaagcaaagaaaagatgtgaatgattcccattaggtggcatcccttctgaatgattcaaacaccggcaaaggcggcccagacaattcatcacactggcagcacctgctccagaggcccagaggtctctatctgtagaataaaaacacaggtgatgtttctcttatacccaccaccgggtttccagctcactctcatctccctcttggaactgactctccactccttttcttcagattaacatttaactgccatgattaatatgcttgtgccagcatttactcccatcctgactagtgctatgacagggcatatgcagcgccccaggtaagctttttcagagtcaatcatctaagaggctctaaattatttggcaattaagccatcactgtgttcccatagaactctggcattacaggtttgctacttgcagaaaatcagaaaaaaaaaaaaatacacacacacacacacacacacacacacacacaattaaatgcattccacccaagcagcacaatgaccaaacaaactacaatggacattcacagacagacatatgcaagctgcttacaggatccataggtggccccgccctccctcattccggcagcggctgtgcttgcttacctagccgtctgggcaccaggtgaaccggtttagctctgttctgctccttccacttctccaggttggccagctcctgctccgcaactaagccaggcgagaaatatcaaatcgtcaattattagacttctaaaagaaaaccagtcccttcaaagcataagaaacaactattagaaggcaattaactatatgtgagcatgagtgaacaaggcttccaggttagaaacacaatattcagccctgacccgtacaggtcatcctgggcccggccctgtggcacattctcaccaagagtcagcacagagggttcgaatttgaaaaaccacctgggctcctactaaaagaagtatagattttcctaccattctggcatttttaaaactctatatcaagttaatttttaaagttacctatagaaaatgtgtgcaaaactagaatattttcacgtcaataagaactttccacacataggtaaacatatccccagagaattctgatgcccatactcgctttatcttcaatgctcccaagcttactgcgactctagggaatgagggctcggtgctacaggtggagacccttgctctggtttcaggcactccagaccactgtgcagagtcggcttcctggggagcagggctcatttcctaaatgttcactctgcacgacagcagggggcgccagagagaaattagttctgtcactccagcgcctccccttatctcctcatgagacctgtttcaaatgtccattactagaaaaacaaattctgaaacatttcgaaatccagaccacattgagacttaatctcctattaagtatttaaatcaaaagcttgtaagataccagaactgctggcagttcccatagtccctgcatggctgtgattgtcatattctgcactgacccgctgtcccacccggagctacatgtccggtggagactctttagagagctttttcccttttgtgcctttctgtccatcattagtcatgaagttaaatttcctaccaatcatgtaataaaggagaccatcgaatttcagcatagccccacagctggacttgagcaagcctacaatttctttgtgaactaaatgaactttagttctcttccacctctaaaggataatgctataactttaaatggcagcatttatatttactgtacatcaattaaacatgttatgtacgcattaagtacagagagcacaaaaacgagtaagatgtggtccctaccctcaaggaggtttattggcaataagtgtaaagttgttcaagccaacagaaatccaggatctaccatcatgtcatgagttctgttactaacgtagagaaacaaacttagaagtgttaatagtagaatatttttaaaggtataatcaaaactaaaaaaaacaaaaaaccttgatgagatttggtgagtctatataaatgagaaaataaaaatacttcacaccaaaacaaaccaattgtaaaaagagagaagcattctgaatgttaaatgaatgactatacatacttctttgtatctcatttctccggtttatatttggtgctatcaaggtgtatgcacttgtgctaaaaggaagagaaaaaaaaatgcttattaccatgagaaactaccaatgcatataagccaccagatatttttccttctattatactgtatttatgatcattaccatcaaataggcactatgaaagataatcttcttaagaccctgatctgttctctgggacctcacaatcttgatgtcaaagtaaaacaaaggacatggccaaatatgaaaatataaagcattcgatgagtgacaagtgactagttggtgtactgtccttgtagggctccaccgttcctctaggtggtgcttgtgagtaaattcctttaagatggctttagattggcattctcttctgtgtgaccacaccggggtacaggaaacattggtacattttctgttcccacagactgatcctagaggccatttgcaatgcagccacctcctcttgatgatctgagtaactaactggcttttaggctttgacttttctaggcctatgtccactggtctcttcttctcctagggacacaggttgagcataatcaggggctcggagaagcaaggagtcatttcaaccaggcggatcagggaagactttttaagaaaaatattcacctctgtgacactaggaagctgttaaaatattgtgagcttttgagggcagagagtgtgcttgattgatgtgtattccaagcccctggcacagtgtctggcacaaagacattggctgcttgataaatgtgggctgaattaaaacaaaatgatgctacagacccagcctgtgagtctgtgtgggggtggctcttttttgagatgatgcacgtgatcccacaagaacatgaatactccattaagcaataatatagcacagcaacagactgcagcatacatgtaggtacagttttaagagaaatgctgtggataaacacaaccagcttctaactgtaggatttaagagggagggaaaaaaccccacccagatactcttggaagtctctctcttctacctgaatacacaatttcaaagggcaaattagcaaagattgaactgtagaggccaaaagcactgatcaacagaagccatttccttccttatctcattatttttctagcagctagccttcagccagcttcaaactgggctttaattttagacttgtaaatgtgaggtgtgcaacagcctttgcatgcaaatggggctgctggatgcccaattacttaatgtatatcagcagacgttgcatgtgtagcctagcatgcatacaacgttatgaatacaaaattaggagactgccactggcaattaatcccttgtccattgcacattctttgtacaccctaagaaacatttttcacttctgaattgccagtactttttaggagcttggaagctacaatcccgtgggtagtccctggaaacttgaatatgatgcaatggtgagccatgctacagagactgaaagctgaaacatcagatacgagacgtaaatgccaatcatgaaattgctacacaatcttcaatgtctgctaacattgtggtatagagcttctctctataccacaaatttgactatactccagatcagtagttctcagcctttatcgtgcatcataatcaccaggagggcttgtccgcgagcttgagagtttctaattcagtagcctgcgactgggtcaaataacttacatttttaacaagttccaagatgatgctgttcttgatctaggtaccacacttggaaaaccactactatagagcaatcaagctatcttagaacatttgggataaaagaaaacttaggtattcataaatcactggtaaagacacagaggttgaatctcaggccaaagatcaccaggtcaattgagcaacactgatgagactccagtctaagacttttgacttagatcagttttctgtctgcagctaacttttcaactcaatgtgcaaagcataaaatatgaccatcctttaactttagtcccttgatagacttccaaacaatgcaacctacttaactgggcacttattatggatttattgtattaggggcttgtagagagtgaggggagattccagaacagggatactaatcactttaacagaacttacactttagttaggaacaagtcaagaaaccacaaaagcaccccacgagaatatccaaccactcaacatgagttctggatggggaaaaaaacaaaaataaataaataaaaaataaattaaaaaagaatacccaaacaagtcttaaagtgggaatgatgtaagtactcagagatccaaaacagtggagattcatagagacctcagaagagtaaaaaactgaatagcacgaaataagaatagtaagttgaggcttaaagaataggatctgaaatagcaaaagtgtttctttgccaggactttgccaaaagcagcttcacagagaattttccaagtccatgagtctctcttacggaaattttgcaaaaggtttggagagaaaaatcaactcatttgtaaaagattgtattctacaatatctaatctggttaagtttttaagtccgacatcatactagaatcttccatcttaagaataggacttcagtcaatctatggccaatgtgtgtagcttacaggtacctaatagagaaacataaaataaagggaaagaattagctctgaatttagagggtttttactgaaagcattttagcataaacccaggcagtggtcccagtaataaacgttttatgtaaattttatgtgaattgctcagcaaccttctcagcaatattttattgactgaaaatgccaaatctgaaacatgttataatagtcccaagaaagcattgccaagtaaatggtaaggaacttagcttctatttctatttcttaatataagaagaagagcttaagtcaaaggatatgctttttattttttaatatcatgtgtcagagtgtaatgccttagtagatacaaatattcatcccttctttcttagctttctcttgacatgaagagcaagtataatttattaatgttttcagccaattagtttgtacccacagcaaaggcctttgctgttttaacctatgtgctatctcttccaacagcctgactctcaaagttgctaatctagacaagcccaacaaccaacatttcgcattcttgtcatttcctgattaagcaacattcaagccactgaaataaatatatatatttgaaaatgagtctccttaattacctcattgaaatttaatgaaagatctcaatttgtaagattattttcactttccaacagcgcacatccgtgagatatactgagggagaatatatgaaagaacagacaagataaaatgtttttctgcaccataagaaacataaaataaaaagatattcaagaaatgtttggccaagcgcggtggctcatgcctgtaatctcagcactttggggggctgaggcgggtggatcacttgaggtcaggagttcaagaccagcctggccaacatggtaaaaccctgtctctactaaaaatacaaaaattagccgggtgtgatagcacacgcctgtaatcccagctactcgggatgctgaggcaggagaatcgcttgatcccagggggcagaggttgcagtgagctgcgatcatgccactgcactccagcctggccgataacagtgaaactctgtctcaaaaaaaaagaaaaagaaaaagaaaagaaatgttttcctggccgggcgcggtggctcacgcctgtaatcccagcactttgggaggccagggcgggcggatcacgaggtcaggagattgagaccatcctggctaacacggtgaaaccccgtctctactaaaaatacaaaaaaaattagccgggcgtggtggtgggcgcctatagttccagctacttgggaggctgaggcaggagaatggcgtgaaccagggaggcggagcttgcagtgagccgagattgcgccactgcactcccgcctgggcgacagagcaagactccgtctcaaaaaaaaaaaaaaaagttttccttgcgaggtctctcgagttacacaactgcatcttgtgtgtacattcttgcacaatttttataactttttatcaataagtactctgaaaaaatgttatgttgaagttatcaaaaatatcttggctggctaaaagtattacataacaatatcccctggtgtgtacaaactgcaccagatgtaatttaaatttgtaattaggagcaacactggtttgacagaaaaagaaatgcagttaagagcaaaagttcggaaagagaaaattaagtgaaaaacataatttcaagcagaatagtagacatgtaaagtctacagtcctgcaaaaagttgaagttttcatagttcaagaaaatcttatccttgggtatatataaattgaaaaaaaaagacttagagataatcaaaggcatttcgatacttatctttccagataagacattccatattggtttttgttacatgaccttcaatgtaagaatcagaaacttactgttttcagtcaacattgagtcaaaacttttgaggcatttaggtttccaaaagtttgttcatacatagatcaaattcccaagaataatagaaaatgacaagaccaggccgagcgaattacccttgacccctaagcctatattataccacccctgatcaagtattccacatctccagtgtggaaacatttatgaattgtctttggcctcagaaactacagaggctaagatactgtctgcacacccaagaagctgatgtgtaattgattagttctttcatcagcacaactcattgcctctgttagacggctgaatacagacacagtgggtaaagacagataaataagcaggaaatcatcggggcctttgtttataggatgcctttaagaaaatgagaggcatacacacccaggatccccatggcttactgagatattgtaaattcatgcaaactagaaaaaaagtgctgcttctttcaggtggaggtaatcccacactaagatacatggtttggtatgtatctcagccacaaatcacaccttagctgggcaagtgtgtgtagtcaccaatctgcacaaccatatagaatcgacctgagatgatgtatttcttcacttaaacacacacacacacataagtaaaagccacacaaaaaaaagttagcaagaaggagtcacactaaagatataaagagtgtatatgaagtacaatattgtagagactcaccatctttaagaggccaaaaaccaatgatgggaccatcgttgagatggagaccaactggtaggtatacttacaaaatgtcttgtaactacttcctcagtaaaaataactgtcagaaattcatattttcagaacatagagatgtcaggtctgggatttgattggattccacttacaagctaataagttagcctgttactgtttcacagacactggcagaagacatgaaattcctggatcagagtcaaagactttattactgatggcacagtaggcagcatgagcaccagcttatttacatctattctctctggcctccagtcttatgatgggcgcaacaggatggatgctgcacacatggtgtgtttgcattgcagctgataaaatccttcgggaatacaccatttttacagcagatagtaagtgagcctggtctttgtcctgggagaacaaaccttatctctcaaggttcccagctaaataaataactctaagaaataggttaaagagtggtcttggcacatccaacaaaacgtaagtgtacctgaggccctagggggactctcttttccagcaagagaatatttagtattaacattcatattaagaatggcttaatgataaataaattgatattggcagaaaaaccacttacttatgaaatgtgctatatattttctcttcccattattattattaatagacttagaatggattatgtttctgtctcaagccttactcaaggttatctataacttaaaggaaaaaaccagaaatgcaagacatagtgatgtactccaaaatctgtacatagaacacttagaaatgaaattcatgttttctgattttgaaagaaacatacttgtaaaagaaaattcagaaaactattttaaaaacatttaaaagtcacatataatcccacctctcaaacaccacaattacaattttatttgggtgaatttacttttcatctatgctctatacatattattacacagttgcaaacatattttaagtacagctgtacatcctgctttcatttataagtggttttcctaatttgattatatatgtaacatgcttaattctcaatggctatgtagtatttcatgatattggtgcatcatataaccactcaactattgcaactgtttcaattattcactattataaataatcctacaggatgtacaaagcataatgctttcagcagaacattatccagaagaaaacactaacagtcctctgaattcaatactctgaacaggaatgtgggctacatttaaacttttcttccttagatatcctatttacatttcaaaaatctgagacaacataatcatatgattaatttccactcttatgtgtgacatcctttattctttaaccaaaagagatgtaggccctacccaacattcactctcacttcctccttgctaatagcacttctgtattattcagacagagaatgtgcccaattaaaagactacagccaccaaccttctgtatagttaggtaaaattatgtgattaagtttgagaaattgagacataagtggaagtcacggagagagatttctagaaagcctcctttaagtggtggtagacaaatagaaaaagctgttttgttactttccttcttcctggaaggttgatgtggtagctggtgctcaagcaaccatcttagtcaatgaggcaacctgaatatggaagacatgatcaggaatggcagagcagaaagtcagaagcagtctggtgctctgtgaccatgaaaacaccacatcagtggtaatccgttgctgtactgcccaacttcaaaccctaattctgttatttcctatctgtacaactttgagcagattattcagtttttctattttttcacctgtgaaatcgggataactatccacttcataggatataaagtgctgtgaaccctgaatatctgaggcaggcctcagttaatttataaagtttaaaggcctggtgtggtggctcatgcctgtaatcccagcactttgggaggccgtggcaggcagatcacgaggtcaggagatcgagaccatcctggctaacacggtgaaaccccatcactactaaaaatacaaaaaaaaattagctgggtgtagtggcgggcgcctgtagtcccagctacttgggaggctgaggcaggagaatggcgtgaacccgggaggcggagcttgcagtgagccaagatcacgccactgcactccagcctgggccacagagcgagactccatctcaaaaaaaaaaaagaaagtttattttgccaaggttgaggacgcacccatgacacagcttcaagaggccctgatgacatgtggtctaggtggtcagagtacagtttggttttagacattttaggaagacatgagacatcaaacaacatatgtaagatgaacattggtttagtccagaaaggcaggacaactggaagcaaaggtgggacaacgcatagcggggagggggcttccaggtcataataaataagagacaaacagttgcattcttttgagtttctgattcgcctttccaaagaaggcaatcagatatgcatttatctcagtgagcagagggctgactttgaatagaatgcaaggcaggtttgccctgagcagttcccagcttgacttttccctttagcttagtgatttggggaccccaggatttcttttcatttcacagttctgagaacaatgccagaaaataacaaatattctattatagttttccattatttgtattagatcatccctagactacctaccttcagacttattttatgggagagaaataaagaaagccatagatacttacttaagataactaaggggacatctattgcattgtatgtaattataacaactatatataacatatatgacatctattttatatgtaacaacttagccctgaatcactaggacatctcctttcttcatgctgtgactgattccctttgctgcatcttctttcataaatatatatcattaagttttttctaattatttctttatatccctgtttctggctcttccttttaacaactgtatcctggttcctgattctttcctttgaataataaggaccactgcatgaaacaaagtagtatttataaataatacatcttaaaaattagtacatattttttctcctgtaaatggtagcatgattctgagcccaggcttttttcattaaattatgtattaacgtataacgtaactacagaaaacggcacaaattttaagcatacagcttcataagaaaagttcttttacattctccaggttccaaaagagaaaaggaaaaaaataacaataggcacaatgagctttagaatatcacctaaaattgtatttcccccaatgttttaagaaattttaagccggtggggcacagtggcttatgcctgtaatcccagcactttgggagactgaggcgggtggatcacgaggtcaggagatggagaccatcctggctaacacggcgaagccccgtctctactaaaaatacaaaaaaaaaattagccgggcgtggtggcgggtgcctgtagtcccagctactcaggaggctgaggcaggagaatggcgtgaacccggaaggcggcggagcttgcagtgagccgatatcgcgccgctggactccagcctgggcgacagagggagactccgtctcaaaaaaaaaaaaaaaaaagaaaagaaaagaaattttaagcctaacaagcaaagttatatattattaaaatgaatatccatatactgtttacttatatttaccaactgttaatgttttcccacatttgctttttctcttttaaccatatgaaaataagctgcagggtcataacacatcatccctaaatattttagcatgtatctcctaaaaataaaaacagtctcctacttaaatataataccattatcacaccaagaaatttaacattaatattgcctaatagtctatattcaaatttccaaattgtttccattttaatattcttccctacctttacctcatcctagatccaattatggattacacatttctatggtttgacatgtgtttgtagactcctatgagctcagacaatttccttgactttttttttctttctttcatgactgacatatttgaagagttcaggtaacttttcttatagaatgcttcacaatctggatgtaaggaaaagattatttcctcatgattcgattaggttaaacatttttagaaagaatactagataagacatgttatccaagatgccactgtgagaacaaaggttgtttccttgtgcaactaaataataagccaaagtgaaaaacaagatccgtctatatgatggagtgcaatcacagtttaaaacaaagattagaaaaagagtatctgtcacattctattggcaatagaaatcaaagggcattgtattagtccattctcatgctgctaataaagacatacttgagactgggtgatttataaagaaaaagaggtttaatggactcacagttccacatggctggggaggcctcacaatcatggtggaaggcaaaggaggagcaaaggcacatcttacatggtggcaggcaagagagcacgtgcagaggaactgccctttataaaaccatcaggtctcataaaacttactcactttcgagaacagcacaggaaaaaacagcccccataattcaattacctcccatgggtccctcccacaatacatggtgattatgggagctacaattcaagatgagatttgggtggggacacagccaaaccatattaggcatcatggccctaggttttctacttggaataaagagtcaaagagtgcaatctgtactttagagatttctttacactaaactctttgaagtgtttatttctaagggtcagaattgcaggggactttcacattctgtattatttttgaaatgtttgagtttttataacaagcagatatgactttacttttataatcagagaaacatattctgaagatttttaatagagaaatatttaatataaagatttcttatagcaggggctcagcttttcttacaagattaggtagcataggtttctgctttcactagtaccatagtaaaacaaacaatgggcaatactagcccttgagttttaatgatggtaaacatcttcagtttttctacaggactttaatggattttcttttaagtcttcatatttgcagggggtgggggacagggaattacaaacattacagaacaaaggaaccatcatcagccgattctctgatatagaatagacccttcaaatgcagtcatctccctttgattattttctttcctcttaagcttttgtttcagattcaaatacattctgaatagatgcaattaaccttaatatgtataaccttacagcactctactgactttgaagtaagtaaccttactgtgtaattgaactaagtttctttctcatttctgctatggttctactgattattgttagtaatatgttttcaagctttcatcatcctgttgatttattgtttcaccgttccagctgccaaagactttttagcaattcccattcatttttggtgatattgtatttgaacaaaaatgattgctccccaaggcttggcagaccacaaatgcgtaccatactgaggaatggaatccagtgcagaaaagttggaaattccttctaaacaggaccataatttctaccgtcctgcacaaacaggaatgtaaatttgatctaatcaaaccaaaatgtttttttcttttcatccactctgtctcttctgccatgcatagaactgtgcttttcaaactgtaggaggtaaccctctaatgggttatgaaatcaattcagtggatttatttttaatgaacaagaatagaaactgtcagagtacatcacatataataaaggtgaaaattgttttgtgaaattttttcagttatatataccctaatatatactcagtcaggtactaggtcatgatgtcaaatgaattgctcactgcaggctatgatcagaagtctgaaaaaaaaatcactgtaagttactatgttgttgaggttgcacagtgagagtgagataactgctctaatgtcagaggtgtttgaaccagagagattccaccttgaataggggctgggtaaaataaagctaaaacctgctgggctgcattcccagacagttaaggcattctaagtcacaggatgagataggaggttggcacaagatacaggtcctaaagaccttgctgataagacagttttcagtaaagaagccagctaaaacccaccaaaaccaagatggcaacgagagtgacctctggttttcctcaaagctacactcccaccagcaccatgacagtttacaaatgccatggcaacatcaggaagttaccctagatggtctaaagaggggaagcatgaataacccaccccttgtttagcataaaattaagaaataaccataaaaatgggcaaccagcaagccttggggctgctctgcctatggagtagtcactctttattcctttactttcttaataaacttgctctcactttgctctatagacttgccctgaattatttcttgtgtaacatccaagaaccttctcttggggtccggatcaggaccccttgccagtaacactaacacaaggctaccaagctcacctgtcatttgtgaaaagcagcagaacaaagggaatccccagagaaacttttctcctgcaaagtacttctctattcaaatcattttaaagctatgatggggttcacgacatgttatcccaaaatatagcaccttggtatttgagaaaacagcaaaaggaggaaagcctctctgaccttctcccatctttttcccctgaagcaagccataaaaaatttctctgaccttcctctaaggtaggtcataatatcctcatttcagagggatcctccctcctccctaaacccataggaaagaagtggagacatagagacacaaagaatttgaacaaacaggacttgctaagcttccccagtttatgtcattagaccatactcctttttgaccaatcatacttctatatactatccactcttcatcaaacctaagcataaaaagacacagttttccctggttctttgaatcttcatttttggatgctcctatgtcctataaaacttatgttaaatgaatgggtatgcttttctcttgttaatctgtctttttttatagggatatcagccatgaacctagggataggtaaggaaagaaatcttcccctctctgcaactgtaaatgtcacattactgcttcgatattaccactctctttagcctatagaacttctcttttcttaatgtcaatataaaacaatgatagggctgggcgcagtggctcatgcctgtaatctcagcactttgggaggccaaggcaggtggatcacgaggtcagcagttcaagaccagcctggccaacatggtgaaaccacgtctctactaaaaatacaaaaattagccaggcatggtggtggacacctgtaatcccagctactcgagaggctgaggcaggggaatcgcttgaagccaggaggcggagtttgcagtgagctgagaccacgccattgtactccagcctgggcaacagagcgagactccatctcaaaaaaaaaaaaaaaaaaaaaaaaaacaatgataagaccttagctagctgtactatcaatccttctatctattctccatctgtacatcatattcaagatccaaaatttggtagatagacataggtttgaatactggttctgtcactcaaaaagccatgagatcttggaaaatcattttattttcaagactcagtttcctcatctttaaggtagcaaatggcttatcatgaaaagaatattcaataatgtacctgacatacttaacacaaggtctagcacatggctaatcatggaaaacacatgagctactaattgttattttggttttagtctctcaggggtacccagtttaatttttccagatcataactaatttactttatgctacaacaggattccaatgcttcattacatttctcatttcaaaaataagtcaaatagtagtagtattagtatctgataatcattgagacatctacccagctcattgagacatgtcattaggaagagttaaatactatctgttgctttataaactttctgcatgctagagattgacttaaataatcccctaatgaataaccatctatattgagccatcaagattactcattacaatcaatcacagatactatcttccaatgtactattatttcataacattaaaaggaactccagcattacccaattctccatctccagggaagaatactagactgatgcattcaggccacttagcatctataagcagaattttattctcataatcatatagagaaggaaattgaacatctgaacattgcagtgaggaagaaatagtgaaaacagttctaatatgctctaataagtttgttaaaacttgtacttcatttcagaatattttatgtggcttattcagatgcaaataatgtgagtcaaaatgacttaagttctgtctcagacataagaaaccatacttcaggattgcagaaaatagacactaaatagtgatattgataaaaatttaacactataacttagtgactttattattgtatatcccaccttgtattccatcttataattacaaaatactttacaaaatttaacaatgctttttaaggagaaaagagaaaaatcaggattggccatgatgaactgctcttatcaaaccatcatttattctccttttatctcccttgagagtttggggatgaagagaaggattacaaagattatttccttccctcaagcataacaaactggtgggacgcattaaggttggatcaaggaaattaggaaatgtttttctgggccctgaaggaggaaatgagaaaaagaatgggtttccccaatctgcatagacagcatgccaacaacagacataaataagatgtctaagtgttgaggttgcagtagggtgttttagagactgtattagtttgagtccttcagaagctgacaccaagatggggttagacaagcaagagatggataagggggaatgcttgtgaaggatgaaagtgggagcaggggtagggaaggaaagctttgagaacaagactaggtctgattactattgccaaaacctaaataaaagacagtgagagaggccctcccaaagaaaatcatatttattctggattgagcattgcaatgggaatacagtgggtatattcaagaaggcaaaggaagacaaaggttttttaaggaaaagtgaggaaaggagggtgatacaagttgtttgagacaaatatccttggctacaaaaatcaacaagggtagaatcagtccaaggctggacagacagttgctaggcagatgtccttgcagaagtactttttgtgtaaggttgtagcttttgtgcaaagttgtagtttttgcagagccttttgtgagagttcttgttatgaggcatatgtgcatgagaatcttcccttcatggccccagctccacgtgtttgacacaagtgacctcattttgagtctgacaactttcattctatgaaaggaccgaaggaaagaggattgagtagcaagatcctcagtgttatacagttctgagaaaatcttggacacgaatatggggagtcttccagcaaaagttgcctaatagaggagttctgcatgggccaggaataggctagcactaaaaccatcccaagaaaattgtataaaattgagcaagagaaaaacaaaacaataaaatccaaccgggcttgcagcagcaatcattaagccagcttgccctttggtccacttccttgtagctggttgttgctcactagcccagctttgagctgtccaatggacaaccccagattttctagcccctcaccctccatgaatccccttaaaaacccttgcccagaacccatggaagaaacaaacttgaggcttgagaattcctcctgtttcctcactgagaatgtcgcgatgattaaactctttctctgctgcaagtgccattgtcagtgtatgggtctgttgctgcccagagggcgtataagcctggcagtcctgcaacagcactggcaccctggaatgctcagccattggctgggatgggtgcagcacaagccagcactcacaggcaaggtgtaatggatccaaaagggtggcagctggggccgtcagctgactatgctccccactgtaagttcttctgaagacaatctgaataacaagtttctctggctgtccagaggccatttaaactcctgtgacataataaaaaataaatatttagccacggtccctggttcctgggacagagctccccaaacccttgggattcccagagtgctaagtgtcttttttatgctaatgtctgttggtgaggtccctagacagctagcttaagagactggtagctagaaaaaccagctatgcgattggggggttaaaactttcaacccctggccgggagcagtggctcacgcctgtaatcccagtactttgagaggtcgaggtgggtggatcacaaggtcaggagttcgagaccagcctggccaatatggtgaaacctcgtttctactaaaaatacaaaaaaattagccaggcatggtggcacatgcctgtaatcccagctacttgggaggctgaggcaggagaattgcttgaatctgggaggcagaggtggcagtgaactgagatcacgccactgcactacagcctgggtgacacagcaagattccatctcaaaaaaaaaaaaaaaaaaaaaaaaaaacaacttgcagccccatctcagtttctggggagaggcgggggctggagatttaatcaccaatggccactgatttaatcaattatgcctaggtaataaagcctcaataaaagttcttgaactataaggtttgggggtcttccaggttggcgaacacatcaaagtatctacctagagtatggaaactcttcacaccccaccacctaccccttcatctcccaaaagatgccttacgcatctcttccacttgactgagttgtatcctttatgataaacctgtaatcataaatatagtaatttctgcgagttttgtgagtcactctaatgaattatcaaaactggggaaggggagatgcatgggaacccccaactttgtagtctggtgggtagacatacaggtagcctggagactccatttgcagctagtgtctgaagtctgaagtggggggcagttttgtgggactgagcccttaatttgtggggtccacactaactctgagtagttagtgttagaattgaactgtgggacacctagttggggtcacagttagttggtgttagaatgacatatttgatgtcaggaaaaaaaaaaccacacaactcctaatgatcctgtagaccaaagctcaaacgtcacctctaaggaaagatcttcctgctcccaagaccagctgagaccccagctttccttgcaagcttgtccagcccagggcccacaaggtgcatgtagcccaggtggctcaggatggctttgaatgtggcccaacacaaattcataaactttcttaaaacattgaggtttttttgcgattttttttttaagctcatccactatgattagtgttagtgtattttgtgtggggccaagacgattcttcttcccatgtggccccaggaagccaaaagattggatacccctgctttaaagtatacatatttgttcacatattaataaatgtctgtcccatcaattagacagtaagcttcataagggcttattttgtgttgaatagttatttgttcctagtttttaattagttcttttaagctagagatcctctcattccatggtggttatgaggattgaaagagttagtatacatagtgtgcatttacatactagctactacgtaagtgctattattattattgctcatgttgaagtctctacaatactaatacgaagtaggccacaaaaatgttaagattaacataatttacatacaaattcagctcaagttaactgtaaaataaaattccatattataggttcattttcaaaatatatttttattttcttcaaacagcatcaagctaaaggaccaggtatggttagacaagtacatgaatgtgaattcaaccctatattaccagcacaggcaagaccccatttcccagaattggataaaactaggtaaatgcatgtctttgtcttatatttatctagaggtgatataaataatgtaaaatatttacaaacaagcagaatattaaaaggaaggataaaggtttactttggattagaagtttgtgtaagcttttttctcttttaatttgtgtagacagctttgatatttaaggacaagacaaaaatcaccaagtaaaaataattgggaaagccagtatgaattagtaaatacttataataacttaaatccaaattccatcaagaactcaatcttggccaggcgcggtggctcacgcctgtaatcccagcactttgggaggccgaggcaggcagatcacaaggtcaggagtttgagaccggcctggccaatgtggcgaaaccccgtctctactaaaaatacgaaaattagccaggcatggtggcatgtgcctgtggtaccagctgctcaggaggctgaggcagaggagtcgcttgaacacgggaggcagaggttgtggtgagctgagattgcgctgttgcactccagcctgagcgacagagcgagactctgtctcaaaaaaaaaaaaaaagaactcaatcttgtctgagagtctatcagaggtactcagaataatttaatatattgatagccacagatttttactagtatactttctttctatgcaaataggtggtttatttatttatttatttatttatttgagacagggtctcactctgttgcccaggctggagtacagtggtacaatcacagctcactgtagtcttggagctcctgagctcaagctatcctcctgcctcagcctcttgagtagctgggacagaggtatgtgccaccgtgcccagataatttaaatttttttttttttttttttttttttggagagacaagggactccctatgttactcctggactaaagcaatcctcccacattggctttccaaagtgctgaggttacaggcacaagcccctgcgcccgaccacaagtaggtgttttaaaccagtgtttttttttaacaaggcacaaacattcgacttaagggtgacagcatagtactttaccaggaataaagttatgttttacacatatacacgtggaaaaattaaaaccctatgaagttggtattgtcttatattaagtaatgaggaaactgaggcataaagtagctaaggattttgttcaaagagcaagtgatggcataatcagaacttgaacccaggtctacccagcatcagagcccatattcctaatccccacactggggctgcaggaggaaattaatggaaggattcccacaaaacaagacaaatcttttaccatataaataaattcacattatgagtggacaaatgaaactgtactattaaagcactttatcctcttttttcttttttttttttttttgctttttgttttgttttgttttgtttttgagacagagtctcactctgtcgcccaggctggagtgtagtggcgcgatctcggctcactgcaagctctgcctcccgggttcacgccattctcctgcctcagcctcccaagtagctgggactacaggcgcctgccaccatgcccagctaattttttgtatttttagtagagacggggtttcactgtgttagccaggatggtctccatctcctgacctcgtgatccgccctcctcggcctcccaaagtgctgggattacaggcgtgagacaccatgcccggcctcttcatttttttaaatcagaaagtgtttctaatttttatccccaaaataaataaagccttctttattttggggcagcgggtaggcagctaattctactgagatatttgccattcattttccttggttttccaacttcattaaaggaaacaagtgagaaagtgaatctaagtaactaatggagatgcaacaaaaattcaaagtcatcccaacaggatctcagacatcaaacccctaaaagggaatatataattctgtacttactgcaactggttcacatgaggaaaaaaaaaaaaaaaaaggaagactctgtgagagataactaaacacttcctggtatttttttaatggttcatttgaaaatcttttcaggaatcgcaaaatagtgtacagtgagctcttcagggtattaaggcctggataacccatcagaaagctgcctctttctgagcaatttgatctggcaagattccagggtaattacaaccaaataagaaaacagatgcaacagttaatacttatgcgatgatatgagcttagaaataaatggttgtatctaaataaatgctttttaacagaaaaaagtcatgcaaatcatgttcatcgttaactattcatggacacgagaccatatgtctgtgacctttgttactgttaagtactatagcttgtagatacgtgggttacttgaaagtaattggctgcttctactgtggcgagacactaattattctgaggaggaaagaaatgcaacaatctctaattgatttccagattatccaccccatctaagggtaaacctaagctaaataataatattaaaggcctggtactttccaaaagctaagggatgaaagaaaatctactgtttatcggccataaggttatatactgtttcttagcaaccagggtttgtctttcagagactagaagtcgatgaaaaaggagagactaaaaataaaaccatctggacagttccaattcacagaggcagcacttcaaaggcagtgatgttgtgataaaccatactgttgagttaaagttcattccattggctagaaagagaggctcatgacacttgcttaataaatgtttcccggatactcactgcagtccctgaaccaaagaccaggaataaaagctacctatctgttcctgcatagagcacatatcaacatcagggatgagaggtactatggtcactcacctcctcactctctcagctccactcctctggttgtaagaggctagtttatctgcgagtcttgctgggacgtaggcttgctcctacctagaggcagaatttgaaccttctaccccatatcacatttcttgttgacccttacctgttagtgtctgatacagtaattccgtttaggacaccaagttttgtttttctgttttgttttgttttgagacagtctcgctctgttgcccaggctggagtgcaatggcgcaatttccgctcactgcaacctccgcctcccgggttcaagcgattctcctacctcagcctcccaggtagctgggactacaggcacgtgccatcacacccagcttattttttatttttagtaaagactgggtttcaccatgttggccaggctggtttcgaactcctgacctcaggtgatctgcctgccttggcctcccaaagtgctgggataacaggcttgagccaacgcgcctggcccagcaccaaatttttaaaaacagtaagggaaaagttatttccatactggttggagtatgagttctggagatacctggaaaatgacatcttactggatgcctaggcagttccgacacacccatatctttcaatcctgtagccagtcacaaaaatcaggaaagtagtattcctggaaggaaccgggctggttatttaccaaaggactgcaaactagccgactcaatttataaggtgcggcatggatactttcatttaagcaaatgagctttcattcagtcaaaatccctgttgttgggcccctgtggttttaaactccaaggaccaaggtgcttgtgagtgagtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggtttt

SEQ ID NO: 1431 - DNA, 105885 bp, Homo sapiens; identical to SEQ ID NO: 1430

SEQ ID NO: 1432 - DNA, 11260 bp, Homo sapiens
cgggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcgggtaagcgcggccgcgagtttcccactccagagccccgccgggccgcctggctcctctctgcttcttttctttttcttttctgcctgaactcgtctgcctgggtacctttaggagaagagagaggcccaatccaagggcgagatgcgatggacgcggtcggctggactcggtggggcccagaggatgggatgggcagtaggagttggagcaggtcctgcacgccagagctcgctctcctgaagggaggcgaggaggccagggggccttttccagaagtttgaactctgaataatgcaagtatatcatacatacaccaggactagttgagaaggctgctttggagcgggccggcgcctctcagcctcaactcaagttcagagggattgggtgacttaacccgaagctgcactcctagttagtgacaccaccaagaccaaaagccaggttcctttccagatcattttccaccacccgccttggctctgagactggcctttgtgagggaaactccattcctcaaatactttgctctcatcggaagccgaggacagacactccgtgaagatttgggaaagcttttctgaaaccttacactcaccccttcctctcttgctaaaccaacacctagtcccatccctggtgccctcgcccccccccgccccccccccactcctcaatacagtgtttctctgccatttgctttcatttgttctgtttgagggggtacatttccctctgctctgatttatgaacacttgaactttgcctggtgtggtggttgggagtgggcgttttaaagatgatgttaactattggaaagttcatagaaatggtaccaagccaagtgccagtggctcacgcctgtaatcccagcactttggaaggcctagactggaggatcgcatgagcacaggagttcgagaccagcctgggctgttagtgagaccctgtctctacaaaatacatacatacatatatacatacatacatacaaaaaattagacaagtgtggtcgtgcgtgcctgtagtcccagctactcaggagcctgaggcaggaggatcacttgaccctaggagaggtcaaggcttcagtgagctgtgttctcactgctgtactccagcctggtcaacagagtgagaccctatctcagaaaaaaaaaaaaaaagtacgaaaattactctgttcaatcattacaggtgttaagaagcacagtctgcagtacagcattagaatgggagctggtttagggttagaggacacctgaggccacccttcattctacagtccctacactgaagcccatggagggtatagctacctggctggtagcagagtggttggggggatcacaggtctactgtctgtctgccaggtagtgctcttgtcatttatagcttgttacataagaaagagtagtaaataattgtaacctataactcattcatttaagagcacatttctgtccctcagacaggagaataactgtatgcaactcagttgctcagaaaaaaggagtaatcagccagggactcagctttttgttgttgttttttgttaccaaaaaccaaaagttcgtttgaaaagtcatctttgaagccagaagttttttcgaaacacttcctgccgttgcacagaaccctaatgagcagtatttctgcttcttgacaaagtcatggattctaaaggttgccttaccatgtgacggtcattctccaggaatctgcagcatagctgaggtttttcacaaagatggttttaaaaccttgcttacaagggtgattgaccttgccttactctttatgtaaattatggcattttgttattaaactacgattgggtcccactgctggtaaatcagtatgagtaactagatttttaagtgtttatagttagaaacttgagaaagtaaaagcaggagtaagatacaaattttctttctggtatcacctcttctttttttattaatcacagacctcgaatgacaggaaggggtcatatctagttttttatcagactctgataaacatctgcctagatgggatatccttgtacttttcactaaatccaaagcttgagttttgccaggaaggaaaacaaaagtttaagatctccaaaagggatttctggatgttagatattgtttcaacaggtattgttgtcccatacagcaagtacagaccagcaatttacaaaattagaggtaaatttatagaaattattaggctcacattataagtaagattttcagagatagaattttaatatctctgaatatgagggagaaaaatagcttagtgagagaccaaaaacaaaaaaaaaacaaaaaaaactgttttagagaccaaaaaaagcaaaacaaaacaaaaaatccttagcctaaagtttggagagctacattactaactgtttgatttgaatatttgagctactagtgaatctcagctcataccatttgaattaagtaatgatgatgtaatgaaggcaaactgatggctgctccacaaacttcccccagggctaagcatacttgccttatgtagtaacaaagttggatcatatttaattctcaaataatagaaatattctttgattgcacaatagtagatagagccagctacttgccataactaagttaaggtgtggtgtttttactagttaggttttttttttttttttttttttggttgcttcagtgagagggcgaggtagtgaagaaattatgacgaatctctatgcttgaaagctgtggcaagtatgataggctagaattatcaaatgttttctacacatgtagctaagcagattcagctgaactcttcaggttaagaaccactgtgatcctcagatacacaaatctgttcttacggcattgaaggaatctggctttaaaatacagatgcagtttagtgcagtttttgtgttagacaattgccatctcttaactcacacgtactttaggactgctgctcaaaacataactgaaatatactaaaatcttgaagtctttgataacactttacagagatcttaataaatgcatactcaagatatagcaagagatgtctctgatcttccttttaatgctcagtgtaggtaaagtagtatttggtttactattatatgcttattgcttattagtcactatagcatttttcaggcaaattgaaagactggtctaggttaaatcttaaaaaaacaagtttgtccatttaggtctagtatactttagccttcatgtattgactgagtgatttgctttttaggatcaacattttttaataaaaatctgaatgagtaactctcctttgggccaaaggacaaattgggaacagtctgctctgaagttcatataaataatatttacccaagcataaaatgtgtgcttggaagatataaactatataatttatgcctaaacttattttacattgttttgattcccatccaaaatagaatgtggatcctgattgccttgctgcatcttatactttgtcgattagtatacctagtaatatccctttgtcttttttttcacaactctcctatcatctttcatgagcacgagtaaaaggaaatacttgaaatttacagatgattcacaaaaaaaaaaaaaaaaaagcaacagtcactaaagtttaacaactctttgttaacttctaggtttctaactgttcttttactcatttgtcaccccactctcttttctaaattaaagatatagtccaaaggaatagtttattaccatgtaattatcttgaaatcttactttttcaatttcctaatttaagactgtcatatcttgttgcttagtcttttcatattcaataattaaaatatataaaaatggaagtggttggtaatgtgtgcactgcatttgaaattggagtctgaatcatttcaatgcatatagtctttctgcagaatagcgattttgaacagttggcatatcatgtaagtttttataaatgtcagcattatgagccaatgaactatataatggtcagatttacatcacaataaaatatgagcataatagtagggtttcatatgtgaccatttgttacagtaaaatttagacctttggactattacagtacagcttcagttaaaccatatgaggagtcatcacaaaacaaaccttaaatttatgcattcacgtttgaccattgttttattcttcttccattattccctaaaacaatatataaaattatattgcattgtagagtttggagaaggaagaattttatattttggggtatctttgcatctgtgcagagaaaatgtgtcaataaaatgtagataaagcctgttgctcatgtgtttcaagaagaaagtgtctttatcatagaacagagtgatacatcttagatgtgcattgattgccaatcatttttccttcacactgtagtcagtaactaagtcaaggcaactgcaagatagttcagaaaggctagcatcccacttctataggtgtgtgggagtcagaagacctggattctagtcctgtcttctttagtcagtgccactataatcctggccaagcatccattttcctgttgttacatctgtcagatgaaaagaagggtctttcctatgccaaagattagtacaatagcagatagtaagagaacgctttgcaaagtcctatataatgtacaaagcagatttttcccaaagtgtttgacataaattattttaaaagtacaatgacatttgaagaaccctggaattgattcttcttgtaacaacacaaccagttgtgccttttgttctgaaacagattttcatgtatctactacttacaggggtgaaatcttgcatattgagtcagaagtgggtatgggctagagatatgaaggagagatgagttgagaacatgaactactttatctcatgtccagccctaatctatttgactagcatgttacccactgcacttatctccttcctgcaggcttcatttcttctattcttgtctcttcttcctctacttccagctttatgttttcctttagtgcctctcttctcttagactaaggggagacgagtcggaataaatgacagactttgtagctttaaatattgtcatattggtttttatggagaatatgttgtacagaacataaaactaattcattatgtacttaaaccaaattatcagacacatctgctctatgggtcatggtctgtatggatagccttaatcacaccaggttatattgctgtggaatggaagacatttgttcatagtgttgctcttggggtaaaaggggttatacctaaatgtagactctgtctgaattacaagtttttaattttttcttatatttatgtctagggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggtgagatctgctttgcttatgcatcttttgctttctagctcataattctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctattgggtgatttgctctacttgccagctttgctgtaaaaagacgaaaaaaaaaaaaggggcagtaagtataactgcttatgcgagtgtgcattttggtggaggagttttataaatgatagacaaaattcccctttaggctctatttaatctttcagatagtaaatccagatttgcccccagatgtaagacgtcatgtgactagtagcttgtgactgtgtaagtcatcggtttcactttatgtatggataggattacacgcagaggtgaaaggtgaaacgctggttaagagtacaagtttcaagtttgctctgtgcttccatacaaatataatagaagcagcttctgtagaatttccttagcagtaaaccagacgtgttccaagagaataacagtaataaaaaaatttaggttaaaaatcttagagttaaggcttaaagtactgcctaaatgtcactaaggtacacttctgagctggcctgcagctaacttcagatctgacttttgcttgaattgcagtcatccgaatttcactaggaacataggcaaaagataacttttgcaaataaatttcatcatttcacctttatggcaaataatggatttctaatatgaaactttaataatattaacatatgggaattacattaacatgtgactagttacactatcattggaattttaaccaactgcttccaaatacagttagagaattttataattatttgatataatggggatagctgggactgaatgtcacttggacattcaaaagatcaatacttgaattaaagttaacacttatcttgggagtggaggtaaaaaataaataaaaagcttgtttcagtgctatgaaagatgcctgtaaatagcacagctgttttaggtttcttgttgtctgagaaagggtttacaaataaggaaaaaggctacaatgaacctcatagcattggattggattagacattaatatgagcttcaggtttcatatgtgtgtgtgtgtaagagtatatgcatatatatatgtgagtgtgtatagatatatgtatgtacacacacatatgtgtaaacagataaagaagttgatacagatgcatgtgtgtatacatacgtttatttactagccatacctgctgagagggcttaaaaggaatgacaccacagaaccaattaacttacctcgtgctcaaaattcggtttttaaatatcattctccagtaaaaagaatgggaatctctagagaaatgcctgattttaggacgggtggaacaagtcaagtaaagatgtgcctgagatattttgttgtgcaagaaactaaggaaatgcttacaaaatgatggggacatgtgacaaagatacaggatactgccatacaagctccaaacatgtaagacaatttgagcaacaaactaaataattactgtaatgggttcaacttatagagtaaactaataatccatgataaaaatgaacaaatgaataaagaaatgggggagaagggaacctctttctttttttatttttatttttttattatacttttaagttttagggtacatgtgcacaacgtgcaggttagtcacgtatgtatacatgtgtggaacctctttctaacagtagaattccagctaataaatgtagaaggaatggcagaaataaaaaagtcaccattaaacaccacagtgatgattgttgtagggaggaattaattgatgataacattagtggggaaaagtgcggtgagaaacaggatatttacatatttgcactaagtacaaagggaaaaataataacttttctgtggagaaacatggcaaaaacaacttgaagcagtgtgcttcctgataaactgtgcagggtacatcacttgtgttttatttctgccaaaaatacatacgttgaatttaatgataaggaaacatcgaacatcacagatggaggtatattcaccggccagtgctctctgagagtgtcaaggtcatgaaaagcaaggagagtgaggaactgttcgagagtaaaagagaccagggcgacaacagtgaaatatagcttatgatcctggatctgaaatagggcattgagataattgatgcaatttgagtaagctttttaggctagcactgatacaacactattatgtaatttcctgattttgatagttgtattctggttatctaagatgttaacatttgagaaatatgtgtgaatggtaggaatgtttactttttttgcaatgtttttgtaaatccaaaattatttaaaaatgaacagttaaatatatttaaaaataagcacagtttttgcaatgtgttacctactgtatatttaatgataacttataattcagtcgcacaaatgctgtgacggctaataattccttagggtgtccttaatggacattgcactgacaacattgtttcaggctaatttatacatgacaactaaaaggaataattggtacttagagatggaaaaatgacatgatacatttatcacattttaatgttgtttgagccctttcagtttttttcacagtgtatcctgactgcttgaattagatattcaagggcaggaatttttttatttggaatgtcttcattatatgaattgcagcccagagcaaagattcattttcaaccgtcgagatagctcatggaacctcagtggcaaaggtttaagataggaacatcagaaaaggtgtccttcataaaaataagggaattctttccatcaccacattattctttaacattcaactctaagtgggcacacactttagtattagaggaaagtggctgtgcacttgctgccacctctaacaaattttcctggtcccattcatactcttaatgccttattctaagaattaatcctaaaaattaatcccgttcttcatttctgcattacaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacct

SEQ ID NO: 1433 - DNA, 26084 bp, Homo sapiens
cggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggtgagcgggccgcgctggggagggcttaggcactggcactgccccagccccagccagccgcggggctcagcctgggcaggggctagacccccggggagaggcgaaattggctggaaaatcacagctgatgacagggcgagtagctggtgggatcgagaagcggggggtcttgggcagccccaccccgaaaaaagggctcagcctgcgggttcagggggtgggtcgcagatatccggtaggagctcggccccaggaggacaaagttctggggcgagccctctttcctgggcccttggagacagtgtgggtgcgttcgcgtccagtccgcagagccatggttcctggacagcgatttccggtgctgtccagagtgctgacagagcggaccccggctgggggtagccatgggggacagaggttcgatgcgggccccatgcctctcctcagtgcccggctcagagccgactcgaggcgggcggactccaggatgatccactctgtctgtctgttgcttttctctaggaacctgctagaccttgataccttctccaagtccgaccccagtaggcggctccaggaccgggagggggaacttggggtctgggcgcgactcaggggcgggtggagtcggggccaggggtgggagccgacctgacgtccttccctccccgcccccacctgcagtggtggtgctttacacgcagagccgggccagccaggagtggcgggaggtgagtcccagagccccctcccggcccagggcgtcgcccgggaattcccctgcccgtctgcacgtcccacgctgaccctccacccccctacccagttcggacggaccgaggtgattgataacacgctgaacccagacttcgtgcgcaaattcgtcctcgactatttctttgaggaaaagcaaaatctgcgcttcgatgtgtgaggccccgcctggaattctggcttggcccgcccccgacctggatccgcccggaattctggctggccccacccccgcctcgcctccggcctggttcttctcgcaggcctccctcccattctgaatggccccctctagcctgagccctgcccttttatgagatgcggtccagttccgtcccccgctctggccccgcccacaactctgctcctatcgcagctccacctcaggcccgaccccttccacacaaccctgcccccagcagcccctgacttggcctcggcccaggcttgaccgtctgactactcagcccaccctgactcctccccaaaaggagaccaaagctgaattcgggtccacggccgcccatccctccacccaaaattttcaccaagactcggtgcccgacccctttccaccctctcccccacccagccccaccccacaccggttccactcttttcccaggtacaacgtggactccaaaaccaacatctccaaaccggtgagcaaacgtttcctcgagggttggcggagcgcacaggaggcacttagatgtgttcaacgactctcagaactcctcccaaccctcgacccagaccccatcttcttcaggcccccaacccaccctcctggtccctctcctcctgcctgagtgtcctgcctgtgccccctactcactgttcctcttccttcttggctgccactgctgggacctgcagaaggtgaggctgaatggggctgggcagaggttgggggtgggggtggtattgtggagaacaggcttggactgatgacccactacaaggcagagattgctcgcagaccccttctttcacaccccctccattaaagcccatgtagggccgtggctcttgcaccactcattcgcctgggaactgccctggtcctgtgcaggagcatcactggggctaggctgggactcagcactcaagagcttctggtcttgctgactccttgtcctgcataggatttcctgggacaagcgttcctggccctgggagaggtgattggaggccagggcagccgagtagagcgaaccctcacgtaagctgaataggaaggggtgtgggagtggggtgggggcttccaaattctccctcccaaggatgccgctgactgatagaagtggaggctggggttgcccctggtcaggagcctgccccggctcccatcaccctcgtagaaaagtccaatttccagtgctctgcccgagtcagtatcaggcctgatatgtcttttcttttcttttttttttttctctctctctctctgtttctctctctctctcctcactctttttctaagtctgattcagcctttaaggtccacttccaagcccctctccacagggaagctcccccggactaagtcaaatcctcaggaattaccattacatccactcactaaatatgcattagcatgttttatatcccacaccctgttctaggcaccagggcttcattcattccacaaacactatgtatacataccctatgtcagccactgttaaaggggattagcttgcaatggtgaacaaaacaaaggttcttgtcctcagggggctgatactctagttgtgtggggaggacagtacaaaatagacataagtaaattacataatagattagacaatattaagtgctatggggaaagagacgaagtagagcagaatcaacggaactggaaataatgggtgagtgggaggtgcaggattcaacagtgcggttgagcaggcctcacggacaggtaactttggagcaacaacctgagggaggtaaggtacagacatgtggaggaagaatgttccaggcagaggagactgccagtgcaaaagcctggtgcattcaaagaacagcaaggaggccagcaagactggagccaggtgactgggaggcaggaggaagtgaggttgaagagctaacagggccttgcagcggacttccacctttcctctgaaacgggagtcactggagggttctgagcggaggagtgacatgacatggcggcttacaaaagatggtgctagctgtggggttaagaataaaccttgggggccaggcgcggtggctcacacctgtaatcccagcactttgggaggctgaggcaggcggatcacgaggtcaggagatcgagaccatcctggctaacacggtgaaaccctgtctctactaaaaatacaaaaacttagctaggcatggtggtgggtgcctgtagtcccagctgcttgggaggctgagggaggagaatggcgtgaacctgggaggtggagcttgcagtgagctgagattgtgccactgcactccagcctgggcaacagagcgagattctgtctcaaaaaaaaaaaaaaaaaaaaaaagaataaaccttgggtggccaaaggtagaagcagagagccaatgagaagactctgacagtaatccaggatgctaccagtgaaggaggggagaagtggtcagattcaggatatattttaaaggtggagctaacaggttcctgacagattgaatatgaatgtgagaggaaaagaggagttgaggacaacaccaagatctttggcttgaacaacaggaaagatggaattgacacaaactgagatagtagggaaaaaaacaaaggaaagccaggcatggtggtgtgcacttgtagtcccagctacttgggaggctgaggtgggaggatcacttgagcccaggagtttaaactcctgggctcaagcctgggtgacaccccaagctgggtgacagagtgagactgtctgtggacaaaaaagacaaaaaaaaaaaaaaaaacgtgaaggagaagcaagttggaggaggaattcaatcaagagttcaatctgacatgttgaattttatgttttataaacatataaaatgttagacatccaagtggaggtatcaaatgagtcttggatgttggttttgttgttgttttttcaagacaggctctcactctgtagcccaggctggagcgcgatggtgcaatggtagctcactgcagcctccagttcctgggctcaaggaatactcccacttaaaccttccaagaagccaggtagctggaactacaagtggatgccagcagccccagctaatttttaaattattttttgtagaaacagggggcctcattgtgtttttcaggctggtcttgaactcctgacatcaagtagtcctcctgccttggcctcccaaagtgctgggattataggcatgagccactgagcccggccttagatgttaactttaaagccatgctattagatgagatcaccaaaggaggggaggaaggacgggagaaaaagagagaaagagggagacgagagagagagaaccaaaggccaaggctccacaaattggacctagaaaagaagactgagaaggagcaattaatgaagtaggagaagaaccaagagagggtgatgtcatggaagcaaagagaagggttatcaagaaggagagagttaccaaccacatcaaatgctgctacagctcaaataagatgaagattgggaattggccattgcatttagcaagatgaaaatccctgttgactcttaagcacagttttgaaggagaggtggaggtgaagacaatggaagagcgggaaaggagtcaaggaatcttttttttgagacggagtctcgctctgtcacccagctggagtgcagtggggagatctcggctcactgcaagctccgcctcccgggttcacgccattctcctgcctcagcctccggagtagctgggactacaggcacccgccaccatgcccggctaattttttttgtatttttagtagagatggggtttcaccgtgttagccaggttggtctcgatctcctgacctcatgatccgcccgcctcggcctcccaaagtactgggattacaggcgtgagccaccgcacccggcccaagtcaaggaaactttcaaggagttttacagcaaaggggagaaaagaaaagatgtgtgaccaggggcggtggttcacacctgtaatcccagcactttgggaggccgaggtgggtggctcacttgaggtccagagttccagaccagcctggccaaaatagtgaaatcccatctctactaaaaatacaaaaaacttagctgggagtggtggcgcacgcttgtaatcccagctactcagaaggctgaggcagtaaaatcgcctgaacccgggaggcggaggttgcagtgagccgagatcacgctactgcactccagcctgggcaacagagggagactccatctcaaaaaaaaaaaaacaaagaaaaaagaaagaaaagaaaagaaaaagagatgtggctgaagcaggaagagaggtcaagaataagtttataatttttttttttttttttgagacagagtctcactctgtcgcccaggctggagtgcagtggtgtggtgtgatcttggcccactgcaacctctgctgcccgggttcaagcgattctcctgcctcagcctcccgagtagcttggattacaggcgcctgccaccgcgcccagccaatttttgtagtttttagtagagacggggtttcgccaccgtggccaggctggtcttgaacgccttacctcgtgatccacccaccttggcctcccaaagtgctgggattacagacgtgagctgccacgcctagccaagtttataattttttaacataaggctgggtgaggtggctcacacctgtaatccgagcactttaggaggccgaggcctcctaaaggtggaggcaggtgtatcacctgaggtcaggagttcaagaccagcctggccaacatggcgaaactctgtctctactaaaaatacaaaaattaactgggcatggtggagcgtgcctgtaatcccagctactagggaggatgaggcaggagaatcacttgaacccaggtggcaaaggttgcagtgagccgagatcacaccattgcactccagcctgggcgacaaagcaagactccatctcaaaaaaaaaaaaaaaagaaaaaaaaaatttaacatgagataaattatactacattggccgggcatagtgtaatcccagctactctggaggctgaggtgagagaatcacttgagcccagttcaggatcagcctgggcaacatagtgagactccatctctacaaaaaaaaagggaaaattatactacatttacatattgatgggaatgaccaagtagaaactgaaaacttgatgtaataaaaagaggtgagcattactgaagtgatgttctcgtgcagacaagacagtatgaaatatagtacacagtggagggataaataggcacaaagacacttcatttatagcaactgtaggagtcacacttgtgtgggtgaagatactggtggcaaggtaggtgtggtggtgggtggacattctcttctggttgcttcaattttgttcagtgagtaggaaacaaggtcattggctgagaatgaggatgggggaggaggctttaggggttgaggagaaagaaggagtgaaactgccatctaccagaactggagagtgaagggccttgggatgtacagtatgactctgaggtagcaataaggaccctcttgaagtctgcatcatgcatttgaaatgagacaagttcgcataattgtgtttttgtctggccatgttcagtttcacaggtgcagtgtgggttaggcagagtgaggcttaactagagctgtggttctgccaagtaaatatatcgaaagtgagagaaaagattgggccagtggctcacgcctgtaatcaaagcactttgggaggctgaggcaggaggatctcttgaggccaggagttcaagaccagtctgggtaacatagccagaccttgtctctaaaaaagtaaaaattttaaaattagccaggtgtagtgtgtgcacttgtagtctcggctacttgagaggctgatgtgggaggatctcttgagtccaggaatttgaggctgcagtgagctatgattgtgccactgtactccagcctgggtaatagtgagaccccaactcttaaaaaaaagtgagagaagggaaaaaagagacaggatgcaagggaatgattattataatcactgactggaattcacactggatggatgaggtggtaagggagaacatcaaagaggcaaagaacagtgaggaggcaacaggatcaacaatttgttggtcctggatgtgcaagcgaattatttatttatttttttgagacagagtcttactctgtcacccaggctggagtgcaagggcttgatctcagctcactgcaaactctgcttcccgggttcaagcgattctcctccctcagcctcccgagtagctggcattacaggcgcccgccaccacgcccagctaattttttcttttttttttttgcagttttagaagagatggggtttcaccatgttggtcaggctggtctcgagctcccgacctcaggtgatccgcccgcctaggcctcccaaagtgctgggattataggcgtgagccatcgcgcccagccgtaggcgaatagaacctattctcatcacactccctctttgcaaagcacaaagagtcaaagatcaaaggagccaaagaaatagttcaactctcattctaaggatagggaaaatcacatagcaagttagagccaggactggaacccaggaccctcctgacctagttttctctctgccacattttggatccctttgggaatcagggttcacaggcccctatcaacaaggtctcttactgctggggatgggggttctcgtatgcaccattcaagcacatggaagtgttccttctagggtcaggaaaggataaagtttcccttgtcttttaaatctccctctccatggtcttcagaaagcacatcagctttgacctaacaagctagcccttttgtccctgggtctggacagaaattcttctccctcattcagtatcactacaatccactctacttacctattggcattgacattccacctacccccgcccccaaagctccctgcgggcagtctagcagagccggagagagccagttgcccaattcatatctatcacagcacccagcatatagtaagaaccagagtcagctttgaagactacaaccagctcatatctataaggcttacgagttgcttttccttccatgcactcattcagatctgttcacagccctgacaagtcatcatgattcccatttcatagagaaaaagactaaggccgaggaagggtaaataacttgcccagggtcacacagcttaacaatcataaaatccactggctctaaatcccatgtctttctcatgctactgttgtgagatgttcacctaagctgttctaaccccttttcaccagactgcagaccccacccagtcaaagtgaggcccttcctcaccagaaggcactcaagacacaagggactgtcagtaaatggcaaactgaatcccctggcccacctaaccccagactggccactcaatccttgttgcctaccctccctcctctcactaagaggctttttctgcttccaggggtgtaccaggcaagaagtgtgggaccatattgctgactgcagaagagcttagcaattgtcgggtcagtaagggccacatgctagacccaggagctcccttctctccccgtaaaccctttaatggactgtctgaaggctatggacaattggggtgccaccagcccaacttcatccatccctaggacattgccaccatgcagctgtgtgcaaacaagctggacaagaaggacttctttgggaaatcagaccccttccttgtgttctacaggagcaatgaggatggcacgtgagtcactgccatcagggctgttaggctggggtgggccatgtgcttaacaagtgggggaatctcaggaatctctgagagcatctggattcagtcctaccccgggcacgagataaattataccaattcttcccactcccctccaggttcaccatctgccacaagacagaggttgtgaaaaacacgctgaatcctgtgtggcagcccttcagcatccctgtgcgggctctgtgcaatggagactatgacaggttggctccagcataagctggggagtaaggagccaaggacatgccagtgtggttcctgggcccaagaatgatagtagaagtatcataatagcgttggagggtcctgctcagtgagacagagtttggggcatgaggttgggtggatggacaggcagatggatagccacacagatggataggtggactatccagggatggatcgactgatggatggaatggtaggtggatgggtagatgaaaaggcagatgaacaaatgaataagcagatacatggatggatcgttggatgggtaaactggtgaatggttggatatgtatgtggatggatatatgagtgaattgatgggtgggtagaggggcagataaatgaatggacagcagaagaatggataattggactgatgggtgggtttgtggatatacaggtgatgggtgattaacggatgaatgagctgatggatgggtgggtgataaattggtaaatgagagtttgatggatgactggggaggcaggaggatgaatagaaaagcaggtggaatacaaaaagataggtagagtgacaagtggattgatggttggatagatgaatagatggcaaatggatgaacggatggatttgtaggtgaattagttgatggatgggtataaattagatggataggccaaccaaatgaatgagtaaatgggtagtataaagacagatggtaggggccgggcgcggtggctcacacatgtaatcccagcactttgggaggccgagacgggcagatcacgaggtcaggagatcgagaccatcctggctaacacggtgaaaccccatctctactaaaaatacaaaaaaaattagccgggcgtggtggtgggcgcctgtagttccagctactcaggaggctgaggcaggagaatggcatgaacctgggaagtggagcttacagtgagccgagatcacgccactgcactccagcctgggcgacagagcaagactccgtctcaataaataaataaataaataaataataaagataggtggtaggtggaagggtggaagaatggatgggcacatagatgagtagatgaatggttatgctgatgaatggataaccagatggatagatgttatatagttggtagacagacagacagatggatgcttgcatgcctcagtgagtcagtgaatggctagatgtatagttaggtggctaaagagatgaactgataggtaattggactggcaaatatatgggtaaataggtagctagatggatagacggatggttggatgggctgatatactgataggtagacatatggaatgatttaggcatgacagttaagaacaaagtctttggaatcaggatgcctgggtttaaatctcagttcagtcatttactagctatgagatcttagccaaattacttttttttttttgtatctcaatttccttatcccaaaataataataatagtaattactttatatagggtgattgttaagttaaatgagacaatctgtgaatgtgctgagaaaaatgcctggaatacaataaggctcaaagtggtaaaaaaaaaaaaaaaaaaaaaaaaaaaaaccaaccaaacaaacaaaaaaagtattagtggtactaaccagagtagtattaataggggtaggtggttgggtacaggcacagactgatgaatgaatagacaggatgggaggcaggttgaaagatgaacaacttaatgggaagacagatgggtggatggggagatgatatgtgtgtggttaagtgtatgagggtgtctctgggatttatcatacacacctagggtatgtttatctcctacatttcagaacggtgaagattgatgtgtacgactgggaccgggatggaaggtagaactgccccacatggtcccttctcctgtacttgacccaagcagttctcaataatatgttgtacattcactgagaaccccaaagtagctttaggagccaggaaaggtgatgataaacaccagtgtcttgggtacaactgatccccccaattgtctctctggacactgtctcttcccgtttttcccctatgtttggcctcccttatggccccagcactaggctgccctgcagcctaagtaggggcttaggataggaggaataaaagactgggttcagctctggttccaaaccagcagcacctgctgcttagccacgcccacctcattgcagccacgatttcattggtgagttcaccaccagctaccgggagctgagcaaggcccagaaccagttcacagtatatgaggtgagcattccagccctgcccaggtcacccaggccctccatcccagtgtgctcagtctggacctcccttcctttgtttctcatcatcactgttacctcctccccttaggttcttaaccctcggaagaaatgtaagaagaagaaatatgtcaactcaggaactgtgagtgctccctagagccgtggccctccctggatccttccgtgtctgtccccattgacacagcatggcaaatatcgagggcagggcaagacagtgggcacagattacttggaatagtaatattgggcacaaggagcaccacttaagtttttctttgttttttttctcactcaggaaatttttctgacttcactcttttgcagaataaaagaaaaaaacctaagttgtatttcccaatttaatatacttttggaaatccaacgatgtttctgacagcttccccttttcccctgtcagaagttgaacagggtgggactgactgggggagcgggtggaatcatgtgcctcccatcacgtgcctctttccaagcccctatgggcctcacttccttctgccaccccaactgccttttccaaagtgccagggctgcctattctgtcccacaggtgacgctgctctccttctctgtggactctgaattcacttttgttgattacatcaagggagggtgagtcacaggccaagctctgggctgaaagcccggcaataaattactcccagttctgagccccaggtttcttatttatgaatggtcagggcccagtgagaccatggagataaactttaaaacacttggccaactataaagtgctctgtaaaatgcaaaatactgctcttcttagttcccttcatggggctgcttttcattcttagctttcgactcctcctgggaagatggctcccagaccagtggtcttcactggtggccccagtaacctaattggggcacaaataaagttatagtcaggcaagagggagaggtagaagagagggcacaaccaagcagactataggggacattctgtttggtttggtggaggcaggcagacctgggaaaggtaactttgcttctctgaacttcacttttctcctatgtaaaatgaggatttttttttttttgagatggcgtttcactcttgttgcccaggctgaagtgcaatggtgcgatcttggctcactgcaacctccgcctcccaggttcaagcaattctcctgcctcagcctcccaagtagctgggattacaggcatgcgccaccacgcccggctaattttttgtatttttagtagagatgcggtttccccatgttggtcaggctggtctcaaactcccgacctcaggtgatccaccctcctcagcctcccaaagtgctgattacaggcgtgagccacggcgcccagccaaatggggatattaatcactacttcagggctatagtaagggttaaattaaatgacatataatacacctgccacacagtaggcatttaattctgttacctaaagtgtagtccatgagccagcagcatcagcattacttgggagtttgttaggctctacccagaccatctggatcagaatctgcattttaacatgagccccacgtgatccatatgcacattactgtttgagaaatagtgatgtaataatcattagttcctcacttctcaattcatctgcttccccaacaggacacagctgaacttcacagtagccattgacttcacggcttccaatggtgagacacggatgagtgaaaaagtcggaggtgggaaggcacttctaagggagtcattaggagttggcctggattcctacctagagataagagtttacctacccaagaagcccaaacttaggcaaaacccagccaggaaaatagagtgcagaaaaatagatgggtagatggatcatagagggttgaaaggatatatagctcaacaggtggatgagtaggctgatggatgagagagaaagggggtataaggagagatggagaggtgaacaggtggtgagtcatgaatggatgcatagatccatgaacaaatggagtgggtacatgggttggtgagtataataggttagacaagtagatgcatcgatgggtatgtgggtggacaaatggactaaagtttaagttggggaaataacaagtaattaggggaaatgcatgagtggatagatccatatgagaatagacaagggaatgaatggaatggagagggctggctagccggatggataaaataatactgttgtatagatgggtggaaaatgaagaaaaatggcaagtagacaagtgggtggatggatggatggatggatggactgatggatggatgagtgggtaagtggatagctgcataagagaatggagagattggtggataaagatgtataagtagactgaaagatagatgtatggctaggtagatgggtggatggatgtgtgggtaggtaggtaaatggatgaatagatatagggatgggtgggtggatagatggataaatgaacaaatggatgattgggtaaaataaggagggaggacatgggtagagggcagataaatggatataggtggatgaatgcacacaaagataagcaggtgaacagatggatgatccagatgatcatgaggctggggttcctgtgtccctacagggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctggtatggtattggccagagcttaccctccgtgccctggcatctggttcacccaagttgatgattttgttctgtttacattacttcaaagggcatgtagaggaacaggaagctatgagaggatagcagagcagggaggggagcagggctgggtttggaggggagcatgaaagggactgatggaaaaaggaaggagtgagctggaatcagagcactcctgcatgtaccctgcatgggctcagcctggcagggcatattctttgacagaacaacaatgatgaggaccccaactgtgcgggcatcgagggtgtgctggagagctatttccagagcctgcgcacagtgcagctctatgggcccacctactttgctcctgtcatcaaccaagtggccaggtaagggaactgggtggaagctgggggaaatgaggggacccacataagggattgaccccccaaggatagtcaggagcactctaagtaatttaggatgatttgaagtaaacaggagaggccaggcatggtggctcatacctgtaatcccaacactttgggagactgaggcaggaggatcacttgagcctaggagttcaagaccaacttaggcaatttagtgagaccccatctctttttttttttttttttttttgagacagagtcttgctctgttgccatgctggagtgcagtggcatggtctcggctcactgcaacctccgcctcccagattcaagcaattctcctgcctcagcctcccaaatagcagggattactggcgcatgccaccacacttggctcgtttttgtgtttttagtagagacggggtttcaccatgttggccaggctggtcttgaactcccaacctcaagtgatccacctgcctcagcctcccaaagtgctgggattacaagcatatgccaccatgcctggctcatttttttaaattaaatatttaaattaaaaaaattaaagtatacaggacgatgtgtataggttatatgcaaatactacaccattttatatgacggacttgaatatctgaggagtttggtatccacaggagtcttggaaccaatcccccgtggatactgagggatgactgtaccttattatgcggcacaaagggtgtcagcaaattaccctaaccccactgcctgagaatgacaagctggggcttgagtttgggtaagagagagaagagcctacagcactgtggtgaaggcgtacgttttagcatcagatctgagtgggatccttcctccaccattcactaaccatctgaccttaagcaacttcgcctctttaagcatccatttcatccctgtaaggtggtgtcataatggatgacaatagcagcttccttatagagttattgcaaggttaaaattagataatagtgtaacaagtattagcacagtgtctggcccatggtacatgctccataaatgataagttaaaaactagatgagtgactgtccaaattttcagaataaaactatacaaagcaggccaggtgtggtggctcacacctgtaatcccagcactttgggaggccgaggtgggtgaatcatgaggtcaggagttcaagaccagcctggccaagatggtgaaaccccgtctctactgaaaatacaaaaattagccaggcgtggtggtgggcacctgtaatcccagctacttgggaggctgaggcagagaattgcttgaacctgggaggcagagggtgcagtgagccgagatcacaccactgcactccaacctgggcgacagagcaagactctgtctcaaaaaaatatatatatatacatatatatatatatgcacacacacacacaaaccaaagaaaacccagatcatacatcaaatggcttaaaaaaccagagggtattaaaataaacttaaaacgaatttatgaaatgacagaactaaaatcaaacatatgtcaataaacataaataagctctgtttgaccttaaaaaagaaaaagattatttgattgaacaaaaaataagcaaaccccactttatagtaaacagaagaaacccagctaacacaaagcccctcagaaagctcagaagtaaaaagattaaacaaaaagggaataaaagtgaaaggatttcagtgagatttatatgtccatagactttttcccctagcgaagatttgttttttttttaactttccttttaagttcaggggtacatgtgcaggtttgttacataacaaacttgagacatgtgacacatgggggtttgttgtacagattatttcatcactcaggtattaattctagtagatttattttctaatttgcagtaatgataatagattctttaatcataaccgtagaaagtttcaatagagaaatgaagaaatcaccctgaatactgcccatggaatgtggatgtatatacagttcttttccttatgtatccataattatagtcaaattattatacatataacatttcactactgatttttttttcactaatactggaacctgagcatgtttttgttgttattaagctgacttcttaaatattatcttatgcaactacactaattcaaaatttattcattcatttagtaaacattcagtaaaggggcaatgcaccattgagtgtggtgtccggagccagactagccaagttaacactctggttctatcactcactagctgtggctttggtcaagattcttaacctctctgcgccttattcctcatttgtaaaatgaggaaagtaacaatgtctacttcatagggttgttgtgaggactaactaattaatatatgtcaagcacctagaacagtgcctgccacatcataaatactataggtgttcgctattactgttactattattatcattattactatccaaaaggcatctgctgtgtgctcagttctctgctggggcactgaagattcacagatgaatcagatctagtccctccccttgggagctcccgccttggtgcaggagacagaaatataaataaatcattaccttctgtagaccagagcttcccagacttttctagcaagtcgcctgtcagcaaaggcaagcgacagcgtccctctgggggaatctgggggcatagctgaaagcagtcaggctgaaaatgtctttgaagtttccgtatttcatcttaaaaattcatgcaaattttatattcttctcacattgcatccctgtttaatttagagaaaaaaggtgttttaagtacttatagtcttatgtacttatagtcatctagctttatccagcagatcatgcagtgagaacccacttagaggagcagacagcccatcttggtgggtggagcagtatcctagagggagggggtagggcataggctccagtaccataaaggggactgctcagctgggtctagaggacgaggtagactttatgagagaaacagaagcagagtaggcctggtagaaggaatggcatatgaaaaacagaggcatgaaggggcaagttcatgaaacagtgaagagtttaatatgactagagtgcgcactgtgtacagaggactatccagataatggactggggatagagagtgagagaatcaagagctccagcttcaggctcagctggtcaggcatgggcttggaccccagcttcataaccccttggggatgttacttaatgtctctaagcttcaggttcctcattttaaacataggaactgttttttgtttttagtttttttttttttgagatggagtcttactctgtcacccaggctggagtgcagtggcacgatctcagctcactgcaacctctgcccctgggttcaagcagttctcctgcctcagcctcatgagcagctgggattacaggtgcgcaccaccatgcccggctaatttttgtattctagaagagacggaatttcgccatgttggccaggctggtctcgaactcctgacctcaggtgatccacccccccccgccacccggcctcccaaagtgctgggattacaggcatgagccactgtccccggccataaaaataggaacttttaaagcgcctaccttatagaatggcggtgaggattaaattagatcatgtatgtcaagtgtacatctgtgattttgatgatcacaatggactctgctgtttcccactctacagccaagtgaggcatagactggcctcctctggccactcacccattttctcagctaacttccagataaaaacagccttgagaatgcaaggcatctacagagaaccaaagatgtacctcctgtgcccccaaacccttccatgatgcccattgtcttctacagttcttttttttttttaagagacaggttctcactgtgtcactcaggctggagtgtagtggtaccattacagctcacagcagctttgaactcctgggctcaagcgatcctccctcccacctcagccttccaagtagctaagaccacaggtgcatgtcaccacgccaggctaattttattattttttcgtagagacagggtctcgctatgttgcccagcttgtctcaaactcctaggctcaagggatcctctgatctcagcctcccaaagcattgggatcttagatgtgagccaccaggtccagcctctccgctgtagttctacatgtaactcctcgtggtttgcacttgccattctctttctctggaacacttttccctttaccttcccaccaccatcaccacctggctaaacccaacccatttttcaggtacttaggttagatgttacatcctcaaagccctaacctcaatacactttagtagtttaatcctctctctccccaaggacaatatcctattctgctccatgctcagcacccagcgtggtgcctgatacacagtaggtatgcaattgctatttatgaaatgagtaagtgacaggaaaaggtaccaagccaggtctctgaggaggctggggccagaactcaggaagtgggtaggggatgtaaaggagaatcatggctggccacagtggctcatgcctgtaatcccagcactttgggaggccgaggcgggcggatcacttgaggtcaggagttcaagaccagcatggacaacatggtgaaaccccgtctctactagcaatataaaaattagccgggcatggtggtgggcgcctgtaatcccagctattcaggagactgaggcaggagaatcccttgaacccaggaggcagaggttgcagtgagctgagattgtgccattgcactccagcctgggcaacagagcgagactctgtctcaaaaaaaaaaagaaaaaaaccaggatcatgacccactcccactctgggccctgggcaaactgagccaaaattattttattttattattttacttttatttttatttcagttggggtcttactctgtctcccagactggagtgcagtggtgccatcatggctcactgggctcatgcaatcctcctgactcagcctcctgagtagctgagagtataggcacgcgccaccaagcccagctaattttaaattttttcgtagagaccaggtctcactatgttgcccacgctgttctcaaactcttggcctcaagtgatcctcctgcctcagcctcccaaagtgcttggattacaggcgtgagccaccccacctgtccccaaagctattttataattctacaccctctccatgcctttcctcacattttgagatcaggtttcaatacagtactgtccaatagcactttctgcaatgatggaaaagttctgtatctgtgcaggccaatatggtactcaccaaccacatgtggatatggggcacttgaaagtagctagggtggccaaggaactgaatgtttaactctatttaattaatttaaatttcaatagccaaggctaccttattggacagccacagctccatcctttccagtccgcacaggactggagactggaagtcaagagaccagggtctcccactacctttgtgccctctctaggtctttttttttttttttttgaatatgcaaaataaagggactggactcaatgacttctgaagtccttttcaggtggaaaaaaaatcttggcttcaaagactagtgagagaaggaaaaggagctctggaagcagctgttagattggcagggggaggactgcatggggcccagcagcccaggcgatgagatgtggctggcagaggggagaagggagagagaagaaatgtgggggagaaggaagcaaggaagccttcagcctttgctctcgctcatatataaacatcaaaatcttgccaggggttgataaatccctgagcggtctaagctctgtgcttcttcagccacgtggcccactctgcttccctcaatttctgacctccacacaggggagttgttctttagtcccactatagcgcctttttccttgctgttcccccttcctagaaagatcctcctctttcatttagcctttctatcctcaaacatcacttccttaaagaaaccttcacttacctgctgggtcacatcaggatcctatctatctatctatctatctatctatctatctatctatctatctatctatctgagacggagtctcgctcttgtcacccaggctggaatgcagtggtgtgatctcggctcactgcaacctctgcctgctgggttcaagcggttctcctgcctcagcctcccgagtagctgggattacaggcacccaccaccacgcctggctagtttttgtatttttcatagagacagggtttcaccatattggccaggctggtctccaacccctggcctcaagtgatccgcccacctcggcctcccaaagtgctgggattacaggcatgaaccactgcacctggccaggatcccctctggtaccgtcatagcagtgtcccttccatcacagcactcatcacagtggtgattttacactatttttgtgtgattcctggattaatgtctgcctcactccagagggctgggatggatttattttttctcctcatgtatctccagtgtctaccatagtaagtgctcaataaatattactgaaggcagaccaggcacggtggctcatgcctgtgctcccagcactttgagaggctgaggcaggcgaatcacttgaggtcaggagtttgagaccagcctggccaacatggtgaaacctcatctctactaaaaatataaaaagtagccaggtgtggtggctcacacccgtagtcccagctactcaggaggctgaggcaggaggatcacctgagcccgggaggtggaggttgcagtgagccgagatcacaccactgcactccagcctgggcaacagggtaagactctgtctcaaaaacaaaacaaaacaaaaaatgtgtgtgtatggatatatatatatatgtgtatatatatgtgtatatgtatgtgtatacatgtgtatatatatgtatatacatgtatgtgtatatatgtgtatatatgtatatatatgtgtatatatatatacatatatgtgtatatatgtgtatatatgtgtatatgtatatatttcatatatatgtatatatgtgtgtgtatatatatggatatatacacatatatatatgcaggcagtggcaggctgccaggtctggggaaggagcatgggtttcagaagccccagttcctgcccactgcccacacactggctgtggaagctctgggggtaaggtgttcccttggcctgtctggctttcagctggattctcatttggcctctcatccagggctgcagccaagatctctgatggctcccagtactatgttctgctcatcatcactgatggggtcatctctgacatgacgcagaccaaggaggccatcgtcagcgtgagtctgaggaggagggcttggcagggaggagtaatgtcaatactgtgaaggggctgagattttatcctacttgcaagctaacaagttagcctgccagtttcatggatgctggcagaagacacaagactcttggattagagatagaggactttgatttccagcaaaagcagtagctggagtattagcatttgcttgaattctctaagtcccagttcccactggatgatgtgaagagggacagatgatgcttgcagccactgtgggttgcgttacagaagaggaaccctgagcttagggaacttgagtcttttataatggacagtaagcatgcttgccttttgttccaaaggtctccagggagacctttttttaaaactatattggacagtatgcaaatatgccctctgctctagaggaaaatactatatctttcaaggctgcttgatatagaaacatccttgaaaaagtagtctggggcagagaaaatcaaggtgcctctgcttacaagatgtgcagaaccatgacacacatacacagagaactgtctcccaacagtcacctccctagtgatgcctgcttgccccaacagttcaccctctttcccctacaggcctcctcattgcccatgtctatcattatcgtcggtgtaggaccagccatgtttgagggtgagtaggaaggggtgtccctgagtgggactaagaactaaggagaaaagtgggagggggtcgggtacttgggcctgcctcacagatgacacaaggtagacacccccgtgtgaagccttggtcaagtcacagaccttctctgaacctgtttccttatcagaaccaaggctgatgatactaatacttccctctggggttcctgggaggatggactgcctgggaggcataataatagtaataataactccataacgaagactgatatttgtaggacttgatcacaagcattaggcattctcctgatgactccaaaggggagctcaaagggagggggcagcatggggtggggctggagaggccaatcagctgaggggtgtgtcttttctgcagcaatggaagagttggacggtgatgatgtgcgcgtgtcctctaggggacgctacgcagagcgggacatcgttcaggtagacctgacgtgggagaggctgtggagctgagaggcacagtgagaagaggctaagttgggagccactttcacttactgccttctcagtctcctacttttttcccccgtcactctttcatcctttctcattcattgaatacatcctttttgacaaacaggaaggttgctgcagccttggcacatccgtggtgtaggtcgggaggtccccaaggcccctgccctctagtggagacaaccaacaataaataatcacacaaagaaatatctcattagattgtgataagtactccagaggaatagcaaatgccactgtgagagcctgtaacagggacctaacataggtacagtagtcaggaaagggttctttagcttgccaagacctaagggaggggataagcattacagggagaggagcagcatgtgagaaggctctgaggcccagaagaactggcccgatccacgaaaaagcagaagctagggtagcaggatcacactgagtgtgaggagggaggcaaaatttgggggtatgttagaattggaaagctcttgaaggattttacatagaggagtgagatggcattttaaaaggatctctctagctgctgcatggtgggtggacagtaacagggcaagagaaaaggcaggtagactcattagtgaggaagcctttgaagtagtagaggggaggcgataaagatctggctagaagcagtggggagggagagaaagtggcaggttcaaaagatatttaagaagaaaattttacaagacttgatgattagatgatgacagggagtgaggagggcttcaaggatgactcagtattctagcttaagcaactgggtgagtgacatcccatttgctgggaaggggaaagctagaggaggagatttggcagaaagagctagaattcagttgtgaacacactgggttcgaagtatctgtgacaattgaatggagtggtaatatgggcaactaaatatgtggttctagaccttaaaaagaggtcagggatgggcccaagcatggcggctcatgcctataatcccaacactttggtaggccaaggcaggagggcctcttgagaccaggagtttgagaccagcctggacaacatagcaagacctgatctctgctacattaaaaaaataaaggccgggcgcggtggctcacgcttgtaatcccagcactttgggaggctgaggcgggcggattgcctgaggtcaggagttcgaaaccagcctgaccaacatggagaaaccccgtctctactaaaaatataaaattagccgggtgtggtggtgcatgtctgtaatcccagctacttgggaggctgaggcaggagaatcacttgaacccgggaggcagagattgcagtgagccgagatcgcaccattgctctccagcctgggcaacaagagtgaaactctgtctcaaaagaaaaaaataaaataaataaaaataaaacataattttttgaaaagaggtcatggatggatatatacatttggcagtcattagaaacagattttcttttgttttttttctcccttatcagcccctctccccccacatctcatttcttctcctctccctaagtccctctcctaggcctctctctcttcccagccccttctcacagactcctcctccttcttgccccagctccatctctctgacctcctcctgttctcaggatcccttctctctggtccctgccccttgtctcccctgctccctcctttccagtctccctccccacctcctggcctgctctacttccttccagggaacaatttttaaagtcatggaagtgtatgaaatcatccaggaagagagctgagagagagaagggaccaggtttagagagcagatagacccagaggaatggtggtgggaggggggagcttcaagaaaggtaagcaagaagccagaagagtgtggtatcaagagtgggacgtgtccagaagaattatggtcaaatgtaatggaaagctaaagagaagtcaagcaagatgaggactaaaaattactgttcactggactgatttagcaacacagggccactgacgacatcagcaaaagcagtttcaatggcctgtgtgaagccaaactggagtgggttgagggtgaataaaaggtggaaaaaaaagtgggtggagagaaagcaaatgtagaaaactgttcaagatgtggagagggagatactgtgatagttggaaagagatgctggggatcaaaaaagaagcctccctgctgcacccccatgccctctctcctggtcatggcttatctcttcttgtctgtgcctgacccagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattcca

SEQ ID NO: 1434 - DNA, 15194 bp, Homo sapiens
ccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaaggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttgaagactagttcactgcctgccaggagctaaagggacgaggggtggaagcaatcagaacccactgagcagtttgagacagtacacaatgaaatcaggaccgatcacagtgggagggtaagcgcgtgtagtaacgggctagttgtgttatgtggtgttgcaaaaaagttaatagcagatgagtgggaaggttgaattgtgaatacaaaggtatttgggattttacagcattagaattttaaaaagtaataacgttgctactcactgtaactaaactgctacccaccactactcgtttcctttgtatagttgtggcctgtgatagactggtaagtttgaaagtgatcaagtataacttgtgatactcagaccactgtgtaattctcaagaccttataatggaagcttgaatttgactcacaaattgaaaataatttctaagcaggatgacagtgttttgttgatcgcctgtagaagcatatcaaattataatctattgtttttctactttaacaaaaaagtatcagtgacaatagagccttgttctggattggaatctttgagtctcaatgttcttatctgtaaaatgggatattacctacctcaaaagaggtatggggaggattaaacgaaacaattatgcacttaatgtgcagttaacattccatgacaacagttgtcacagtgtcttttttgtcatttaatttcttttacttattattttgttgtatattttactttattactttgctataaatttaaccttgccctccttcccctttctgtccgcaaaggaactggaatattaatatgtaacacttaaatagcaaaactatgtgccaggcactgtttttatccgtatttattttatttaagaaacttcttaaataaaacaacttcttttaatcttcataactctatgaggtaagttctattagcaccctcattttgtagctgaagagtctgaggcacagaaaatgtgggtgattatcccaagttcacacaaccagtaagtatctggacccaggatttgaacagatcattgttaatctgtactttcaactccagaatctgtactttcaactccctcttttggttcaattaatttagtattttgaagttaagaaaattccacaagaacatatatctgaacatatacctgagaaggaggtattttatgtagtgcttctagttatttatgtgatattttttattgcagatgaaacagaatttagaaacttcatcgtttggcttgaagaccagaaaatcaggcactacaagattgaagacagagggaatttaagaaacatccacagcagcgactggcccaagttctttgaaaaggtaatgaattaggaagtaaagtaaaaatacagagagtttgtctgaaaaatcatgaagatgagcttaaaattactttcttcttttaagaaaaaaatgataatgatcagtgttaggaaagctggatttcagggattttgcttttttcttagatgtgtcttttgcttttagagcaaattattttatgtcttcctaccaagctttcagtattaggtagaaatagttttctctagaaacatgaagtttcttaaataaataatgatgtaaatatttcgctttccctttatggcccaaatcagaatttttgttaaacacagtactatttcttatattaaaagaagacattggctaggtgtgatggctaacacctataatgccagcactttgggaggctgaggtggcagatcatttgagctcaggagttctgacagcagcctgggcaacatgatgaaaccctgtctctacaagaaaatagaaagttatctgggtgtgctggcctgtgtctgtagtgtcagctaattgggaggctgaggttctccagcctgggcgacagagtgacaccttgtctcaaaaaaagacattattgagatgcttgaaaaccaagactgtcgtgtttatgcttatatttaatgtaaacagatatcccttgttgtatgctagggaaatagtccttaaatgatctctggtatatcatatttttgtgccttgaatcattttcccattgatttagttttagtaacacttttgcataaaaaagaattctcagattagaataaaaatgcttttagtgtcatttcttacattaaacattttcatcagttatatttgatgagtgagatatttttcttgaaaaaggctaagtttttcatttgcgagagcagtgtgattaggcactttctccctagaatcagtgattttataaattagggattgtataaattacatcattgttattaacctttccgtgtctcaattttttcatcaataagtgagggtaacaatgatacctatctcataagtgtggctttgtttttaatgagtaattgttcacagaagtccctggcgcatagcaagtgtgataagcttattactgccaatgcctctatactactactattaatactactgtattcttttcctttgctcttagaaaatatttttaaaattttcagtggacttcttaaaactttgaaatatatttttaggattttatgtttgtttatattacattttatggtctattcatgtgtacaagacagtacagaattctgcatgtagaaaggtatctggagaatataaaaaattgtctaggctgggcacggtggctcatgcctataatccaagcagtttgggaagccaagatgggtggatcacctgaggtcaggggttcgagaccagccgggccaacgtggcgaaaccccgtctctactaaaaacacaaaattagccaggtgtggtggcgcatgtgtgtaatctcagctgcccagggggctgagccaggagaatcatttgaactcaggaggcggaggttgcagtgagccaagattgtgccattgcactccagcctgggcaacagaacaagactctgtctcaaaaaaaagaaatatgtatgtatgtgtgtgtatatatgtacatatacacacacgtatttctgatgtgaaacacctggaatgacagtaagaataatttcaacatatcagaacctaaacagttattatccttcaagttgattttattataatcttatattacatataattaatgttacatataatactattatatgcaacatttatttgaatatacagcttctgacatttatttaaattacttggttacaccctacatgtatgttacatggctactcttttcagtggcatttccataatatgaaagttaaggtttagatagataatgatttattgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttaactgtcctttcaagattcaagatcgacaagaagctattgactggcttcttggtttagctgttagacttgaatatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattgactgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttatgtttactgtcttagcacagatacttctatggttggaagcttctgaatgttagtacctatagtaaaaacaatttttctttaaacgggtgttttctcttattagaccatttcattttgaaaggcctgccaacatctaaatgcaagatttgattatcttatctgcatcccctgcattttgtgtttttcggttagttacagtcttcttaattatttactttggaagcctttttatatcttggcttatccctttcccttcatcccacctacactgactttttctcatgtttgttgtatcttcattcccattggcataatcctaattcaggctcttgtcactttctgccaggagtattataatatctcccattagtgtcaccttctgttcttaactgcatggccaaccaagctaactttctgaaacgttaatctattttaggatgcaacttactccttgtttccaaagaacagttccagttacatattcatattaataaacatacatatccataaacactaatttcccattttctataaaaagaattttaagctccttagcatggtagttaatgatgactgatatccaacctgtattcacatcttgacatcccagctaaattagaataatagtgcttcctgtttatatcccatttccccctctgtttctttgttcacacttttcccttggctaatataccatttcattctatctacacatctaaatcctacccatctttttaagatccatctcatatgctgtcttatgtcttagcagcagtataatttccctctgaacttccatagcttttaaccctatacattttaagtcattaaccactttccattttgcttctatgtcttattcgtcccagtaatttgtaaactgatactcagctttgattcctacatggtacctctcttagcttccaattgatgctgtaacaaattactacaaactcagtgactgaaaacacaatttattattttagaatgagaaggccaacattagcctcactgggttcatgtcaagttgtcagcaaggcaggttccttttggaggctctcgggggaatctgtttctttccttttttaacttctagaggctgcctgaattccttgactctggccccttcttccttcttcaagtctagcagcatagcattttccagtctcttatctgattctgcttccattgtcataactttgtctctggctctgatcctcctgagcccacctggataatccaggataatcccctatctcaagatccttaattttatcatatttgcaaatcttgccatgtaaggtaacacatacacaggttccagggatcaggacatggacatcttggggggtacaggtcaatattgtgtctgtcacagtacctgacatagtttcttgcacacaacaggtgcttatcaatttcagtaatgtgtggcgaatgcagtatatgtgagtgtttacatacactgatttggagcatcagccaattttttgctgatgcctcagacttaaatttcagaagccttatggcaaaaatcttaaggaaagctcaatttgagacttcgtttacttttccatttaatttaaaaaaaaaaaacttttctttctttagaaaatacatgtattcataagccttatggctttagtgtagtattgattttagggcctttaacaaggtctttttatctaccctgctctggattggtaggaattgtatatgagccaatttgtagcttatcaaaactgtttttcatttattcccaaattcttacatctcagtttatttgttttattctatttgttccatttttataacccgttaaccttcaatggtagatgcatatggtcatgtatacctgcagttgactttagtaagtacatgtatttctcagtaatagcatgttcttttagtgaataaaagaagcttgtgtgtggaatgtaaatttttcaatattgaaaaaggaagtcaacatatacttgaaggtgaatggtatcaaaagtatattaaaagtctaagctagaaaacaagttttgtttattaaaattcagaattgcaaaaacagacttgaaaattggtcaaataatactgtctctaatcggtaggaggcgctgatgttcttttgtggttttacattgatatgttgcctccttgacttttaagttacttattttaaaatttgctgaaaccattgtgagtttttattatttgcgctctactattttttgaagccttttggtagcttgtcaacatgatcaataactgaaattttttaaatgtataatttcagatgtatagaaaaattacaaaatagtacaaagattttcatatacctcaagtctacaaatgtagcgtgttacctcatttgcttcatccttctctctacacagaggcacacaccatttttttccaaaccatttgatagtaaattatagatgattcctttttactcttaaacactttaaagtgcatttcctaaaaacaactttgtcttatataaccacagtacagtgatcaaaatcaggaagttatctttgatatactattatttattcacattttaccaaaccccccacttctctcgaaagaaaaaaataacccagagcaatcctggattatgcaccgcattagttgttacatctgtcttagtatcttaaaatctggaacagttcctgtctttatttgtgcttcatgaccctgacatttattttgtagagtgtccctcaatttggatttatatgatgtttcctcatgattagatttggggtttatacttttgttaggagtaacacagaagtgatgtgttctttttagtgcatcatattaggagatacgtgatagcgatatgtcccattactagttatgttactttgatcactaggttatggtttctccactgtaaagttactattttcctctttgtaataaatatatcttgtggggaggtactttgagactgtatcaattatgtttttgcgcctcaagtttcccccactagttttagcaaccatatgatgattcttgcctcagtcatttattatgttaatcgacaaaaggtgttctctaatttcatcattttttctacatttatttgttggctttctcttgtaagttttcccatctctaatttacttgtttaaatcagtatagatacatggatttttattttattcaatggattataatcctttctgtcatcacgtattttgctgttgatactgttccagatttggccagtggaagcctttttaactctgacttaaattttatgcttttattttttcctcgtttcattaacagatcccataagcactgtatagcctaagatgccattttgaacattaagtttagtgaattattaataagtgtttttatttttgaattcctttgaagtattgtttttcaaatgaaaataataaaatctacctttggaattctgaatttcaagtttccatgaaataagtttgaggtttgtatatgatggtgtatttgatgtattgatttttttggggaaagcaaggtttttggattttatgtacagcattcaaaagaagatggggggaagcgtactttttaatgagtttgtatttaatcttacgtaacctatacttaaccctcctcccattcttctaccccagatttcagaggaagctgtaaaagcagatttttaccttcctaaaatttacatgtttgaaatgattgcctttagaaatgttaatgaaaagatatttgtgtcacatagtccagtaattgctttagcttaatcaaaaagatagttacattgtctttttacattttctatagcaaaaattaagcttgattgaatgaattgttttatgcttatacaggttaagcatccctaatccgagaatctgaaatcctaaatgctccaaaatccaaaactttttgagcactgacatgaggacacaagtagaaatttccacacataagcacttaacacaaactttatttcatgcacaaaattattaaaaatattatatgaaattaccttcaggctatgtgtataagttgtacattgaacataaaaatgaattttgtgtttagacttcagtcccatccccaaaatatcccattttatatatgcagataatccgaagtctgaaaaaatttaaaattggaaattattggcatttccagtaagggaaactcaacctgtaatcattttggctcagttaaatttggtaaatagcagtagtcattttaccttgagttgcagttgtacaaattatatttttgcctgtttttatagctgaaaaatacaaggatttagtacctgataattcaaaaactgctgacaatgcaactaaaaatgcagaaccattgatcaatttggatggtgagtatataaatgcataacattgaacatcaacatttttggttttttaaatgtttttttctttgaagaatgaagtccaggtttacttggttttagtaaatttagaaggatccatgcagacagcatttatgttaacattttattctctataatgtttttatgatgtgctttctccttccccttgcatttgaatatctgaatgttgatttgatttgcttctagtaatttggagttttgatttgtatttaatcatgggggtcattgtttgcctttttgaatgtgtaaatttcttttaatccaatgactctatcagacaagtggtaaaattttccattattttaagtcctggatatcttttagtaatttccctttttaaaaatatgaagaatctaattacctaaattatgatgtgtaaaatatttgttcactggctaattcattgtgacctataatttaggagttaacccttttgaatgagtgagcctcttggacactccagagctgctgcttagagagaaggttttgggaaaactatccatggaggggatctatgtactaaaattaatggccttgggaagaaatgttaattaaaagtgctgtataatttagccttgcagaaaaagttacaggacaaatataatgtgagttaaattagtcatttattggattattcagtttggctgatgaaatacagatactccttgacttaggatgagatcatgtcccaaagtcgaaaatatcataagtcaaaaatgcatttaataccccggaagacccattgtaaagctgaaaaattgtagttggaaccactgtaagttcagattttcctcatcttgcactagggttacatcccactgaactcattgtaaggtcaaaaaattacaagtctaaccatcctaagttggggaccgtctcatacagtaataggaaaaccattttatcttaccaatttatttaattgttgatagtctacagggctttcttttttctcttgtgagtagcagttttaaaaactaagagatttgttgctaccgaaaagttaaaaatgtttttgtatgttcacaaatatgtttgtaattatacgtttgcagggttgtaagtttttgtttgtttttaatcttttatagtaaataatcctgattttaaggctggtgtgatggctttggctaacctgcttcagattcagcgtcatgatgattacctggtaatgcttaaggtcagcttcatgttcttgattcttgacagaaactgtgcacatagaaaaatgtctttattttctaaatattaactattgatattaaaattatggttgaatgactaaaatacacagaagaatatgaaacataaagtagatttcatggttttatctgatttggattctgttttctgcctgcactatgctaaatcctttgcaaagatgttctcattcaatcctgccaacaatcctagagacagctgctaatatctttttaaaaatatatatcatatgaagaaactgagactcaatgaggataatgtctaagatgacacagaaaatgacagagccaggattttaagcactataaccctgtggtccattgtttttcccacattaccctacttctgtttagttagtctttttaatgattcatagtctgcatttgttaagatggtcgaaaatgccaaatgagtaatggtgaatttggtcaaaaatatataaccccaaaatctctttgagaaatgaatctttctgtccccgatgctagataggccactcagttcataactatacttcaggaatcccagtaatctgaaagaggtctcttgtttctgagagaaatcataaacttcagaagatttattcctagtaatcgtgaaagtacagtggtgtggatcaggggagtggtacttaagataccagacttggaaattttataagagattaaaagcttttaactagaccttgtgcatgtaaactactttgtgataaatatcactctacccagaagagattaagccataacttaccatgctttttagatttttattattaaatgtcagttttaacaagactgttgtattcctaagttattaaaattttctatactgaatctgaatgttaacttggattttctcaatccagattgcatgccaaaagacaaaaatgtttttagtgaaatttagctatttcaaaggcttgttctttattccgacaattatgtaaattgccttggaactgttctatagtgatcatgtcagctttaatcataaagtaagtgagaggagagtcagacaatgcatagcgtatttgggatgcttttgttagacttcaaaacccaaggggataaagtataaatcaactacaacaaaatgctataaaattctagtcctgctgcacatttgtcccttttgagttattttaagaggcattcaaacaataacataatatggaaaacatcttagtacgtttgccaagtacaagcatcagtatattaactgtttggcaaccagactatttaataacatctgcaataactgttaaacattgtttgaattcggtttttcaaagatagcatttggttttttatttaaaaattatagtttaagttttcacacttatttttgagttgtaattgtcatcttcctaattaaaattccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagacctactttttaccatgtgtcttgctgtatttaaagttgttttttaccagtcacgtgcattacctattcaaaaaatggttttaattgttgcaagcaccattcaacattattaaaatactagaagtgtgaaaggttacgttatattagtgggttttttttatttttaatttaatggggagtttattaatgaacttaggtaattctgacttcatcaaaatgagcatccttattctctgggctcatagaagaaaggatgacaggtacacagcctataaaaagtaaaaatatttttgggtttcttaggcaattcggattttggttcaggagcgcctgacacaggatgcagttgctaaggcaaatcaaacaaaagaggtacgtttctataaatcctaaataagttgttaatgaacatttcttctggtatggccgtgattttaaactttgcatgtatctgtttaagatatccattctacgttctacaacttagagaaaggatagcttacttcagtgcttcctaaagcaaattgaatgtattcagtggctagggggtcatttttgagtgaaaaacttcatgttcctctcactttgtaccttaaaaaagccacaaatagctcatgcacagtccacaaatcatgcttgtggcccgttgaagtttatttaaaatgagttacccatatgaaacttactggattattttgactcatgctggagaagaaggaacacacctcactacaaattagttttctttttctatctaaattctatccttgctcttatttcttcagagtaaattcttgttttattcaatttcctggcataaaacatgagaaagtaatttggctaaggtcacctagttggtaagtgactgagctcaggcagtctgacttgagagcctgtgctcttacggtaggtggggagaagggtccatgcgtggatgtctgcatgagcttgtcagtctgcccaggtgaagggacagggggttctgttggagtgtaaggttcaaggtacaggtgactgaaatggtatctttcagtcctaccttgtaggctgagaaaagctatatcccatgactaccttccccttaaagagaaaatatggaacatttttagattatatcagaaatccaaagatgcctaaagtttcactggctgtgcagcggtggagagactgtcctcaggtcagcagcagcagtgtctgataacacctgcctcctgcagcaatgatgttgtagtgaatgccttgggcacaactatgttgtttgtcctccctgcgcccttcccccatctcccaatgccttttgtcctccagcccctttaggcaggccaagcagtgttaaaaggttactaatgccagggcagtatctctgaaagacactgttttcttttaaaggttcttactggctcgttgtatatgaatcgagccactggaagttgggttaaagatcagcttatttcaccctccctatagaacagacagtaaattgttctggtgtaataaagtcaatcattcattcattcattccttcagcaaaactatgctttggaaggcagtgtaagtaaaggcttagccaaatctctttgctcttgtttgtaaagtaaaatttagttttatttttaatgctcccaattttaattttggtgtcatctcaaaagataccagcctataacaatttagtggagttcttacagtctagtgtacttataagcatttataactactatttgaggcatatggtagttttcaggggtagcttggtggcctgttggcaaaggaaaaaaaagtggagcctctggtactagatgaacatataaagccactcagtacaattctgctctttaattttgctcacttgtgctttcgtacccattggtttcttcagacttacatgtgttagctgttttaaagcagacagagcctacgtagatttacattactagataaggcaagaattgagcagtgactaaagcatttgaatagtaacaggttgtaacattgaaagattgaaagtacgggtagtgtgtttttcttggcagtgattttatataatcagcaggaagtacagactgtcctcattttagaatttgtttctgtgaagtttggcatcaccatagtcaccatctttagtatgtccataggtgctgagtggtttagtttttcattttcctagactgtttgtttcaaagtaacttccaagtcaagtcttgaaagttaaattatacataattatacataatcttggcaaacaccatgctggctgaaaggttcgtacaatttgtaaagacaaattaatgtgctcagaaatggaatataaggtactatttttgccgtttatactgttgcttactgtcgccaaaataagacagtaacagcctggctcaacttgccttccatagcagtaatgacaaggcactgctgcaataaggatatattgttttgtatgcctgggctaaaggattggatgagctatagagcttcctggtacatttaaaggttaacttttccccctaaccggttgaaatagggaaaactcgctaatcacaatcatcacaaagcaaatataaacaaaattcctagttcccttgcccatgcagctaaaagagttaagacaccagaatagctaggtgcttttcagtttcagttgaggaaaggatgctattcttaaccataaatactctcattttgtctttctttttttaaagggcttacctgttgctttagacaaacatattcttggttttgacacaggaggtaagtgattttgtttaaattcaaactattttttttacagactgaatacttgggaggaaataaatggccttaaatgtaaaaattatgtattgaagcagtgttcttttctcataaaacagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaattttta

SEQ ID NO: 1435 - DNA, 36823 bp, Homo sapiens
taaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtccttttactttttatgtttttgagtcctatcagcaatctgaccacatacaaaaagtttacctctttctctatgatttttaggacacttttaaagtgtagatgtagcccttatggagaccttagacaattcacagagcaatggttgcctgttgtcttggtgggtgcgcaacctttgccagttaaagggaaccagtgcaggaatgaggctgagggaagctggtggatcggcctggagtgctgggatcttgagtggtctcccaggcgataaaggccccaactgcctgacaccggctgctggctcctcacccgttgggggactgtgctgctgcctgctctgtcctggctcctggcccatctctgcagagacctccccatagcagttgtggacccaggcagcttgtgtggctgagggtggccaaccagtgccctggcacagtcctcagggagactggactggagaggcggccgagagtgaggccaccaagagtgcctgccgagggaaggagcgggataaactgaagtgcaggactgaggcccagagtgggcgagtggcccggcaggtgggtggcctggcaggagagcagacggtggagcatgggagccagcagtggtctgctattttccaaaattgactcatggtgcttctcgataatggggcacacaccagagttggtccatctgagccctagccccggcagtgccatttcccagggtggtccaactttcaggatgactttgtcaaagccccttcatttgtcctcacatgttaacatttcattctctagggtcatgctgtgtgattctggagagctgagagcccctccagggtccccacacagatctcagaggatagaagtcccttctaatttagagggcctctttctttccttataaaatttcttccagtagcagggattctcttcaaagttttctgatttttaaaacaccggtttttattatctctcttatgaaaaataaaattcccccaaatctccttttctgaaaacatattctttttgagtttagctgagtggcctgttgtcagatggaagttacgggaaatcggcatcaataggattcacttgtatgactgtcatcttcacctctgcctgagacaccttacagctccgtcctgcttccatgtcattctgttccttttgtaaaatgtgaaccaggtctacagctcaatgtagcttaatgctatacctctataaggtttgttgtatgctaatccacaaatcaaagacaacaattccttctagaccctttaccctgatttggagttcaaaacaatacagccagcataatcagtagaccatatttatataccctttccttatatttgtgcttttgttttgttttaatggagagaaaaatcaacagtagaaaccacttacaagattacttactactgtagtgtggtataaagtaaaagattttacaaaattaaaaacatagtgatgggaaaatatggttagagtcaaacagtctgatttttttttaaggttgctggttacagatcaatgtcatgaacaaacagtaattttttttggaggagcatgcttggagatgaagtatagcagtatagcagacatccgatcattgtaatctgttttcagcccccttatttatattctcttctgccaccttctcattttccctcccccttggagttgataccaggaaggacctagaatcagcaattttcactgacagtctctattatctaacccacgaaatttcatctttctacaaatgggcccctcttcctggctgcactttcctccccgcactaacttaactcttcttcctcagttattaatttctcgctgttaccaagtgatgacttgctggatggcaaaagtgaactcttggatttagtttcagctggaagaataaacctgtaattgtagcctggccttttcctggtgcgcttccctgggggcctggcctcacattggagacgctaagcttccagaagccagacaggcaaatcccaatggtgaccgatgctctcagttctggattccaaactggggggcagctggtctctgctcacctgcccagccagagtctgcctcctgtgcttggtccccaaccgactcagaccaggcttcctcactatgagcttcagaggtttttgtgggttttttttttttttaacattctatcaacttttaagttctggggtacatgtgcaggatgtgcaggtttgttacataggtaaacatgtgccatggtggtttgctgcatggatcaacccatcacccaggtattaagccggagctgtggagtttatacaggaagcccaatacagagaatgtaaccaagactcatgcttaggagatggctgccctctctcatctgtcatcactggggagtcaaatgtttcaaatgaatcaatttcacaataattgaaattagcccttgagggacgcaattcttcctttaaacaattcaaaaagaagcaaagtaaagctatgtataccacatgcagatagatgtaaaaacggaacctgatgaactaattctgtactcagaaattactgacggcattttacttgagagacatgcgtgtcagccatttctgccacgggggttcttctgatgctgtgataggctgtgatgaggaagccattccaagttggtgtagcaggagtttgtgtgtcttctggctgggcagccggggacctccgtgctgtcggaatgtgttttgtatattgtctgtcatgtctcttcctagttttttccaaaagccctctcttttaatatgacattaataagacaattagaacttagtgtaaactaacagtaaatagtacatatgtttcagtgcatggacttcgtatgttcttcttagtctgctcatgatgtcttttgtcaaaaaaactttcattctcatctgcattctggatcattgaggttcccagaaaagtgatttctgcgggttatataaacagttatttgcgacatctcttaatgtaacctggaaagtttctaacccagacatttaactttgtacttcaacgctggtttattatcaagcttcggaggtttttctgggtttttttttttttttgacattttatcaacttttattttaagttctagggtacatgtgcaggatgtgcaggtctgtgacataggtaaacatgcgccatggtggtttgctatgaaaatacacattttaaggggaatgtgctggggagggacatgctgatgtgcattggtgaaaactgaagggcgatggtgagatcctcctcaaagtgagctccttggcaatcaatcttgctgagtgttgccactgaaaggagaaagggagtgctcggtgcgtccttacccttcaggggcaggcggactgcttgggacttttatgtatataaacctattgactcttcccccaaagtctattggggtatgagattccattcacagcctctatttaaccatttaacttagccattcctctgtgaatccatgttattgctgaagataataataataatttagaaaaaaatctctaagtgactatagttttatttgaccaaaacttgaatttcgagtctgtcctagttgatctgttggtcatgcagtcctgggactctgttcccctccgggtctcatctataagatgtcgaaggggagagggaagcagcagagaggaaggtggacaagatggataagacgtcacctaaggtccttagcatgttgaaattatatgattttgatctaaacctaattggttacacttcctttcctggttagatatttatcaacaatgaatggcacgaatccaagagtgggaaaaagtttgctacatgtaacccttcaactcgggagcaaatatgtgaagtggaagaaggagataaggtaaatacttaaaataaatttgctctaagtaattcaattatggatgaccaaaggataaggaaacggttcggcttagctataagacagaactggcctatcctgggggcagggcctgggctagctgcgtgaattggcatgtggttctcagacgtgtggcacagaatggcatcaattaccgatgatcctctgcagagaatcattctcccttgatagatgtttctcctactatgaggatgacctcagctatcctcatcatatggctaaaggaaaggttttcttttttcttttttttttttttttatcaattatttggacctggaggcattaaagaatctttccagaaagcatttcccgctggtgtgtttcacgaaatgaagctttctggcagaagacactttagaaaaaaatagacactttgaaggaaaaaaaatagttgctacccgggtgatgcggggatagttaacaatgtaaccaccagatttcttttctcctagaaatttacatgagcatggaaagcggtaacctttatcactctatttgcaagtgcaaggtctatatagtaatacagaagctaagggacttccgaatgtgtcctttatacattgcaaggccatcaaatctattctgaatgtcagtgcagaggtaaagcccttccactgagggcagggagatgtaaatgtttccttagctgctggagtgctggactgatgttcttggtcagcaaactgatgacgttggaagtggatgcagtgaagggcgtgtgcagagtaggcttggattttatcttgcccatgagtttttgtgacagacgtgcaaatgcacactggccccacctatacagacccccctctgtgtggcacctcatgacagttaggctctgctaacaaagaaagtggcacagaggagctcatagaaaaatgtgagggcattggggggaagccatgacatggaatggggtttccactaggagactcccaagtgccccgtacaggtgctaggaggagaacgagacccttgccctgggccttgatttctcccttggtctgagtgactgttctgagccagaggccaccacaccctctgcagctggaaaggtcctggcctccaccccagagcctgggagaagaaattcagtgtcccacatctcccctgccaagcttctgctcacccccaagccagctctggacacacagagactcggtagagtcactcctgactggtgtcccacatccactccctgctgtaccttcctagaaagagagaggcatggaggggccttcgagatgaatgtggcccattttcctgagaaaaagagacagtgacactactctaaatggccctcacttctttccttttagaaagaaggttccgttgtgattattctatcagtgcacaaaagatccagttctgctcccatggggtgggtgaggctgaagggagaaaaacggccttcatgctcctccctgtctgcgaactgttccacgatggtcagttctgcaatccagaaaggaaggaatttccccattctcactcttggaccacaagttcccagctgggatcaaatgccaggcagacacttcccacctgatctgtgaacagcaggctcgtgtgcgttcacactgaggcagccagtggaaagtccttccgtacttgggtccctgagaaaaatactctttaggaaatatttttaaatgctttttataatcagaaacaaacattggtatttggccactgtagaaatattaagatgtaaagaagaaaaaaaatcacttgaacgctcccagccattcaagtgattgaaaaacatgctgctgcttgcagcctgtctgccagcgggacaatctgctgttctctataactgatggccgtggtcccaaactgcagtcacgtcaaaagatgacacccaaactgcagtcacctcaaaagatgacacccaaactgcagtcacgtcaaaagatgacacccaaactgcagtcacctcaaaagatgacacccaaactgcagtcacctcaaaagatgacaccgaaactgcagtcacttcaaaagatgacacccaaactgcagtcacgtcaaaagatgacacccaaactgcagtcacctcaaaagatgacacccaaacttcagtcacgtcaaaagatgacacccaaactgcagtcacgtcaaaagatgacagtctctctctgttgttctggtcgctcagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgtgagtacatgcacttgggggccggtgggggatgagccagcctcactgagggtcctgtccaccatggggtatgggaaaaaagatcacggtcctggttttgtgtggtcgtgggtctgttccatcctctgagacacggctctctggcaatacttgcaggtgttaatgcctctagactgaatccctttcattttgaagtcagacttttgtcctctgcagctcagcttcttgaccaagttgttgtctataggcagttgagctacatcagtggtctcagacttggggcactcacagattggtgaccatgagctgggccatatcctggtaccacctgtgtgtttatgtacttaacttttttcttttttgtataaacttccttttatttattttattttatttatttttttgagacagagtctccctctgtcacccaggctggagtgcagtggcgcgatctcggctcactgcagcctctgcctcccaggttaaaatgattctcttgcctcagcctcctgagtagctgggactacaggtgcctgccaccatgcccggctaatttttatatttgtaacagagacagggtttcatcatgttggccaggtcttgaactcctggtctcgaactcctggcctcaggtgatctaccggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaataggaaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcacctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagagtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttttgatagcagacagctttggaggatctcagaatgcaaacccagcaaatcacttctgccactggcacctcgcagcccacgagaaataagatccagctctttgccacaacatgaaagggacaagagaattactggcaaacacggtttttaaaactccaaccacatcacaggagagcgccccttgctctccacctcgatatggtttccgtgcatgttcatggagcgtgttctcttgccggctcagtggtttgacagagctgggtgtttatttctgtgctcagtgtctggaaacagatgtgggggatccagcggcccctggatggctttcctttgctggggcacccaggccccaactctgctctttgggcgctcattttgggagctcccaaacggaagccctccctatccactctccttttcaccccaagtgccatttctgggtcctctcgttgtaagccctgccgtgctgttttcctggcacttcccgtcattctttagtatctgagggttctgatgtgttaatttctcaggaggcacattttcctcttaaaatgttaaaggaaataaacttaggagtggctatggtttactcatgattgagccacagtaacaagttgtttaaaggatgactgtttcaatctgtagcgagcacttggactcactcacctgcataattttttttaataatttcccgtctaaacctatcatgacctgggttttgctcagagaaattccataaaactaacctggtaaattcatgttgtcactccagtaagcaaacttgctgaagttgacaataaaaacaaatagcaatgctggctgaatgttcgccatgtacctggcttgttgacctgtaggatttattatctcatttcagagatgagaaactgaggcccagagaggttaagtaacctgtcctaggtcacccagccagaggtggtaatccaggactggaggcagaatcttggctccatgtctcgcgcttaccctcagtgctggatgttgaagtcctctctcttgttccatcccagaaaagagcaaagaataaacttgcaattccactgacagatatgcagatactgtctggaataggtcagtcttagaggcctttttgcactatttgcaattgctaggcttcccctggaaaaatgaaagttcacgcttgagtgaaaatctataggaaccaacactagagtatacttgatgtcacactggcctgactcagtccctgagtggcagctgctgggggcagaacacacaccccaagctagaccagtcctgtggtctttagcaacccagtgcgctgtctgggtccccaggtgaggatcgccaagcccttctctggtgcctaaagggaagttgatgatagtcagtgtaatcatcagtgttctcatgtgaacaccaatccagcactcaccatgggcgggcactgtggttgctgctctgtggacactgactcctttcactctaacgctggccctgtgaggtaggaaccgttattattcttattttacagatgaggaaactgaggcaaggagtgattcagggacttacccaaggcccacttacttaactagggttcagcagatgtagttgcctcctatttaaagggggcttggctcattcctgaagcaaaggggagctggggtagcccgagcatccggagtggctgccctgcagtctttccagacacacctgtccaggagcagcctgtaaaggccagtcgctgtgctggccagaagtagatgcccccaattcagctgctgcattactgggtggccttggccaagtcactgggccgttagcgtccgtgcctgcaccttgaagtgggaatgcagtcatggagctcaaagggtgagacatcggggagtgcgctggggttaaagccctggatctgaggaggggccttcttcctttttcaatcaccatctcactccactgactcttccacaagaatccagccctgggctatgtgtcagggcggccacttcctgcagaggcggatgactggcggtttcagcgctgggctcaactggggccacttgtctgagggacaaaggggttctcttccaccccggctggaaatagaaaagaatccctgccattgagtggctgcacactcgccctgggtaatcacctccctcaccagcagggcagtctgctcccttccgactctgcatccggccggccgggctctgcagtgcaggagggaaggattgcatctttgtgctgggggcgcgacccttctcggctcagtcactttccacagccacactggccagcctggccgagaaggaagagcctacatcttctctttctcttttgttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcagagacaggcctcgctttacatttggtgtcatgctttctgaagaggtgcatctgactgtgaggtctacagagcaatgtcctaggactgtgttctctccccaacttccatctttaacaacctgacagtgcaaaagaaaagcaagctatgtccgaaacagacatcatcttgttattgcaggccctggagacgatggatacagggaagccatttcttcatgcttttttcatcgacctggagggctgtattagaaccctcagatactttgcagggtgggcagacaaaatccagggcaagaccatccccacaggtgagcaaggtggattatagcttcatttgggatccctttggggctatatcttttcattaatccagagccccccctgactgtttccctaaggcaccattcccaaccccactccctctccaaatggtactgccaattcttcttctaagaacttcacttttaaagttgaggtcaaatcacttctctgtataatagacaagacttgaatctggcacccttgttggtttctttcttgtctttttactacttgaagttcctaacctggactaagtgagtgtgtccttccccaccatgtaaccctcttccagatgacaacgtcgtgtgcttcaccaggcatgagcccattggtgtctgtggggccatcactccagtaagtatggcagcctttctcagtagattctatgtagatcctgccccactgccctgtgtcctttggaatcaatttctggtgtgtttttatctgattgcaccagcgttgaacaagcattttcttcgtggcatggaactccatgcttgggggctcttgagatggattagaccccatttctgctctcctaagaccggctttaggcatgccacagaaagcactgtggttcccagccagagtggtcaggaatggccagcattcccaggaaggtggtctcttagctgggccttaaagataagaaagacttgttcaacaaggaaaaggattttccaaggagtgggaatggcctaggcaaaagtgcagaggtggctgggctacttggaagggaacagcaggaaagctggtggggctagagctcaggcaggagcaaaagtgaggaaaagggtgagcacacgtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttatgaaatggtccatttttctctggagaggtggcctcgtcagctctagctgggcggctgcagcagtccgtgtgccgggtccctgctaatcagtgccctctgctctgaatgcaatctcttctccctcaggcagccagaacttagggaaacagaggctcaatgggacacctccttccagacatacctttagtcattccatccccaggttgtatggagcaaagatttagagaaagcaacaggaagcaaagagggacagaagaaaagatccattcctttctcttcttagtcgggctgatatgaccggcaggcaggtccacagttgcttagaagcaaggtgggaacagctggtgatgagccaattttccactttcctttggtgatgtggggcataattaagtcacactggtgagacttaggaatgtgaaaatcccaactgttaagaaacagtgcctaaaaatctaaagactcaagcagcgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgaggtggcagtccctgccttccagaagggcttgctccaggtgagacccaggttgaacaagcaaagaactttaagggagtgataccctgtcaccatttggaataataacgggtctgattaaaaaatgaaaactgggctcacgcctgtaatcccaggactttgggaagccgaggtgggtggatcacgaggtcaggagatcgagaccatcctggctaacacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaagatcgcgccactacactctagccagggcgacagagcaagactccatctcaaaaaaaaaaaaaagaagaaaaaacaaaactgaagctcttggcagatattttgcaggtgcctctgatcctgggcagggcattctgatcaaggtacccctctccccttaacgcatacacacactctccctcacacacacacacaccccacatggaaaggtgctgtgctacaggcgggccatggccaccttgaagcataaccacacatttgcactgcatatcactttgggatggggtccccccccagaaggagaagtgggcatctccccttgcccagcctgcacactgggctggcagcaggggatgagaagcccaggtcagctcccagggtgcccacggtcaactgcttctgggtcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacacccgtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctcctacaagtcaatgaaaaaaaaaaaccaaactgaatggtagaaaaatgggcagttcagagaatagaaatacgacgtgcccattaagcttaaactagtttgctggtaatcaggaaaatgcaaattcaaacaaaatcagactttccttttgcctgccagattgctaagaactgaaatgatactgctgagaatatggggaagcaggtgctcagcgacacttgccctaagatgcacagtgttttggtagcactcatccaacatttaaagtgaaaaacttttcgattcagaagctccatttcaaaaaaagaaaaaactacttagagaaattttctcatgaggcttcagggacatattttcaaggatattatattcattctctggaatgttttacagccgttacaacaaggaaagctgtccatgatctattgttgaagcacaaaacagcaaacggtagaaaattacccacaatattttcccattcgtagaggtgtgtgcttgtagaagtagaaattatctggaaggattcccaagaaatccttactgatggccacctatggggtgggctcggggcagagccggagggaagctgaaggctttctccctgtaattcacatacatctctatgtggaattacttttaatgagaaagtatttcttctgtacttaaaaaagaaaaaaacacccgctgcaatcagtgtccccatccccctccttagttagtccaagccctggtggatgctgttactctccttggagacagacactgccctgtggatggattccagacctcattcagccatcacccatgagcttgctgatgtttaaaatgcgctcacaccttagcattggagaaaacagtctcagacccggaagagcctgggccgcgccttgctagcttctggctctaggcctccgtgtctgcactggtctctgaggatcttcccagctctgaagttcgtggtgctgggctttacttgttgccctagataagtcaccgagtcatgctgggccagccctcccctccaggggtacagtgggcaatgggagagaccccgtgggggccttgagcatgactggtgagtggcttttctgctcatagcgcaccccttcactccctgcctgtctgcggcagcctcagtcttagagtgtgtttccagagaatcggctccttctcatccggaaggctggctgccctcgctacttctctaacacttggaggttccctcagatcacaccaaagagccacacagaaccacccccctactgggctgttggaatttcagctgtttctagtgagaggtagaagagtcaccctgcggtccctgaagccctttaccagactggctggaccagcctgctgggctcagaaggacaggcaccaggacaggttagcgggtggcagccctgttcccagccagctgtgtgggcttccagaggctctaactcacacctgtaagtggagcggcttagaccaaggatcccaggatgtcatggtctggcatgggaggagatgctggcagaggccaggacagtgaagggacggcatcggggcctggagcgcctgggccgagagccaggtggtggcactgccacccgggcttgatcagaatgttcactgatgtttacgcctgggccaagttcagcaacatccaaggtaaattgtgatctgtgttctgtcctggaggttggaaaactggttaaagaagctgcgtcccggagcaatctgaagcgggtgacgctggagctgggggggaagaacccctgcatcgtgtgtgcggacgctgactgtgagtctctgccctcctgggctttgctggggcttcagggcatccatctgtctccccctacttcctggcctgaattcaaaaccaactgagagtaagatgtgtgcacacacagtggggacgcttccaccgtgggcatcctgcccacagtcagccagccgcagacaggcaggtggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcagacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggatacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggttttacttacgagggtcataaaaacatgctgtgtagccacctccttctcctcatcagggcggtgccagtccacaaattacatcctgacataaccagcatcccaggcaagacatcaagggtaacaagccaccattcccctgccccttcgcctcacccctagctccgtcaggagcaggaaatgagtctgttatctcggaggaggggcagttccaagttgggacctggcccagccagctgcaggggtcaagggtgcagagaggtacccccaaaccttatggtgctgtcctgctgccactgaaacttccacaaatgactcagctagataggagcagcctccttctcaaagccaagggcacagtcccttggagcagcccctgtggaattggaacggatcaccttccaatgcccagagccactgccagcctctatgcaaaggaaagctgcatttcttaagaaagcaatagtgcgggggttggtggtgatgaaaccagccaacggttgaacactagaaacccctctgtagatgtaaatgacatcccaataccattcttatccactaagcgtgtcccccaagatcttattctctaaataccctctggcttggtttgaataactggttttagttcaatgtcagctctgcaacttagtcagcccttctaagtcacacacatgatattatcttacttaataagacccttcttttactcaaggtggaacattttggcttctttagaagttctcgccagggggcctacatcaataattaccgaagtttattctataaaacattagtcctctagaaaaaggggaggggaggggagtcctctagaaaaaggcaagtgaaatggagggtgctatgactctctggacttattagcatattaaaggtactgagaagtcctgcagtcagggaattgatttaaccccaaacttggtggaccccaaaatcctttctcccttcctctctatttgggaaagtctgcaaacaaaattaatttctgaaatgcagccatcctggggcctgttttcttgtgtgggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgacttacccacttgtgtctatcccgggaggctgccacttcccctactgtgacagcactgcatgtttacaggggaggctgctgtggatctgagctcagatttggccctgggttttatgaaagtcacaaaaacccttccatgcctcagtttcctcatctggagagtgggagtaatcaatgaatattatgagaatttcatggcacctaggaagtattcaattatgggcaggttttatttttaaacaggaggaagctttaaatgacaggttctccagtctaggtggcagtgagtgtctgtgcatgacatcaggctgtcctgtggggatgccctggctggggaagaagggagggcctcatggaggaaggatgcatttctggccatcagtgcccaccctccactggccccagtccacacactccgacgccacgtgaccctggcagaaagcacttcttgtggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatacaccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctccaaaatcattcaggtttatttggcaactgagcaacgaggcacataaacattatgcaggccacctggccgggcaggatccggcagcgtcctccgggcagagagccgagcacagccttgagccagtcctgtgggggccgtatttccctgtttctggtgttgtgccctgctgcgtcatctcacttcctggcaggtctctcttcctgtactgtaaggcaccagctgacatttcatggaggattattagatttaaacaatgtgttcctacgggctctccagggagtgtggagtttggatgtgtaggttttccacggggacccagcactgcctgcaggacaaacagggtctgccagatggcatatgcccagcagccagggaggacctgcggttgggcgaagcccctgtgtcccttttggcccctcagggaggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacggtatccccagttcttagttcctcatgtttccctctagaatgttttcgtgtgcatgcaagcagatgaatgcaagtcctgattgcctttgttatttttacacggaagtttccatgatagtatatcatcttgcactttgtttattgttccctaaaaaaactggaagagctctttataccagtccatgggaacctgcctgattctttttcacatgtgtatggaattctgctggatgaagccaccagaatttcagtaacatcttctgattagcatgcaggtatgtgcagtcacacacaaggcctcagagtatgtgatttcacacacacacaaggaaatccctgggacagctttcccaaagtgggttgctaagtgggaacacatttctaatttccttaagtgttgctgaattaccttccatagaggctgaaccaacgtgtattcctactaacattctagaagtttgtctgtttctttaccctttccaacagaatatggatttttgcccataggagagttaaaaatgctatcttgtttcattttaatatgcatctaccgcttataataagcaaggtagaacatcttattatatatttaaaaaccgtttgtatttcctttattatcaaatgtgctttgcgtatttttcttgcaagctgttaggcatttttcttatcacttctaagacctctttacatacatagtagagagattagctttctatgaatatgacttgttaatattttttccaagtttgttgttttgctctttgttatgataattttgcccccaccccattttttttacatactcaaaattatacatcttttcttttttggcttctgcattttgagtcattagaaggcactccaagtttgcaggataagtctcccacatataaaacttttatggttttgtttttcctggttatatctttgatctatttggagtttggcctggtataaagtgtgaggtatggatctgagttagtatttttaaactgggtttggagtttggcctggtataaggtgtgaggtatggatctgagttagtatttttaaactgggtttggagtttggcctggtataaggtgtgaggtatggatctgagtcagtatttttaaactgggtttggagtttggcctggtataaagtgtgaggtatggatctgagttagtatttttaaactgggtccatatttcatgagatgattggtcaagtggcatgcacggtttatgccctctctcctgctcctccaggacagaccgtcatccaattgcaccactgggtttgcttctttttctgtttatgatcattggaatgaaaccagttttcccatctaaaaatcccagctaaagtaaacctagtaaagctttgtctctcccagccaaagaggagggagaccagccacagatcatgataaaggacaagattcccatagatttcaggaagaaggaccagtggagggggcagaaagagcattttccctcttgagcagtctcccaaaagggtgcgcttttgacaactgctcagtagcgtgttcacaagctgtgggtcaggctggtggcacagggcaaactccagccaaggagacgtctagacaagatagcaaaagggagagtctttctcatgagctgttcccaccaccaaccaaggagcagccctgccaccccacctggaggctcattctgctttgtccccaggggtgttgagtaaggtggttagcttttcttctcgcttctctgcaccatgacaggagaattccagtaactattaccctgattcacggtgccaactgagcagggcacagggttgccaggtgatacatggcacccaggtaaacatgaatttcagataaacagtaaatgcacttttagcttaagtatatcccaaatattgttttgggacatactaaaaaaaattatgtgtcatttttctgaaattcagattcactgggcatcccgtatttttatttgctaaatttggcaacctgagtagaatgtaaagagttgggagaagaaagactgtgaccacttcagacctgtgtcactcatggactaactttgctgcatggaaaagggagatagaagtgtaaatatgtcccaaacctccagaggatgagactagtctatctccccatctctcccctgctccaaagagcccagctctgtgcatcagaggaatatttgcctgcaaggctcattagttacatggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagggggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacaaccggtccccgagtcagtcatgcagccgcaggtggagaactgttgccacctgtgggttttgccaggaatcagttcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggagagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggtgagttgactgtgtgtgtatttcagctctcctgagttgcttcttgctaagttcattattcttctattaactgagagtttctcattgtttacattgtatattatataccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgcctgtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaactttggggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctggccctctcttcttttttctccccttatcatttcattcctatcccaatgaaacacactctgtacttgaggatttccaaattttagttgctgatgagaagaatgagaagacaaaagttgagagcaccctgtgttttcatcaaggaagctttggcaaaagactgtttattagacaatgccctgcactgggggctaagtggctgcagtgccaggagccagggggtcttctccagatgactctgagctttcttccattcttttctaggatcaactgctacaacgccctctatgcacaggctccatttggtggctttaaaatgtcaggaaatggcagagaactgtaagtgtttccatcattctgagcctgccgtgggctgaacactagatccactagatttgcaggcagtgacacaggctccaatctgctgacaccccgtcccccccacaccgccgctctgtctgggccagctgtgtccctctagggttggtggggacccatcccttcctctctccagcccacccttcccacttacatcctcagcctgcccccctccaggcctcggcttttgtgtctgcccagcagccatcatgctggggacattcagtggatatttgacaaaagctccctggacggggacacaggcagaactgaaaaagtgtacttttgccagatgtggggtgtcattattcacacaactccccactcacagcagtgaagacaggtaaggctgacccaggtaaggctcctacctgctgggtccttttttctgagcctagtaggggacctcctcccaggaggcatatgacaacacctcctgctgggcctctgcggccctctcagtatatgcaagcctactgcaaatccctccacatgcgtgtgcaaacccactgcaaacccctccatgcgcgtgcaaacccactgcaaaccctccacgcgtgcatgtaaacccactgcaaacccctccgtgcgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctccgtgtgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttgtgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttcttacacctgcccctccagggacaggcagccagggctggggtcaccagggtcccctcttgggccctccaacagcaacagtactggcaacagctgggatttgctgagcacagactctgcagcaggctcggttgagctctctatgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgcgtggtcatttgtctcctttcatctgctgccttcaaccagctgggtcattagggctggggaacccagaccccacacagtcctcctcccagacgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttctctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaa

SEQ ID NO: 1436 - DNA, 27483 bp, Homo sapiens
cccatttgtcccttcaaagatttttttttattaaatggttttttaagatcctaaagtctcccagtttcccctatatacataagaccatttaaaccacaacctggttaccaccgaccctttcgtgatgattcttggccaaacccctgaactacaagcacatccatttacgcctgaaaccagaattgtcctgagattcgagcaagacacaaggcggcaattgggtaccacagcttcatggaagtaagtggtgggaatttgcatattattttgttaaatgagggtccagttcttttgggccatggcccaaatttgttgatcccagtgagggtacagatgagggcctggatttagggtgtgcggtaaggactgcccttcacagaagcaaaacaggcagctgcccctttcagcaggctcggagtctccctccaaggcagggtctgccccgagggcttacagggggtttttccggacatcaatcatccccgggctggctcgtcgcagttcccgccggggcttggacaaaggcccaaagttccagggcaggcctgcctcacccacaggaagcacccgccccaccaggggctcagccgcctcccgctgcctcagttcctcgggggacccctgctcctcaccacacaggctcgagcgtttccaggtcaagggtaacggagcgtggaccaagtcccgcgtctcctcccgggtgcggggggccccctcagtgaggggggacagccagagaagctcgggtgccaggtggagctcatcttcatttccaggagcctgtctgccctccgagcacaggctcctcttctccccacctgtcatggagagtaacgtgtcctcatcagaaacaggtggcaacaccttcccgaagccctagctccccagtgccccagcacaataagcaacctgtgaattgagccaataaaggctcgagggagagtggtctctaagctttccccaaagaaagggaacaggtctgacttcagagcgcgacgaggagttacccctgctgtggcctacagcgttcacaccgccgagcttctgtttcagttcctggtttatccacatgtaacggcccagttccttctccagagcttgaatccgggcctcatactgcctcctgctgtctgctaacccttcaccgaggtggtctagagtggaaaggtcgaggagagggtggtgagggctgcaggcggggcaggcggccagggctgtgggggtgggggctgtgggctgggtgggggccggggttgtgagcggtgggccgggccaccagggctgtaggtgcaggggctgtgagtggcaggggcggtggggggagggaggggggtgcagggcggggaagatgggggtgggggggatggagggggccggggttgtgagccatgggccgggctgctcacctcgactctgctgcaggagcagctgcatgttctgctcgtgctccttctgctgcagggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctgggagcaccattgttgtatgagctgtcattcactgaaatgtcacacagcacatgactatagtcacataggctttctctctgctcagggaacacagatgtgtgggcatgaggtgcactgagtatgcgcctgacactccacacacgaagccgagacgtgtgggcaggtactcgaatgcagcacagaacaggagtccaggctccagccagaagagagctgagaggtcagcacagcctggcccctgtgtcccagccaatgaggccaaagcaggggcagaagggccaggccagccctccccagcccccacctccacctaacagtgaaaacttgggtctgccgacagcaaggcccagcacccgcagagggctggagcaagggctgaggagagcagacagacaggcatacaatggcaccaaggggctgagccatggggccgcagggtacctcgggggacagcagactcccctgcctcagcttgccgtcgatctccaggcgctgcttgagcagcgagtccttctcctggcgcaggctgtcgatctccccgcggatctgctgctggctctgggcgctgccctgccgcagctgcccgctcttctcggacagctccttctccaggtgctccagccggctggacactcgcacgatgtcctcgttgagggcctgggggcagaatcaccagggattagagaaggaacaggcactgtcctcacaggggggacagaaagggccggatgttaaggaggacttgcgtccttccctcaagaaaccaacactccaaatgttctgctcagcagggagaccagacttagttcacagagactccaggaggcggggctaaagggaccagagcatttgcagaggggcactcagagatggcgagaggaggataaggaccagagggacgtggccctcctggcaagaacaggcaatgggtaggggtgggaggaatgatctgtcactgagatgaccggactggacagtgataggaattggccaagccctaaaggcctttctgggagccagatgcgggaggaagtgagggctctcctggcggagggaagttacggatcattccagtaggaccctggatcctcctggacatcagagtgatgcgtgctggcaggagcaaggctcctggcctctgcgggcctaggacactgggcgtgtggcccaagcccctgtactggaacaggccctgcatcaatgacggccatccccctccagccatcatggtaacattatgatcccatctgacagaagacaacgctgtggctcagaagctgaccttcctattctagatggagtaatgatgccaggcggagaagtctctttctatttggctataccaccttcctatacctgcgcctcctcattcttcctgcacaggccctgaggagggggttaatgagtgaaatgaattggaggatggacacttaagagaggttcttctatgcatacatctgtaactgtgtcataaatatcttgaagccctacagctcatggggatgcacaggatagaacccagtaggacagagcttcctctgtctggaacttacctggcagagataccacctagaagaaactctcctgtctagacctcgcctggcagggacatcacctggcaggtttatcacttggaaggacctcactttgctagacctcacctggcagaaacttacttggcaggagctcacctggcaagatctgtcctggctggacctcacttcactggacctcacctggcaggatctctcctggcagggcctcacctggctggatctcaggcgcttgctctccagccccgtcttctcctgcatcagggcctccttcttggccaggatggcctcccgcttgtggagctcctcccccagctcctccagcgcccgccgctgctgtagcaccttctccatctcctggtccagccacttcttctgctcctcaatcttctaaggaaaagtagggagggagggagggaactcagggcccacctctggctgtgtcagccgccactcgaggttcactggggagaaaggtgcacccaccagccagcccccaggggagccctgggtgcggacacagcctggccccacctgctgctgttccaggctgaccacagagccgttgctgccactgcgcctcttcctctggaatgccgcgatctcttccgtcttaatcttcaggatcttctgctgttgctcatgcttcagctccagctcctgggtgaggagctcagtgggcagggctgtttatggtgccagcatcttaccagagcctgccaccgatcccaaagcccccaggagtgcctgcccactcccaagagggccctgcgaagtgtcccccagacccatcccacacaaatctccctggagaccggcaaatagacgcaaacacttagaaataagccccacaagatgccagtcacctcatatacctcatctcactgaagtctcaccctggccttgagtttcctataacattccacattttcagatgaaaaaacagactcaggctaagtgacctgctttctaaggtcacgtggctgtgggttgcaaaccctgcctgggctcccctggctgggccgccagctcagcctattggcctggacagaaggtccccaccctgccgtgagcctgaccttgacgcggtgctgccgcttgctcatttctgcctccaggcgccgcttctgctccgtctcctcgcgaagccgcctctgcagctgtccctgctgctgccgcatgagctgcacgttccgctcgagctcctgcagtcgcttctcactctgggccgacagtgacaccagccgctccgtagcctgcttcttctccttcagcacctgggacccacacagtcttcactgggccatgcacggggctaccgcgagcctgccatagtgctgggcactcaacaagggcaggcagatagagggcaaatgggtaggtgggtgatagaccaataataataacagaggccgggtgcggtggctcacgtctgtaatcccagcactttgagaggctgaggcgggcggattacttgaggtcaggagtttgagaccaacctggccaacatagtgaaatcctgtctctactaaaaatacaaaaattagctgggtttggtggtgggtgcctctaatcccagctactcaggaggctgaggcaggagaatcacttgaacccgggaggcagaggttgcagtgagccgggatcgtgccactgcactccagcttgggcaacacagcaagactctgactcaaaaaataataacaggacacaggagccaagatggccgaataggaacagctccagtctacagctcccagcgtgagtgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcactcgggaagtgcaaggggtcagggagttccctttcctagtcaaacgaaggggtgacagatggcacctggaaaatcgggtcactcccaccagaatactgcgcttttccgatgggcttaaaaaaggcacaccaggagattatatcccgcacatggctcagagggtcctacgcccacagagtctggctgattgctagcacagcagtcggagatcaaactgcaaggtggcagcgaggctgggggaggggtgcccaccattgcccaggcttgcttaggtaaacaaagcagctgggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagcacgcagctggagacctgagaacaggcagactgcctcctcaagtgggttcctgacccctgacctccgagcagcctaactgggaggcaccccccagcaggggcagactgacacctcacacggccgggtactccaacagacctgcagctgagggtcctgtatgttagaaggaaaactaacaaacagaaaggacatccacaccaaaaacccatctgtacatcaccatcatcaaagaccaaaagtagataaaaccacaaagatggggaaaaaacagagcagaaaaaatggaaactctaaaaagcggagcgcctctcctcctttaaaggaacgcagttcctcaccagcaacggaacaaagctggatggagaatgactttgacgagctgagagaagaaggcttcagatgatcaaattattccgagctatgggaggaaattcaaaccaaaggcaaagaagttaaaaactttgaaaaaagtttagaagaatgtataactagaataaccaatacagaggagtgcttaaaggagctgatggagctgaaaaccaaggctcgagaactacgtgaagaatgcagaagcctcaggagctgatgcgatcaactggaagaaagggtatcagtgatggaatatgaagtgaatgaaatgaagcgagaagggaagtttagagaaaaaagaataaaaagaaatgagcaaagcctccaagaaatatgggactatgtgaaaagaccaaatctacatttgactggtgtacctgaaagtgacggggagaatggaaccaagttggaaaacactctgcaggatattatccaggagaacttccccaatctagcaaggcaggccaacattcagattcaggaaataacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggtcaatattcaacattcttaaagaaaagaattttcaacccagaatttcatatccagccaaactaagcttcataagtgaaggagaaataaaatactttacagacaagcaaatgttgagagattttgtcacacccaggcctgccctaaaagagctcctgaaggaagcgctaaacatggaaaggaacaaccggtaccagccgctgcaaaatcatgccaaaatgtaaagaccatcgagactaggaagaaactgcatgaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggagcaattcaacaagaagagctaactatcctaaatatacatgcacccaatacaggagcacccagattcataaagcaagtcctgagtgacctacaaagagacttagactcccacacattaataatgggagactttaacaccccaatgtcaacattagacagatcaacaagacagaaagtcaacaaggatacccaggaattgaactcagctctgcaccaagcggacctaatagacacctacagaactctccaccccaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagaaaaaaagagagaagaatcaaatagatgcaataaaaaatgataaaggggatatcaccaccgatcccacagaaatacagactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaaaagtccaggaccaaatggattcacagccgaattctaccagaggtacaaggaggaactggtactattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaatcacgattatctcaatagatgcagaaaaggcctttgacaaaattcaacaactctcaataaattagatattgatgggacgtatctcaaaatcataagagctatctatgacaaacccacagccagtatcataatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacaaacagagagccaaatcatgagtggactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatagaaccaaaaaagagcctgcatcaccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccatttaggacataggcatgggcaaggacttcatgtctaaaacaccaaacgcaatggcaaccaaagccaaaatcgacaaatgggatctaattaaactaaagagcttctgcacagcaaaagaaactaccatcagagtgaacaggcaacctacaaaatgggagaaaatttctgcaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgcagctataaagacacatgcacatgtatgtttattgtggcattattcacaatagcaaagacttggaaccaacccaaatgtccaacaatgatagactggattaagaaaatgtggcacttatacaccatggaatactgtgcagccataaaaaatgatgagttcatgtcctttgtagggacatggatgaaactggaaatcatcattctcagtaaactatcacaagaacaaaaaaccaaacactgcatattctcactcacaggtgggggtggaacaatgagaacacatggacacaggaaggggaacatcacactctggggactgttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataataaattaaaaataataataataataacagtatactaataatggtaaatactacgacatttacgcaccaggcaccacactaagagctctgtgtatattaaatggtcctaatgagcctacaaaaagtgtaattatgattatccctattttacagatcagaaaactgaggcagagaggttaggaaacttgaccaacgacacatagctagtaagtggtagaactgggattcaaacctgagcagtcaggctccagagcccatgctctcaaccactccacgatattgtctcttggacatttgaactgagaaaataaggatgggtgggcatctgcaaggatggacggatggaagggtgggagggacagatggctaggtgggcgagatcatatgaaggtaaaaaaataggataggccaggcacagtggctcatgcctgcaatcccagaacttttgggaggccaagataagtggatcacctgaggtcaggagttcaagagcagcctggccaacatggtgaaacactgtctctacttaaaaaaaaaaaaaaaaagaaaaaaattagccaggtgtggtggcacctgcctgtagtggcaccccgctactcaggaggctgaggcataaggatcacttgaacccaggaggcggaggttgcagtaagctgagattgcaccacagcactccagcctgagcaacagagtgagactccgtctcaaaaaataaaaaatgaaaacaacaggatggagaccgtgatgggctgaattgtgtttccccaaaattcctatatgaaagccctaaccaccagcacctcagaatatgactgcgtttgtaaagaaggtctttagagaggtgattagtttaaatgaggacattagggtgggccctaatccagtatgaccagggtcctcatgacaagaggaagagataccagggctacaagcaggggaaaggccgtgtcaagacacagccaggaagtggccgtctgcacaccaagaagtgaggcctcaggggaaaccagacctgtagacaccttgagctcggactgacagcctccagagctgggagaaactaaacttctgctgtttaaatccccctagtctacggaagtttgctatggcagctgtagcaaactaagacagagaatgcatgaattaacaaaaggggatggaaggggtggatgcacctgtggataaatggacaggtggtcaatccactgataaaaggctaaaccagctaggcgtggtggctcacacctataatcccagcactttggtaggcccaggtgggcggatcacttgaggtcaggagttcaagaccagcctggctaacatggagaaaccccgtctttactaaaaatacaaaatcagctgggcgtggtggcacgtgtctgtaatcccagctactcaggaggctgagacaggagaatcacttgaacccaggaggcggaggttgcagtgagccaggatggtggcactgtactccagcctgggcaacagagtgagactctgtctcaaagaaagactaaaccgatggcatgggtttgacggacacatggaccaacggatagacagacaagggagaatgggatggaggggtaagcgaatggagagctgaaagggggaccgggagacagaggactgcacgctgcagggtaggtttctttagacgcccacccttcaccctctcgttgctctcccaggtggtcttcaggcaggacctgccccctgcctctactgtgtgtaaagctgggcggacccccagcttctataccagcctcaccctgcagggccagggctggagcacaaggttccacagtgaacttgggcctcagagcccacatgtcctggtcccaaggatggcagcctaggaggcaggagtcaccccagcaccccaccctgaggccccgagactaacctgcacctggctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctggcggttcagggcctgagctgcctttcctggaagaaagcgggaatgtcagcacaggcagccctgctccaccgagagggccagctgtttgtccccctgggaggtttcccagcccttggacacctgtgtgggtttcaccaagcctttgcaccaccagtaccacagtttacttaatatttttcttcaaatcaactctatttatttatttattgagacggagtttgctctttttgcccaggctggagtgcagtggcgcaatcttggctcagtgcaacctccgccttccagattcaagtgattctgctgcctcagcctcccaagtagctgggattacaggcacgtgccactacacctggctaattttgtatttttagtagagattgggttttgccatgttggccaggctggtctcgaactcctgacctctggtgatccacccaccttggcctcccaaagtcctgggattacaggcgtgagccaccgcgcccagcctcaactcaccttttaaataagcctcatccactgcagcgacccaaggaaattacaaattagttttatttttaccaaatgcattctaaaataaatatgtaacctgaacctgtatataattaagcctttagaactaactttcatttccaggaaatctggaggacaaaagaatgagctaaatgacaccacaaaaaagcaaacagacaaaccccaaacgtggggtttgggacattcagcaggatgactgagagaagggagatgtcagagacctcagaaacaaatacagtcggccctctgcatctgtgggttccacacccatgggttcaaccaaccatggatggaaattatatttttctaaataaatggctgcatgtgtactgaccatttacagatttttcttatcatcattacctaaacaatacagtaaaacaactatttacccagcttttacattgtattaggtattgtaagaaatctagagatgatttaaagtgatttaaaggaagatgtgggtcagttactgtaaatactataccacattatttactaaaccttttttgagcatccacagattttggcattcacggggtcctggaaccaatcccacatagatatcaagtgacgactgtatgatgtgtgtgtggaacaaatgtggagcctgattcaagcgatccagctataaacagacactgctgataatggagagaatgtgcttatgctctggtcattaagaggactgtgccgggtgcggtggctcacgcctctaatcccagtactttgggaggctgaggtgagcggatcacgaggtcaagagatcgagaccatcctggccaacatggtgaaaccccgtctctactaaaaatacaaaaattagctggttgtgttggcacacgcctgtagtcccagctactcgagaggctgaagcaggagaatcacttgaactcgggaggcagaggttgcagtgagccaacatcgtgccactgcactccagcttggcaacagagtgagactccgtctcagaaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatataaacgctccactggccagcacctaaaactaccccgtgtcccctccttcactcatatcaccagtcataggcataacacaatttggagacgctcagtcctccatgacactcactgtgtgctccccaggactgagagatacttcgcccagcacaatggctgaaacattgcaggcactcgataagtaagaagaagtgccgggcatggtggctcacgcctgtaatcccagcacttgtggacactgaggcgggtggatcacctgaggtcaggagttcaacaccagcctggccaacatggtgaaaccccatctcaactaaaaatacaaaaaaaaaaaaaaattaggtgggtgtggtggcgggcgcctgtaatcccagctactcgggaggctgaggcaggagaatcgcttgaacccgggaggcagaggttgcagtgagccaagatcacgccactgcactccagcctgggtgacgagtgaaactctttctcaaaaaaagaaaaagaagaaaaaagaagtactgcttactaagagctattctaagcacttcacctgaattaactcacttcaccctcacaacacccctattcagtaggtataacgactatccccattttagagatgaaaaaactgaggcacggagggtttatgctacttgctcagggtcacacagctggaagaggctgggctgagtatcaaacctaggccatccggcccctgctcctaaccacctcattgttgaaatccctctagaacagtgcagaagtaacgatgagaagtccccctcgggtgagaggcccacctgatgcccacgcctcacctgtgcggaccagctcgccaataagctcctccttcatgcggatgttgatagccagctcccggatcttctgctgggcctgggccagccgccactctgaggctgtggcaggggggacctggcgggcctgaactcgggccttgctcccaccaactgctgcaacaggcagcctgtcaaggttgctgccccaactgacagtgggggagacagaggagtggagagcaggggctgccagggatggtgggtgggactgtcccaaggtggctggcccagaaccgtggaggggcagtggggaggaggccctctctgcatcccacccagcttacctctggaccctggaatggctgcatccaactcctcaaggcaaagctctgggcccttcctctctggcagactccctgggcgtgcccccgccctctgactgcagttgctgatcctatttctggaggacagaagcaggaggccatgctcctccccagcccctgccccagcctagccacccccaggcctggagggaagaagagaggccaccgggtcttccacctcccagggtcaatataaacccaggatgtgagtctggcagaatcaggagtccaggggcagagttttaggaggtacagggcagctgggggcatagagggccaccctggaggctgaagtcaggaggcctgggcccaccttgtatcacactcgctccagtgagacctttcggctcagtgccccacagctctcccccaggggctggccagggcaacatgagggcatcctaggacccagaggcttccccactgctgtcaggagaggagacggtgcgatccccagcctgcctagccctgggccctgagcaggtccttgtcaggtgggggcagtgggtcccactcacctgcgcaggtgtaaggtccgcctgggcggctcctcctcctcctcttcctcctctgaagcagctgaagagccacttcccagcctgttcacctcagtcagcaactcagctccagcctccctgccatttgtcacctgctaggggagtgagccatttcccatcccaagtcatcatccctgcgatataccccaccttgcctgccctcctcatatctctccctcctcaagccctgccttaccttcgtgatccagctcaaatgacccctctggcagccttctgaatctcaagctggggtgagagcttcctccctcccctcccctcccgcctgctttggctcccatgatacctggtactcctcaggtgacaatctgccctttctaccttgtgtacaggtcatgtgcacccaagtcctatctcaccaccaattccctgccagagtgatgggtgaacatgagacttctgccaacccccagctttgagagctgagatgacccaggcctaaaagccccagaggacccagaactttcaggcaggagtaacctttgtccaaacaaggttccccacgtggaaaagtgaacttgcaaagagagccatccaaagacagagggggtggtctgaaaggtgatgagctctccgtatgcagaagtgtgcaaggtttccacccgatgccggaagcctgaaccccctctgtaacctcctcattccaagcgatcttcagctaccccagggatgcccgatggcactgcacccttctgagaggcccagagtcattcaaatcttggctcttcctctggggacagctgaaagcagcctctcgcatctcacagccagtcccatgaaagcatgagtgggggacacgtgccccagtgcccccttcccctgccccgaacttgaccagtccagcagggcccacagacacccagcctcaccctcttctcacctctcccctctgctcagagccaacttcatctccagggaggcaggcaggcggcaccatgcccagcacatgggcgtgggcaccccccaggggggctgtatgaggtcgaggcacaaaggacccgggaggcaggccattcaggagccgcgggcccccccagcctggccgcaccagctctaaccgcagccgcagttccaccatctcctcctgctgctcacgcagccggtcgctctgcaagacatggtccaggtgccaagggggcatgaatgccccgacaggcaggagtgtaggaaactgaggaacaggtctgaggccactccaccgtctctgggctgaaaatgaggagtgtcaaatactcctctcctccccaacaactctgtaggagttcagactcaaactcaccccacagatcccatcacactcctatcctgccagaccgccacctccaaccgccgccaccagagggcgccaggagcaatgctgacctggtgacgcccggctccaaggtcccccgctgctgcccctcctgtcccctctcccgtccaagctcacaccacccagcaaagctgccctgcctggcggtcctgcacacccacctgcgctgttgtgatgctcacctccacactttcgctcatgtgcacctcctgactctacacccctaccccgcagtaccctaccctaactccctcccatcctgagaaactcagctctgccttcccttcatcctcctctgggaagccttccccgcactgtgaagcgggcgccgcacctgcagtttgtactgctccatggcgtcctccagcgcagccagaaagtctcggttctcctcctccagccgcgccacctggttctgcagggtcagcagctgctgcgccccctcatcctcctatagggcagggagaggggcttcaggggcgggggttgacagggcgagctggacacccggcctcttcttgtttagccctgctttctatctactcttccaagccctacctgcagtgggaactccagacccactggtgggaggaaaccccagaccccagctggcctgggtgccctctgcaagccatttgggtcatctcttgtaattatccatcgtatttgtattaataatatcaccactattattaggaacaatttactgcgtcttcaccggcatgctaggcacatgtgacaccctcagcccttacaacatccccactaagagatggggtaagtcctacggttatccctattttacagctggagacctgagactcggtgaagttaaggaagtgaccacggtaatcagcagaagtgaccgaatcccgaacgtgccctgctaatgggcaggaggcaggggcgcagctgctgtctgaagaccctcttccttcctctccaccactccccactgcccacaaccacaaccacaacctgtccctcggccacctttcgcccgccggccccctgcgccgcctggtcctcgacggaggcgctctcgatgccgctatcgggcccggaggcggagctcagggcgctgcgctcgccctcgacggcgcacagccagtcgcgcaccttgcgggcggcggcgccgggcagcccgggctcggcctgcagctcgcgcaagaggctgtaggcggcgtcggtgcaggcccggtagcgcgcgcactcggcgcccaggcgcatggcggccgccgcggaggcggtggctgggcctggggcgcgccggccgcggtggatgatgcgggtctcggagcggtgccgtggcggaccccgcgcgccgctcgccgtctcttcgggtggccgctcggcctcgggccgccagttgaccgtggcgcggttgcggatgttctgggcgcggctggcgtagttgagggtgttgagggtctcgtcgaagtcggaggaggaagggctgacgcaggcgatcatcaccgtcttggcgttcccgcccagcgagtctttgaggatcctgagggcgcgagggggaggctctcaggggccccgacgctccaggcccagggccagcgggccagacctgggaccggctcctggcgcggttcccgtgggctggagacctcaggggacctgggcttccacccccactggtgtgctggacactccccgcctccccggcccccaggccacataggagccagggggcagctcaccgggtgatcttggagtcgcggtagggtatgtggctgccccggcgctgagggtcccccagggcgctgatgacgttgcccagcgccaggaggctgctgttgatctggatgctctccttgagccgctcgccggtgctgcccgtcttgagcaccctctctgagcccgccaggtccacgaagtggaacttggagacgagcagctggcccggggcggggcggggtaggcggctgggggcgcgcccccgctgctccagggtcacggtgaagaccgtgtgtgagcggctagacaggtggttgaggtgcgtggctcccgtgtgccgcgccgcgttgcccatctccaggaggctcagcacctcatccaggccctccacgtcgacctccttcaccccgcacagcactgcgggcacagaaggccgtgagccccagggcaggggccgccagactgaccagccaggagggcaggcagagcagaactagccccaaacctgcccttcctgacccactgctccctccccatgcccacggggtactgcccttcctagttccggcttgaggggctccggcttcccactggcccacctcagtgcctctcactctgggtatagaagcatgtactgaactcagtggaggcaagaagctaaagcaaaacctcccagggcttgggttttccatgaggagttgccattcccagacaggtaagcactccactccaaacaggtgaagcccccctaagcccctctccgtcagtggaggaccccagagttcctcaccaacattcccgcgctcatcttcccggagctggatgtcacggctggcagtgcccacctcgagcaggtctcggaactcctccttgtacacttccaggtaggacacatgtaccagacagtcaagcaggtcgttctcatcgatgagcttgaaggcctcggccatggccctcgggacaatgccctgctcatcctcaaggagggaggctggggagacaccgcagggcctcctgccacttcagctggacacggcccatggcccccaggcccggaagctcataggcccctgccagagctggaggatggtgctctaggatggagaaggcagtggccgaggccaggatgggacaggtggcctgagcttggccatgctccagcgtggtcaggcagaattataaaatttaagagttggaagcaacctctcctgattcaatcaacccctttcatgctgtaagcatccccttcactgcatcctcaacagattatcaaataaccttgccttgattactcctaatccatgctcagttatctaaagggcctcctaaatttatcccaaggaaataatcagaggaacttcagagcagcactcttcctcatgacttcaaaaaatgcaaacatcctaagtgtccatccgaagatccaataggagatctggccaaatcaactttttttttttgagactgagttttgctctcgttgcccaagctggagggcagtggcgtgatctcggctcattgcaacctccaccttccggtttcaagcgcttctcctgcctcagcctcctgagtagctgggattataggcatctgccaccatgcccagctaatttttgtattgttagtagagatggtgtttcaccatgttggccaggccggtctcaaactcctgacctcgtgatccgccggcctcagcctcccaaagtgctgggattacaggcatgagccaccgcacctaaccaactattttatattcacaatggaatgccaggtagccattaaaaagttagatttttttttttttggtagagacagggtcttgctgtgttgcccaggctggtctcccaactcctatgcccaagcagtcctcccagctcagcctcccaaagtgatgggattacatgtgtgagcccctgcgcctggcctaaaaagttagattgaagaatatttcatgatacagagaaatgttcatgatacatttgttgttgttgttgtgtttttgaaatggcatctcactgttgcccaggctggaatgcagtgaagcaatcttggctcactgcaacttctgcctcctgggttcaagcaatcctcctgcctcagcctcctgagtagctgggattatagacccccaccaccatgcttggccagttttttgtttgtttgtttttgagacggagtcttgctctgtcaccaggctggagtgcggtggccagatctcggctcactgcaacctctgcctcccaggttcaagcgattcccctgcctcagcctcccaagtagctgggactacaggcatgcaccaccacgcccagctaattttttgtattttagtagagacagggtttcaccatgttggccaggatggtcttgatctcctgacctcatgatctgcccacctcggcctcccaaagtgctgggattacaggtgtgagccaccacgcccggctcagtttttgtatttttagtagagatggggttttgccatgttggctaggctggtctcgaactcctgacctcaggtgatctgcctgcctccgcctcccaaagtgctgggattacaggcgtgagccactgtgcctggccaatgatacattattaagaaaatcaaacaggacacaaaagaatgtatataatataatcccatttttgaaaagtaaaataatcttcccagggaaagaaactggaaggctaacagggcaggggatttccgaaaggcaattatcaagtacattttatttcgtgcatgtgttttgctgtattttcctaattttttttacacaaagtatctttctgtaactgctatggtctgaatttgtttatgctccccaaaattcacatgtagaaatccttacctccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaaggatctttctcgaaactgctccagagcctggctgaagcaccctgcagccctgctgtgcagtatccaaagcagcctcttccaggacacacggcccccattcccaactgctccagctagaacagattcctgaccttccctagccagcctgacaacctctagagacacgccaccttcccgtgcccttcctctgctgaggtccccagagccaggcagcatggcgccatctctatggaggtgagaaggccactcacctccaacgacccttccttcctgccctgcctagcccacagacatggctggtcccagcctgggccacagatccctgtctaggaaatcgactcttcctcccccagcatccccaccttccacagaacaggcagcaagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccag

SEQ ID NO: 1437 - DNA, 605418 bp, Homo sapiens
tagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgcaccccctacccgccctttccaaagatgtctgatctcaaagaaggtgagaagtgaatgagcagagtgaagagtttattttcttctttttctgcctgtttgaaaccggaaccctacctagctttgattttaaagtcttgctgaaaaataacagaccaagaacggtgcgccataggtaataattgataatgggaagggtgagataaacttaaggagacttgtttgtgttccaaaataaccactgcgtcgaagaatttcagtgaaatatattgattttagggagcttgggattaacatggagctatagaataatatgtatatgtatatatatttaaaaacttacaaatttttaattttaaaaactgtctcaaaattgatttttttcttaaaatcaagaaattatagcagtgttcgtcaggggaaaattgattttaaggtgtgttaacttatcctatgtaacttgttttaaaccaacttttcccacttcatgaaatccacagcctttaaaatgtgtgtaatgtatttactagtatgctatacactcttttagaaactgatatcaaattttaaagatgcataattactgagaattaggatgaaagtcaaaaatataccttaactcatacagcatgattagaaattcttactgaagttatgattactttaaattactaaagtgttttttctccctttgtgtgtcatttatcaaaataattagatcaaacaacaacaacaacaaaaacccccaaaagatcataaggaagagaaaaaatgatatcttaggcaggatacaaatgagcaccaataatttattctgggttaatttcatagagtaagtggcgaactattccgcctatataatttgagaaaaatgtaggttacagggagatgtcaaatagactctgaactgtgttataataaaatatattaaatatatgtgattaggtataattttctggctctgccattaacacacaatgacttcggacattcacccatccttccaggcattagtttcttcatttataaaataaagtaattggactaggtgattgcaaaggtttatttcagctaaaaatattatatctctcaaattattacttttagaagaagtaaccaagatacacagactttaaaaatttacaactgaagtacgactgaatcctatctccattttctcatttccatgatgaataaatatagcagtcactccttaatgaatgcctgctatgtagtgaattcttagaaaccctttacataggttatcttatttaacacaataccaccataaattgaatagtagtatatcccaatttatagataatgatactgaagaatgaaaagtttaagctccttgcccagagttccagtttataagaactgggtcaaatattttttccaaatgctcttaggacctatactatactgaatgggatgattaaaagctaaaattgcctataaactgaagtaatcttggactactataagagtctataatggggcaaaggtaaattatgtaacactgagtcttcataccattaaatatataagtgctgtatcagtctccatttattatatcttaaaaagttacatatttatgctgtatatttattaattgaatgccagttgtattctcagaaagtgatcatatgagatatatttgtaacacaaatggttttatggtaataaatataactgctagaaaaaatgtgagagggcagaagctagtattaagcaaatgctggtattaagtatgtcagatgtctttctacttgaaggtactcatgcttgagacaaaaatgcttacacccaagggaaaagggtgttcagagtagaattagctgtgactaaactcttttgttcatatcctatgatgaatcataatagtatgtcacatttattgaatatacgttgtatgccaggaattctcttaagccctttattagtataattttatattggatcatgaattaaattgtattatcctgatttgcaaatgaagaaaccgaggcagagagatctatgccctgggaggacccacaaaaaaatactttttatcttagattaaatgtgtgatcgttcattgttctgaaattcttaggctgtgaatgtaacatgaaatcttgaagcactggaaggagacttggagccaaactaaaccaacctctttattttatatttgaggtaaaagagacctagaacagttaagagacgcacttaaggccacatattttagtcacctatacattctcataaactattaggtaagaagtatcctaatgggtaaacttggttattaattgtttgatttattgtcacgcaaacaaatgccacctcatgccgtttcttatattgctgccctacttttatttaaaatttcaaggttgccccaattaggatgcaaaatccttgaagacagtgattgtattatatatttctcttatatagtatctatagggttcagcatagtggttaacctattgaataagttgctttgttgcctgtttgcctttgataagtcattattttatgcaccaggtctgaaatctacacagtggaagcacaatgccatcaccatttttcacttcatgtagagggcaactagacaatttatgatgcttacaaagtgtaatgagcttcttagataattatttaatttggttataaaatgcagtgtgttaccatggagagatttggatgtgtatttccctgattttggggggacaaattgcatagctaagtatcacacacagttcaatttacctccccaccactctgttcttttgatttggaaataacttttttttctgagtgcaaagataatgcaaagtcatgcaggaaattcagacagtaaagaaataatgaaaaaatcaccagaacctccccagtctaaaggttttggtgaacagccagccagagaggtctttcttctcttaactcctgtcgaatcagggtgagagctgaattatttattgaaaccatttacagtaaagttctatttagttttagtattccattactcctgggcagttcagactttatgtaaataaagatatttgttgagcaatgaagataaacatactactaataaactagagtctactccatgtagaatggagtagtacagaaagttgatttcctcacatcgtatgcctaattttttcctttcacaaggtaggtttgggagcacagggagcatcttttgcatgcatggagggttctccaatatgccaggatcttaggccacacatgaagccacagcaccccagctctgttgccctgagtgaggtgtggcagaggaggagaagggtggagctgaggcacaagcggctgtggtaatacaaaggctgtgttttccgattctactgtgacacactatacacttaaaaatgtaccagaccaagtccctccccgagctgctgggcaggtggtcatggggcccttttctggtgcagtcacgcgtaagtctggctttacctcaaagccagggcaagatgctgatagggcatttctcattcatttattcaggattctgaaaacctagaatggaccctcttttatattaaagggaaacactggctgctggaatcattgtccataaatgagtcttgaagtaatactcacaaaattattaagtataaagaaaagttggggcatctctttgagagagacaatagctctttctgtatgcattcggatgtaattacattgaaaatatttgttttgaagattatgttttctggttattttaatttcataaatctatttgttattcaaaacttctttccctaggcatattttctttgtttatactatacatttgagcagagagatttttcatgcttcactttattaggggcttaacatggctttaatccaaccatctgttcgcatcttggcacatcagcatgtctgaggtgctggtaggggccaaataaatttcccacattttaaaggttagggaaagagctacctttatgaatagatttcaaatgattctcagcaagacaatggtatagaagtggagtaaaaatgcatttcattctctgaagcacaaggtcccctgtctgtcttcagttttgctgaaaggcaattagcatttcaactagccaatttggttacatgcaacgaagtacttgggtttataatttgctgctctgtctgaggctgttgagtgctaggtcttatgtaatcctttccaagtagccttctctccagcatagttattgttgctggtcttaaataactaatcaacagagagttttccttgccttcaactgtagggtgccatagggcaaggaaaatgaaataccaagcaaataaggggatgactgtaattataaatagtcattattgaaatgtggcacaggttgaaagacatacaatagcttcaaataaaatgcaactccaaaaagtcattgtgtgcactgttaatggtttctcatgcagtatgcacaataagcatagggcatacatgctgggattaattcagttaacatgactcaaaattaacaaagaaggtgcaattcctttatgccagaaagaattttgttgggaataggtttaaaagagaaaagattctaaagtgttacaacaaatgaataagtgctctgaggcatattgtggaaataaaggttttgtactgtgtgctaattgaaaataagatttttgtcagcttctttagtcgtgaattttgacaattaggtagtattaatatacttcatgtatacactcatatttctctgaaggagccactgtatggtatggtaatccttttgttaggataattaggatgatattttcctgtaatccatgtcatggaccagcaattcagtgtagctcatcttttggtgtaacactgtttttgcatagatgtacttgtgtaattatttggaggtaaaatagtacatttttcattcttcaagtaatgtttaactgaaagaaggcataatagaaagaagtgttttagatatgtcttacaagtgatcagtataattttgagaacatatgtgaaagaattgattttcatttatatttccaatctgcgattataaagcttttgttacggttatagttagaatcattagttttatttaactaatttcaacagtgttgatgagcaggaatgaaatgaagagagcttgttccttctctggcagactagtaagctaaggttggagagtgttctggaaaaagtgggacttgattgggactttgaaaaatggtggaagagagggagtggaaaaaggtagagaggactgggactagcttagattaaaggtgcagaagcatgaataatacaagtgttttgtcccagacacgtattagattaacctggctggaaatgttgaaagaagagaaagagatagctggaagtgcagaggtttgattgttttttaaattgatagataattcacatatgaaaaacaatcacctttcaaagtacacatttccatggcgtttaatatatatatatatttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactgcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccggcgtttaatatatttaaaaagttgtggcctgggcgtggtggctcactcccgtaatcccaacactttgaaaggccaaggtgggcgggtcacctgaggtcaggagtttgagaccagcctgaccaacatggtgaaaccctgtctatactaaaaatccaaaaaaattagctgggcgtgttggcgggcgcctgtattgccaactacttgggaggctgagtcaagagaatcgtttgaacgcgggagacagaggttgcagtgagctgaaatcccgccactgcactccagcctgggcaacaagagcaaaactccatctcaaaaaaaaagttgtgcaaccatcaccactgtctattccagaacattttcatcacctccaaaagaagctctctacccattagcttttgctctctatcccacctttctccactgccttccaattcctggaaaccagtaatctattttctatctctatagatgtgcctattctgggcattttgtataaatggaatcatacaatatgtggccttttgtgtgtactttcacttagcatgatgttttaaagattcatccatgttgtaccatgtagcaatacttcaatccttttgtaaatgccaaataatattccagagtatggatatgccacctttcatttatgcatttataaatagatgggtgtttgcattggttttactttttgactattataaataatgctgctttaagcatttgtatacaagttttttttgtgctgacataagttttttgttctcgtagtggcccatctaggagtggaattgctaggtcatattgtcaccctgtgcttcattttttgaagaatttccagctgttttctaaagtgtgtttaccattgtatatgcccaccagcaatgtatgagagttttgatttctctctgtctttttatgttaaccatcctattcggtgtgaagtggtatctcattcgggttttgatttgtatttccttaatgactaatgatgttgagaaccttttcatatgcttgttggtcatttgtgtatctcctttggagaaatttctattcaggttttttgcccattttaaaaataggattttgtttttgtttttgttttttattgagtcataagagttcttcgcatactctagatactaatcccttatcagatatatcatttgcaattttttttcattgtgtgggttgtctttttactttcttgatggtgtcctgtgaagcaaaatgtctttaattttgttgaattaatttatttaactttcctttggttgcttatacttttggtgtcacagctaaacaactgttgcctgatacaaggtcacaaaaatttatacccatgctttcatctaagagttttatagtttaagcttttacatttaggtttttattccattttgtgttaatttttaatatgatataagcttccttcatttgcacatagatatccaattatccaggttccatttgctgaataaatcattcttttttcattgaattggctaggcttcactgtcaaaaattaattgactataaatgtatggttttatttctggactcaactctattttgttgatctagttttctgccagtacctcacagtcttgattattttacatattttgttaaatttcttcctaagcattttattgttttattaattatgttgtaaatgcaattattttcttaattttatttttgaattcttcattactaatgtatagaaataacaattgattcttgtatattgattttgtattctgtaatcttgctgaactcttttatttttttatgtatggtgtttttaggattttctatatacaatatcatgtcatctgtagatatagtttaatttatcttttccaaggatacgttttattttttttcttgcctaattgtcctgcctagaacttccagtaaagtgctgaatagaaataatgagagctgagatccttgtcttgtcctgtgatcttagagagaaaacttttggtctttcagcattaagtatgatgtggatacccattatagataccctttgtcagattggagaattatccctttattcctaatttgtataataaaaagatgttgatttttttcaagtgctttttttgtgtcttttgagatgatcatgtgattccctctgctttttttctattaatttggtacattgcattaattggttcttgatggtgaaccaatgtagcattcttggatagatctaatttggttatatagtgtatcatttgttttatatgttactggatttggtttgctagtattttgttaagagtttttgtgtcaatattcataagggatacttgtcttagtttttttcttggttctttttttccataatgtctttgtctggttttagtatcagggtaatactggccttataaaatggtttgggaagtcttgtgttttatatatatatttttaagtttgtgaagggttgatgttaattattccttaaacatttggtagaattcaccagtgaaaccatctggtcctggactttcttcatggtaagttttgcaattactaattcaatctatttaattgttgtgggcatattcagatttttaatttctttttgagtcaattttggatgttcgtatcttcctagggatttgtttacttctaggttatctagtttgttggcatgtaattgttcatggtcatgctttatatactcagttttatttctgtaaagttggtagcaatgaccccttttgaatttctcattttagtaattcaaatcttcttcccttttttcttaatctagccaaagttttgtcagttttgttatcttttttttttttttgacagaatcttggtctgttaccccggcgggagtgggagtgcagtggtgcgatcttgtctcactgcaacctccgcctcctgggttcaagcgattctcctgcctcagcctcctgagtagctgggattacaggcacctgccaccacgcccagctaatttttgtatttttagtaggacagagtttcaccatgttggccagctggtctcaaactcctgacctcaagtgatccacccgcctcggcctcccaaagtattgggattacaggcatgagccaccatgcccagtcccttttattatcttttcaaagaaccaacttttacttttgttgattttctctgttgtatttctattctatattttatttgttcccactcaaatattttttctttgtttccttctgcttgatttgggtttagtttgcctgtttttttctactttcttaaggtggcagtttaggttctttatttgagatctttcctttttttaatatatgcatttgtgcctgtaaattctcttccaagcattgctttaggtgcatcccataagttttggtatgctctgattttattttcattaatctcaaattattttctaatttacatgtgctctcttttttgatcctttggtcatttaggagtgtgctgtttaatttcaacatgtttgtacattttgcacttttttctgttattaatttctaatctcattctcttatggttggagaatatactttgtatgattaaagttctttaaatttattgagacttggtttaggaccttacatattatctcttctggagactgcttcatgtgtacttgataagatatgtattctgctgttgtggggtgaagtgttctatagatgtgtattaggtctagttagtttacagtattttttaactcttcccttttcttgttaatcttttatttagtcgttatattcagtattgaacatggggtactaaagtcactaactataattgttaaattgtctgtttttcccctcaatttggtcagtttttaattcatgtgttttgggattggctttttatgtgcctgtaggtttacaattgttacatctttctgataaattgagccctttatctttataaaatatccttctttgtctgtagcaacattttctgtcctaatgtctattttgtccaatattaatgtcttagtccattttctgaataccagagattgggtagtttataagcaatagaagtttatttgacttacagttttggaggctggaaagtccaagaacttggctctggtatctggcaagggcttttgtgctatgttattccaggatggaaagttagagggcaaacaagcatgtgagacagagaggggaaattagaccaaacttatccttttatcaggaggccactcctgtgatgactaacccacccccctaatagcagtattgttccattcatgagggcaaagccttcataatgtaatcacctcttaaaggtcctacctctcaacaccgttagttacaatggcaattaaatttcagtatgagttttggagaggtcattcagaccatagtaatgaatatagtcacttcagctttcttttggtttctgtttgcatgatatatatatatatatatatatatatatatatattttttttttttttttttttttttttttctcattcttagtttcaacctgtttgtggctttgagtttaaagtgaatcacttataaagagcatatagttaggtcattttttccaattcattctaatgacttctgccttttaattggagtatttaatccagtaatatttaatgtaattactgataaggtaggattgatgtctaccattttgctatttgttttttgagtctatgtcccttttcatcccctgttcctcttttactgccttcttttattttacatagatattttctagtgtatcattttaattttgtggttgtttcttttattatattcttttcattaattttattattggttaccctggggattacatttaatatcctaacctataataatctagctcagattaataacaacttaatttcaatagcgtgcaataattttgctcctatatagtttcatttctgcccctgctttgtgctgttattgtggtacaaattccttttttatacagtatatactctttagcacaaatctattattattgctttatgtagttgtcttttcaatcagagaggctaaaagtagttataataaaagtacatttatgccatcttttatatttatctgtcatgtgaccttttctggcactttacatttttttctgtggattcaagttactctctaatgttctttcatttcaccctgaaagactccttttagtatttctggaaaggaaagttgctaaccacatagtgtctcactttttgtttatccaggaaagtcttaatttcttcttaattttggaatgacaattttgttgcatatagtatccttggtttattgtctttcagcactttgaatacatcactgccttctagcctcctaggctagaggagaaatcagatattaatcaggatatcacttttatgtgataattttcttcttccttcctctttcgtgattctctctttgtcttttgctttggcagtttcgtatatgtctacatgtggatctctttgtgtttattttacttagagtttactgagcttcttagatatgtagattaatgtttttaaatcagatttgggaagccttcagccattatttcttcagccatatttctttaactactttctgttgttagtcttcttctgggagttccactaggtctatgttggtatattttgtggagtcctataggactctgaggctctgttcatctttcttccttattttgtctttttgttcctcagcctgggtaatttcagttactttcatgttcactgattcactcttctggctgcttaaatcagctgttgagcccctctgtgaatttctcaatgtagttattttacttctcaactccagatttctgttttttttttttaaactatctttttgatatcattcatttgatgagaaatcatttttatactttttattgtttatatagacatgatttcccttagttctttgaatatatttaaaacagttgatacaaagtctttgtctagtaagtctaacatctggtatgttctccagggacagtatttatcgattacttttttcctgtgtattgctcatattttcttgtttctttccatgcttggtatttttcttttttaagaaactgtatggctttgaagttcagattctccctcttcctagggtttgttgttgtccctgattttattgttgtttgtttagtgaattttctgaagtctttttaaagtatgtactctttgttatgtgtggccattgcagtctctgcttggttagcttagtggtcagctaatgagtggacagagattttcttaaatcctgggaaacagtaagtctcccagtttttgcttgggagctccatgtgcgtgttgaagaatacctttagcattcagccagaaaattttcaactctgcctaaccttcacttcctctttgcacacagcctcaaaaccagccagaggtgagaatgtagggcttttacaggtttttcatgaacatgtgcacagccttatacttgtgtgtcatcttctaggttctaggaatatgtcagaaatttttaaatttgcaataaatgtctcattgcccagtctttccttttaagcttttagttagcttattgttttcccagctgttatctattacctctggcagctattatgttacataattgtctataaacatttttgacaagtgcctctaaggaaaaggctttcaaatactgggcaaactttgagtcaggtcaaataaagatactgtggtgagtgaagtcttcaagaaaccactagatagatcaaacaatgacaactctgtgaattgggctttgatggctttcctaccccattctgttcccttcagtggctgccaggatgctggttttaactgttattgcaggctgttagtttttaaggtgactttggaggctgggagagttgtgtgggaataggtcaagtttaaatgtaataaagttcactgatttcctggagattcagctgtatttctttaataaatgctccttggaatcctgcaagcccttggttaatttctgaagttctgcaagcattgattctgacagtttttgctagttttctcattatttttatggagcagaggattttaggaggtccttaccctgacatttgcactggtttggattttcagagcaaacattagggcttccccctacctcttgttagatattatggaatcactgtcagtttttgaactacagactgatataaaaatagtcttttgaagactattctgttggtaatgtagagaaggctgattggaatgggcagaagagagcaaattaataaaggcaataacagtggatgtatgttgataagctcttgttttgggtagcagcaaaacaatgttaaatgaaggataaaggaggcatttaaagagggtgtcagaagtacttggtgaccttttgcatgacttctgtatttaagcaggtttgatgtcaataatataaaataaaataaagtaaaataaaataaaaaagttcttctgaagaatatgtcatccatccagtcatccattcattcaccaaatacatgtgaatgaactggtacgaaagcagaaacaaagaccaatggaacaaaatagaaaacagaatagaaataaaactgcacacctacaaccatcttatctttgacaaggccaacaaaaacaagcaatggggaaaagactgtctattcaataaatggtgttggtataaatgtgcacacatgctcacacacgcacacgcacgtgcacacacacatgaattaacaatatctaacaaattatgctttgatggatgtagagaaaaaagagtgaataattttcaaaggaaaaaagttgagaccgtaggatacgtgttttgggactagccttggaaaagggaaggatctcctgtactgtgagagaggagaaaataaagtaattgggggaaattggaattagaatggactggataggaggaaggatacgtcagagaatgtattcatgcccttcctcacctaccaggaagggtggataaaacagacaggtggcatttaaaaggaatttgtccccattcttctgtatattttgttaaactcaggatcaagttatggggcaaatgcatcacagatggcttgaaggtttcccttagatctctccgtgtatagatctactaattaagtaagaaatttaaggccaccagattgtgaggaaacacaataaagtaatgctttccaattcagtttttcccttcagcactgggatgtagcttttcctaagaaaggaagtatggtattggttggcataatgattgagctctccaggatattgctaaaatcagaaatgtggttgaatattatctgattcccactgaatccattccctgatggcttctgtctttttggtggagacttatctaaattacagtcatgcattgcttaatgatgaggatatcttctgagaaatgtgtttttaggtgattttgtcatcatgcaaacatcatagagtgtacttacacaaacctagatggtataatgaaccacacagctgggctatatgtatatcctatggctcctaggctaaaaacctgtacagcatgctactgtattgaatactgtaggtaattataacaccaaggtaagaatttgtgtatctacacatacctaaacctagaaaaggtgtagtaaaaatacaatattataaccttatggaccaccatcatatacctggtccatcactgactgaaacatcattatgcagtctatgactgtatgttggatgaactgccaaaatgagaaataaattattgttttcttctgagacaaattattgaagttttaaaatgttgtttttttaaatgagagaaatttaataaatcacttgattgagaactgggcattaagtaaaaattaagtcccatttaccaaagcataatttgtcagatattgttcattcatgtgtgtgtgtgcacgtgtgcatgtgagcatgtgtgcatgtttataccaacaccatttattgaatagagagtcttttccccattgcttgtttttgttggccttgtcaaagatcagatggttgtaggtatgcagctttatttctattctgttttctattttgttccattggtctttgtttctgcttttgtaccagtaacaagctgttttggttactgtggctttatagtatagtttgacatctggtagtgtgatgcctccagcattgctctttatgcttgggattgctttgtctattgaggctctttttcggttccatgttaatttcagaatagttttttttttttaaattctgtgaagaatgatgttggtagtttgataggaatcgcattgaatctgtaaattgctttggtcagtatggatgtttttatgatattgtttctttcaatccataagaatagaatattttttcatttgtgtcatctgatttctttcagtaatgttttgtagttccccttatagagatctttcacctccttggttagctgtattcttaggtatttcattttctttgtggctattataggtgggattctgttcttgatttaactttcagcctgaactttgtgtatagaaatgctactgatttttgtacattgattttgtatcctgaaagtttactaaaattgtttatcaattctaggagcctttttgtggagtctttaggattttctagatatagaatcatatcgggttgacgccagcttcatagagtgagttagggagaagcccattctcctagatttttggaattagtttcagtgggattgatatcagttccttgtacgtctggtagagttcagctgtgaatccatctggtccaggatatgttttggttgttaggttccttatcactaatttaatttcagaagttgatagtggtctgttcagggtttcaagctcttcctgattcagtcttgggagattttgtgcttgcaggtgtgtatccttttcctctagattttctaatttgagtgcatagagttgttcatactaggctctgaggattttttatatttctctggaatcagttgtaatataacttttgtcatttcagattgtgcttatttggatcttctctttctgtttctttgttaatctagccaggggtttatcaattttatttattttttttcaaagatccaatttttggtttcattaatcttttgaatgaattttgcatcttgattttgttaagttctttaattttagttatctcttttctgtgggtagctttgggattggtttgttctttttttcctagttttttttaggtgcaaagttatattgttgatttgagacctttctaactttttttttacttttaaaaaagacattttattttattttattttgtgttatgttattttattctttgagacagagtctcactctgtcacccaggctggagtgcagtggcatgatcacagctcactgcaacctttgcctcccggattcaagcaattctcatgactcagcctcctcagtagctgggattacaggtgtatgcatcacgcccagctaatttttgtatttttagtagagatggggtttcaccgtattggccaggctggtaaaaagggatattttaatacaaaggaagtagtcaaagaattctgagctcagattgcaggatggcccttttcaaacagaggcagctggccgcttaccttgccttcattttccaggggtttctcctcccatgaatggacagcgaaagcttcatcctagaccaatcctgtctccacgatggctttggggacctgccttgccccagggttttgtctacaggcctggcaactttgaccatgagaggcagactccctctaactggaggctgacaagtggaaactgttcggattattcccagagggcttacatgggggcgggtcatcctggtgaattctcaggcatgatccaaatctgcctcctaggcacagaacaccattctccagggtcgcagtgctgcctggactccaggaagccagtctctgctgctcctggtgtgcccctaggggtggccgaggttagtaaggcctcccctcactggagcagaagacaaagtgatttatcttgatccctgtgaaatggttgcacaaccccaagagcctgagactcatcaaagaatgtccctctttatttcctgttcattacattgccatgcgcaattcagacaagacatcccagcactgcttccagtcctctgcttaagggtgggattctattattattattatactttaagttctagggtacatgtgcacaatgtgcaggtttgttacataggtatacatgtgtcatgttggtttgctgcacccatcaacccgtcatttacattaggtgtttctcctaatgctatccctcccccagccccccgccccacgacaagccccagtgtgtgatgttccccgctgtgtgtccaggtgttctcattgttcagttcccacctatgagtgagaacatgtggtgtttggttttctgttgttgtgatagtttgctgagaatgatggtttccagcttcatccatatccctgcaaaggacatgaactcatccttttttatggctgcatactattccatggtgtatatgtgccacattttcttaatccagtctatcactgatggacatttgggttggttccaagtttttgctattgtgaatagtgccgcaacaaaaatacgtgtgcatgtgtctttatagtagcatgatttataatcctttgggtatatacccactaatgggatcactgggtcaaatggtatttcttgttctagatgcttgaggaatcgccacattgtcttccacaatggttgaattaatttacagtcccactgaccaacagtctgaaagcgttcctatttcttcacatcctctccagcatctgtttcctgacttattaatgattgccattctgactggcatgagattgtatctcattgtggttttgatttgcatttctctgatgaccagtgatgatgagcattttttcatgtgtctgttggctgcatcagtgacttcttttgaaaagtgtctgttcatatccttttgaccactttttgatggggttgtttgttttttttcttgtgaatttgtttaagttctttgtagattctggatattagccatttgtcagatgggtagattgcaaaaattttctctcattctgtaggttgcctattcatgctgatggtagtttcttttgctgtgcagaagctctttagtttaattagatcccatttgtcaattttggcttctgttgccattgcttttggtgttttagtcatgaagcccttgcccatgcctatgtcctgaatggtatgctgaagttttcttctagggtttttatggttttaggtcaaacatttaagtctttaatccatcttgaataatttttgtataaggtacaaggaagggatccatttttcagctttctacatatggctagccagttttcccagccccatttattagataaagaatcctttccccatttcttgtttttgtcaggtttgtcaaagattagatggttgcagatgtgtggtgttatttctgaggcctcttttctgtgccattgatctatgtatctgttttggtaccagtaccatgctgttttggttactgtagccttgtagtatagtttgaagtcaggtagtgtgttgcctccagctttgttgtttttgcttaggattgtcttgacaatgtgggctcttttttggttccatatgaagtttaaagtagttttttccaattctgtgaagaaagtcagtggtagcttgatggggataacattgaatctataaattactttgggcattatggccattttcatgttattgattcttcctatccatgagcatggaaggttcttccattagtttgtgtcctcttttatttcgttgagcagtcctttgtagttctccttgaagagatccttcatatcctttgtaagttggattcctaggtattttattctctttgtagtaactgtgaatgggaattcactcatgatttggctctctgtctattattggtgtatggaatgcttgtgatttttgcacacggattttgtatcctgagactttgctgaagttgcttatcagcttaaggaaattttgggctgggatgatggggttttctaaatatacaatcatgtcatctgcaaacagagacaatttgacttcctcttttcctgattgaataccttgtatttctttatcttgcctgattgccctggccagaacttccaacactatgttgaatagaagtggtgagaggggcatccttgtcttgtgctggttttcaaagggaatgcttccagtttttgcccattcagtatgatattggctgtgggtttgtcataaatagctcttattattttgagatacattccatcaatacctagtttattgagagtttttagcatgaagtgctgttgaattttgttgaaggccttttctgcatctattgagataatcatgtggtttttgtcgttggttctgtttgtgtgatggattacgtttattgatttgtgtatattgaaccagccttgcatcccagggatgaagccgacttgattgtggtggataagatttttgatgtgctgctggattccgtttgccagtattttactgaggatttttgcatcgatgttcatcagggatattggtctaaaattctctttttttgttgtgtctctgccaggctttggtatcaggatgatgctggcctcataaaatgagttagggagaattccctctttttctgttgattggaatagttccagaaggaatggtaccagttcctctttgtacttctggtagaattcggctgtgaatccgtctggtcgtggacttttttggttggtaggctattaattattgccataatttcagagcctgttattggtctattcagagattcaacttcttcctggtgtagtcttgggaggttgtatgtgtccaggaatttatccatttcttctagattttctagtttatttgtgtagaggtgtttatagtattctctgatggtagtttgtatttctgtgggatcggtggtgatatatcattttttattgagtctatttgattcttctctcttttcttctttattagtcttgctagcggtctacctattctgttgatcttttcaaaaaaccagctcctggattcattgatttttttgaagggtgttttgtgtctctgtctccttcagttctgctctgatcttagttatttcttgccttctgctagcttttgaatgtgtttgctcttgcttctctagttcttttaattgtgatgttacggtgccgattttagatcttccctgctttctcttgtgggcatttagtgctataaatttccctctacacactgctttacgtatgtcccagagattctggtatgttgtgtctttgttctcattggtttcaaagaacatctttatttctgccttcattttgttatttacccagtagtcattcaggagcaggttgttcagtttccatgtagttgtgtggttttgagtgagtttcttaatcccaagttctaatttgattgcactgtggtctgagagacagtttgttgtgatttctgttcttttacatttgctgaggagtgctttggttccaattatgtggtcaattttagaataagtgtgatgtggtgctgagaagaatgtatattctgttgatttggggtggagagttctgtagatgtctattaggtccacttggtgcagagctgagttcatgtcctggatatccttgttaaccttctgtctcgttgatctgtctaatgttgacagtggggtgttaaagtctcccattattattgtgtgggagtctaagtctctttgtaggtctctaaggacttgctttatgaatccgggtgctcctgtattgggtgcagatatatttagtatagttagttcttcttgttgaattgatccctttaccattatgtaatggccttctttgtctcttttgatctttctttattggtttaaagtctgttttatcagagactaggattgcaacccctgctttttttttgctttccatttgcttggtagatcttcctccgtccctttattttgagcctatgtgcatctttgcacatgagatgggtctcctgaaaagagcacactgatgagtcttgactctttattcaatttgctagtctgtatcttttaattggggcatttaacccatttacatttaaggttaatattgttatgtgtgaatttgatcctgtcattatgatgttaactagttattttgcccattaattgatgcagtttcttcacagcattgatggcctttacaatttggcatgtgattgcagtggctggtaccgattgttcctttccatgtttagtggttacttcaggagctcttgtaaggcaggcctggtggtgacaaaatctctcagcatttgcttgtctgtaaaacttcctgttggggaagttctcctggataatatcctgaagagtgttttccagcttggttccattctccctgtcactttcaggcacactaatcaaacgtagatttggtcttttcacatagtcccatattttttgaaggctttgctcgttttattttactcttttttctctaaccttgtcttcccgctttctccttcacttagtttggctggatatgagattctgggttgaaaattcatttctttaagaatgttgaatattggctcccactctcttctggcttgtagggtttctgccgagagatccgctgttagtccgatggacttccctttgtgggtaacccaacctttctctctggctgcccttaacattttttccttcatttcatccttggtgaatctgacagttatgtgtgttggggttgctcttctggaggagtatctttgtggtgttctctgtgtttcctgttggggaagttctcctggataatatcctgaagagtgttttccagcttggttccattctccctgtcactttcaggcacaccaatcaaacgtagatttggtcttttcacatagtcccatattttttgaaggctttgttcgttttattttactcttttttctctaaccttgtcttcccactttatttcattaatttgatcttcaatcactgttatcctttcttccccttgatcgaattggctattgaagcttgtgcatgcgtcacgaagttcttgtgccatgtttttcagctccatcaggtcatttaaagtctcctctacactgtttattctagttagccattcgtctaaccttttttcaagtttttttagcttccttgcgataggttagaacatgctcatttagctcggagaagtttgttattaccgaccttctgaagcctacttctgtcaccttgtcaaagtcattctccgtccagctttgttccgttgctggtgaggagctgtgatcctttggaggagaagaggtgctctagtttttagaattttcagcttttctgctctgatttctccccatctttgtggttttatccacctttggtctttgatgttggtgacctacagatggggttttggtgtggatgtcatttttgttgatgtagatgctattcctttctgtttgtgagttttccttctaacagtcaagtccctcatctgcaggtcaattggagtttgctggaggtccactccagaccctgtttgcctgggcatcaccagtgaaatattgttgcctgatccttcctctggaagctttgtcccagaggggcacctgcctgtatgaggtgtctgtcggcccctactgggaggtgtctcccagttaggccacacggggctctggcacccacttaaggaggcagtttgtccattctcagagctcaaatgccgtgctgggtgaaccactgctctcttcagagctgtcagacagggctctaacttcttgataaaggtgttttaaggctattaagtttcttcttaacactgctttggctgtatcccagagattttggtaaattgtgtctctactctcattagtttcaaataatttttacatttctattttaatttcaatgttcacccaggagttatttaggagtcagttgtttaatttccatgtattgtgtaatttggagcggttttgttggtattgcttttcatttttattgcactgtggtccaagagtgtacttggtatatgatttcagttgttttttatttattgaggcttgctttatgaccaagcatgtgttttttttttttttttggaatgtgttctgtatgcagatgagaagatgtatattctgtggtcgttgggtggagtgttctgtagatgtatattaggtctaattgctcaagtgttaagcttaattccagaatttctttgttaattttttgcctcaatgatctgtctaacactgtcagtggaatgttgaaatctcccactatttttgtatggttgtgtaaagtcttttcttaggccaagaagatattgttttataaatctgggtgctctagagttgggtgtgtatatatttaggatagccagagcttcttgtcagattgtaccctttatcattctgtaatacctttcattgtccttcttaacttttattggtttaaagtctgttttatttgatataagaatagtgactcctggtctttttaattttctgttattgataaatcctactccactcttttactttgataaattttttttagagatgggatctcactctgtcacccaggctggagtatagtggtatcatcattgctcactgcagccttgagctcctggattcaagagattatcctgcctcattctcccaagtagctgggactatcagtgtgcaccaccatgcccagctaattaaaaaacaaaacattattgtaagatatggggtctttctgtgttgcccaggcttgtctcaaacttgtcttcaagtgatcctcctgctttagcttcccaagtggctgagatcacaggtgcaaccctccatgcctggcttagtttaaaatgaattcacttcgtatcttaaattttctaatataaataaatgtacaatcataaatacatctgtattaggtattttcattgggtagtgttaaattgaaaacatcactataataaatatatttctaaaacttatctaggatttatttttctaccaaaagtataaataattggaaacaatctttgagtattattgtaaagcaatttgatcattgtgtggcagttttatatagtatttaagtagtaaagtcgggaaactttggaaattgttcatgctttcaggtgactagaatgccctagcttttataagtcagtagcatacctagtagttgagaccttagtataatatatgattaatagactttcctgaagctttttagcttccgagagactttacttcatctcatttttcatttctcagtaatattcatgagtgatatatattaggaattggtcattaattcattctttttttactgaagcactctaacatgagtttgaaaaaaacattgagctggcaatttctgctttcacattttattacagcctcaaaacttgttttataatgatttttagtgatattttaacatctttatgatttcatggcaccatacatttggaaattccattcctactcttctagctaccaaaaacttttccctccctcccctggcacacttctttcagcataggagatgaatgtaaccatagaattagggccccatacttgcattttttcattacttttgttctgttgaggtatcatgatagccacaaaaaacatctaggcctacaactaattaccttgcaaatggtaaatcactgtgggtttgaaattgtatgtaatatgaccattcttattacatagttaatcactaggtgtaagggcttttctattcattaatgttggaaataacagactgtgctgcccataagagactgagttggattatagagagaagagagtaaaatgtgcacgtttcatttgatggtatttttaatacgataggtgctatagatatagtgattttgaaaatgatctttcccatatgactattagtaagatttctttgttaatagaaaatgtatatttagaattttgttaagagtataagagctggactctgatggcttgggtttatatcctggccatttccaaagtgtaatttggcgaatatatttaatccctctgtaactcaggttcctcatttcacaatgggcatactaatagtacctatattatacaatattttagatggttattgggaggattaactgagtttcatgtaaagcagttaaaacagcatgtagtgcttggtaaagttagctgctattagctaatactgtgacacgtaaaattcaaattattaatgattcgggtgcctaaatgaaacttttttttccttagctcctttttcttcttctagaatcccgaagaatgtttaaatttaccttgaagctgctagagctcaagcttcagcccctaagcattttgtttttaatttttacttttcttcttgaagcggagtcccaaattatatgtatgtgctttaggcataaccaacttctctaaaaattaatgacttaaaataaccacttgttttgctcatgaatctgtaatttgggtagagcttggtggggaccacttgtctctgctgtatacagggttcttggggcagcccacctggggctggagtatccttttccaagatgtcttactcaagatggctggcaaattgatgctggctgttagttctccatgtgagccactctgtggggtgactttagcttcctcacagcatcatgactaggtgtcctgagcagtcattgagcaagtggtgcaagagaccagaagtggatgctgccagtttttaaagacttgggactgaaagccagcctgtctttgctagaagtaaatacagtattaagttctactatattttattgttcaagtggccatagaacccacgtttaagaagaggggataaacaacccaccttttaatggagaagtgtcaaaaaattttggttccatattataaaaccaccacactgcatttgctattaattaaaataataacaagcaaggtagctattatggactactttgttgaagtgtacccatttgacagaggatgtggtttctgggttactttaaaaaaggaaaaagccactttgacctcctgatgatgatatattcatacttttgttttacactggaatttcaactgaagcaccaacaaatatatcagatgtcaaaatgagttgtgagaaattatccaaacacaaaatttcaaagaatataacaaaatgagttatataacttttgaattctctcacttacattgagtgtataaaaaattcaagggtaaaatctgagagagaattttctgaggagaattttctgaggagaatttatattgggagaactgtgggggtgcatcccctgtccctctgcccctcatgtgtatctgtgcatcatcgtaagtgtggtgagaagggcttcaacaaaaccccttggagagtatgattttttgcttcaagacaatgacaaaagtcctgatctattactgagggaattaaggaggcctagggttgtaggatggagggcggagtctggataaactgtatcacctcccacagcagggcaaatggaagtgagccccagggctggctgtgaaacctgtggtaaagacgttagcctgaggtcattttaaagggatcctgcccagagggcagcctgtcaggggaaggggagcccaggagtacattgctatgggcatattgtcagaagccatattgtcagaagctgaaattgaaggagatctagattagtcagctgaaagagaagcagtcccgcatgttaggattgaagttgatgggtcctgcagtgagacctctgtagagacttaaaattccactacaatgattcagccaaggacatagagaacgaagccatcttatggcagtccagtcaaataagaacctttctaacctcttctcagttctgatcttattcaaccctcaccttgctctgtccttagtggggatgggaaaccagttggccagccgagtgaggaagaaaagtatcgacaggcaaaaagaaaagatggacaataactctttctccagctgtaagccaccagcttgcagcagtccctagttggggcagaagaagagttaatgttaaatttaagttagagctttgattattatgtggagtgtgccattaaatatttttattataaaagctttccaacatgcacaaaagtagaatagtaaaatgagcccctttttacctccgacttagaattagcaattatcaagattttgccatacttgtttcatgtatgtctacataatatagagtgcagctataaaatgtatggatattttcctacataactacagtgcttttatcctacctagcaaaactaacaataattccatagtattgttcagtaataagtccaccttcaaatttccttgattgtcttgaaaatgtctttttatagttaatttattctaattaaaatataactaagttgtagatagtttatctgacagtagtcttcttggcatctcctacccaccaaccaacagtgatttgttgaagaaatgtggcaatttgtcccatagaatgtccatgttctgaatttgtttgttctcttttttggattacttcacatgtttctttagcccccatttttcctgtaaactggaagttagctctaaagccccaattagatttaggttctgctttttgggcaagaatgctacatcggtatggtgctgtgaatttcatattgcatcacatcaggaggcacaccgtgtctggctctatcactttagtgacattgggattcagcagtgggttcaggtggtgacagctcagtcctttcattgttaagtttcccattatctttgtatctaattgtttcatccatgcatgctggcttccttgattattttactaggagttacaaataggtgcttttctaactctgtcattcttacctcattagctggaatttttctgtaaggaaaaactttttccttaacaacttggctatttggttacctggaaaaggagtttacctaggatagacaggataaatgtttaattctttccctttaaatattaatttcagagtaagtagtttgtgccctagttaccttcagtggtggccattgaactgactttctttccatctttcttttcatccctatgaacatatggatttatatattccacgtgtttcaaacaatcacattcattatccctttagatactcaaaaattttaatctttagccaatgggaacgctttcatgtttctcttgtgacgtgaccccattactcttacctggtttccttgctcaagatgttcaggtttattttgcatatttctttccccagataccagtcattcctctaaaaagtgctgcttccttgtagtggggaatgatggttagaggcaaaagtctgggcccttatgatccttattgttattgagttgtcattacttggaagtctttttagtggacagagccaggaaatatgtattttttacaaagaaaaaagtcatgacgtgatactgatatttccagtttaaatttaaccttacagaaactttacatgatttctttgatgattttattgtcatttctcttttctgtgtcttttttttttttttttttttaaatggagtcttgccctgtcatccaggctggagtgcagtggtgcaatcttcgctcactgcaacctctgcctcccaggttcaagctattcctcctgcttcagcttcctgagaagctgatactacaggtgcgcgccaccatgcccagctaattttttgtatttttagtagagatgaggtttcaccatgttggccaggctggacttaaaactcctgacctcaagtgatcctcccgcctcagccttccaaagtgctgggattacaggcatgagccactgtgcccagcgtgttttctcttaagtaattattatttgctctatcctacaaaatgtatagtttcaaaatatatatctacagtatataaaacgtggtttcaaaatgtatattctatagcataaacatttaatttcacataattatactgatattaccactgagaatatttaatgaaatataagctttctttacagctgtatttgtccttagaatttattctactaggtatagacagtgaaaatactgtattctatagccactagaaaaatttatgtctgtgctattatcactactttatattcagttgctttatttcagttatttgccagtatatatgcatttacttataaaagaaacgttggtgacttaaaacctagtagaaatgattatctatagagggaggaaaagaatgggtaaatggaagtgagcattctctgaatatactttcttatataggtttaactttggattcatataaatgtgttatatatttagaaagtaaaaatgagattaaaaaatcttcacctggagatgccaaatagtctcatggagataatgagtttggaatttaggggaagttaggaaatttttggaagttaggctggagatgtaaatttgggagacggtattttaaattacaggtgagtgaatgagaccagagtgagtctgaatgtggatgaagcagtctgagcctgagaagtgatacgtcccatgacgtagaggtcagaaagaaggcaagggttcagcaaaggaggcagaggggcttctagtgaggtgagaaggaaaaccagaggagtgtggtgtcaggaagccacaggaaaacgtgactcaagaaggaagaactgaccatgtgccctcccactcactttttgtattgctatcctttcgtatgttctaaaccacaaatgaatatctaaagagtcataagaagtagctgaagttagggaagcgggggatatttagagtgggagggtacaactctgataatgggaaagtgagtccaagtgagaagttgaagtaaaccaattcattgaaaactttaactcggagcctaactgcctccttataacctcagaattctcagctgattttgcaacttagatggaaatcaggaattaaaagagcatcaaactaaaattttcagtcagaataataagaagctaaaagtattgtctttcaagaaacacaaagagaaaaataaagatatcttctatttttttaaaggcaattgattagcctaaattttttgattgaaggaaaagacaattatcatgatagaaagtgagggtggagtgggtggtataacttcaaagtgttctgcacgctggacacattgatcaaaggcaaaataataaaagagggaagtctgaggagtcattacattattacaaaaagactccccgtatttcagtttatgacaccagagttcctaagttgaagtcaagagatgaaagataccatagttgatgcactcaatgaattctgttaatggcttccttttcacttgtgaattttcttcaaaggtaagttttaggtacaaaggatttcacagaaggatgtgaaatacatgcatgtggagggaaactggcttctctcctcaagcaatgtattatggctgagaaagaaagtgtggaatggaagaaaagtggggaatggtaaaaatacaatagatgatctgttttttgtttcaatgtctatatgcttgtgttgattaagtgatatttttgccttttttattttataaaaacatttgacatgtatgaaacatgttaaggagttccctgtttgcttatgggtggagaagacattaatctaattctaactataaggttgtaattaagccctgggtgtttatacccacaattcaagtgctagattctgggtgttaaatgatcttagttttaaggttttggttcagagttctaatttctggaattttgcttttcaaaaacagcatcagaaatgaccaaaagtaaaatatattcaatgtagaaactatggaaaacatagaaaagcacaaagaaacaccaaaattactgaaaaactctgtacctaaaggttgaccactgttcttccagtgcttttctatggatatactcacttatatacataaatatatttgtacatttttttctattttaatgtaaaatattccattttagattaacatgctgcatcatgaaactcatttaaaatataccttgatattttatgatatgacttcccttattattttaaataattataagaattaaaatgacacgttttgttgtatttcatttgaggaattcatgtgtattcaaacagcaggatcagaaacagagatattttgttatctattgctatgtaagaagccatgtccaaacttagtggcttaaattaatttacgatgatttctcacaggtctagggtttgaaggacttagctgggctcttcttccttggggtgcatcatagttgcagctcgataacggctgaggctgatgtcatcttactgcttaatcattcatgtatctgatgtctgagttgtgatgtcatatctggacatgacatgtatggatggctggaggctaactagatatgtctctttccatatagccattccatgtggctagcttaggcttcctgaaagcatggcagtcttaggtagtcagatcccttatactgtggtgccttcctctggggcaggcattccaagaggactgggcagaaacttcaaaacaacttaatgacgtagcttcagaagaccaagaatgtcacatttctactccattcttttggtttagcaagtcaccaaagcccagattcaaggggagaggacttagactccattctcaaagtgaggagcactaaagaatttgcagctacctgtaatctattaaaagtggccccatccaatttgaaagtataataatacactgttattttaatgttctgtaacaacagacatatctgtcatgttatatattcatttaaatactattactggaaaaatggcacttgtgtgtttttttaaataaaaatgctgtaatagtatttttgtattgtatttatcctacttgttacccttgaacacttcccagtgtctgtagttttcataatttttttaatttttaatttttgtggttacatagtaggtgtataatttatgggttacatgagattttttgattcaggcttgtaatgcataataatcacatcagggtaaatggggtatcatcacctcaagcatttatcctttgtcataaaatatttttaatgaggctgagcatgatggctcatgcctgtaatcccagcactttgggaggccaaggtgggtggatcacttgaggccaggagttcgagactagcctgagcaacgtggtgaaatcccgtccttactaaaaatacaaaaaattagtcaggcctggttacaagccatacttgtaatcccagctacttgggaggctgaggcatgagaactgcttgaacctgggaggcagaggttgcagtgagctgagatcacaccactgcactccagcctgggcaacacagcaagactctgtctcaaaaaaaatatatatatatattcatatttttctgatatatcacttctgaaattatgtaaatattatctactggttagataaaatagttactataataatgacaaaataattgttcactttaaattgtaggggggttaagcaaaccagtatacattataaacagctaaaataactagagatttgctaaaggaaaggcataattgctaatggctcaatgcttaactgaccactagggaattgtaaatgattgaaaaagtcaactaatccgggacacttaaagtgaattattgtgttagtagctaaaaatactttgaacctgaagtcccacttgttgaaacattcttttagtagctatggttttgttcatgtaaattgggtgaattaataagaattaataagaataacacaagttattgaatggttaacataacttaggcattgcgctaagtatattacatacattatttcagtgaatcctcacaactactctttgaggtgggtgatttaatttcacattttcagatgagaaaacaggtttagagacacaactgagatttagagatgctaagccacttgccaagctaactcagataataaggagtgattcaggatgtaacttaggtgatgtaaactcaaaacaaatgtttggactatggaaaacagtgtggagattccttaaaagtagatctgccatttgatccagcagtcccactcctgggtatcaacccagaggaaaagaagtcattatatgaaaaagatacttgcacatgcgtgtttatagcagcacaattcgcaattgcaaaaatatggaactagcccaaatgcccatcaatcaatgagtggataaagaaaatgtggtatatatgttccatggaggactcagccataaaaaggaatgaaataatggcatttgcagcaacctggatggaattggagaccattattctaagagaagtaactcaggaatggaaaaccaaacattgtatgttctcattcataagtgggagctaagctatgaggacgaaaaggcataagaatgatacaatggattttggaaagggtggtaggagggtgagggataaaagactacacgttgggtttaattagatcccatttgtctattttggcttttgttgccatttgttgcttttggtgttttagacatgaagtctttgcccatgcctgtgtcctgaatggtattgtctaggttttcttctaggaaggaacttctgcacagcaaaagaaactaccagagtgaacaggcaacctatggaatgggagaaaatttttgcaatctacccatctgacaaagggctaatatccagaatctacaaataacttaaacaaattcacaaggaaaaaacaaacaaccccatcaaaaagtgggcgaaggatatgaacaggcactcctcaaaagaagacatttatgcagccaacagacacatgaaaaaatgctcatcatcactggtcatcagagaaatgcaaatcaaaaccagaatgagataccatctcatgccagttagaatggcgatcattaaaaagtcaggaaacaacaggtactggagagggtgtggagaaataggaatggttttacaagtttgatgggagtgtaaattagctcaaccattgtggaacacagtgtggtgattcctcaaggacctagaactagaaataccatttgacccagcaatcctgttacttggtttatacccaaaggattataaaaaatcatgctactataaagacacatgcacatgtatgtttattgcggcactgttcacaatagcaaagacttggaaccaacccaaatgtccatcaatgatagactggattaagaaaatgtggcacatatacgccatggaatattatgcagccataaaaaaggatgagttcatgtgctttgcagggacatggatgaaactggaagccatcattctgaacaaactatcacaaggacggaaaaccaaacaccacatgttctcactcataggtgggaatcgaacaatgagaacacatggacacagggcggggaacatcacacatcagggcctgccgtggggtgggggctgggggagggatagcactgggagaaatacctaatataaacgacgagttgatgggtgcagcagaccaacatggcacatgtatacctatgtaacaaacctgcgcattgtgcacatgtaccctagaacttaaagtataataataattttttaaaaagagtacacattgggtacagtgtacgctgcttgggtgaggggtgtatcaaaatcttagaaatcccaccaaaagaacttactcatgtaaccaaataccacctgttctcccgaaacccattgaaataaaaaaaatatgtagtattcaaagaaaaaaaatcttttatcattaactatgatcttggtaggagtttttttttggtacaagctttttatcaaattagcaaattctcttgtattccaagcatgctaagaattttatgttttttacataactttcttgatatgtaattaaattaaaataaacttcttatgtttaaattgtacaatttgatccactaccacagatgtatacatctgcaaaaacattactacaataaaaatagtgaacatttttataatccacccctcaagcaaacacaagtgtttgtaagtctgtgtaatacgatttcttcttgaaataaaaaagtatagattggtaatttggaatatgattaggtttagggtagaagaggatgcaaaggtaaataaaatatgacacactttgttatggtgtggctgtgtccccatccaaatctcatcttgacctgtagatctcgtaatccccacatgtcatgggaggtaccaggtgagaggtaattgaatcatgggggcagttacctccatgctgttctcatgatagtgagtgagttcttgtgagttgtgatagttttataaggggttcttcccccttcgctcagcacttctctctcctgggacatgtttgctgcttcttctgccataattgtaagtttcctgaggcctccccagccattcagaaccatgtgtcaattaaacatctttcctttataaattactcagtctctggcagttctttttttttttttttttttttaatcattcttgggtgtttctcacagagggggatttggcagggtcataggacaatagtggagggaaggtcagcagataaacaagtgaacaaaggtctctggttttcctaggcagaggaccctgcggccttccacagcgtttgtgtccctgggtacttgagattagggagtggtgatgactcttaatgagcatgctgccttcaagcatcagtttaacaaagcacatcttgcactgcccttaatccatttaactctgagtggacacagcacatgtttcagagagcacagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcccagacggggcggctggccgggcggggggctgacccccccacctccctcccggacggggcggctggccgggtggggggctgacccccccacctccctcccggactgggcggctggccgggcggggggctgacccccccacctccttcccggacggggcggctggccgggcagaggggctcctcacttcccagtaggggcggccgggcagaggcgcccctcacctcctggacggggcggctggccgggcggggggctgaccccccaacctccctcccagatggggcggctggccgggcggggggctgacccccccacctccctcccggacggggcggctggccgggcggggaactgacccccccacctccctcccggacggggcggctggccaggcagaggggctcctcacttcccagtaggggcggccgggcagaggcgcccctcacctcccggacggggtggctggccgggcgggaggctgacccccccacctccctcccggacggggcagctggccgggtgggcggctgacgcccccacctccctcccggacggggcggctggcctggcggggggctgaccccccccacctccctcccggatggggtggctgccgggcggagacgctcctcacttcccagacggggtggctgccgggcggagaggctcctcacttttcagacggggcggctgccgggcggagaggctcctcacttctcatacggggtggctgccgggcggagggtctcctcacttctcagacggggcggccgggcagagacgctcctcaactcccagatggggtggcggccgggcagaggcgctcctcacatcccagacagggcggcggggcagaggcgctccccacatcccagacgatgggcggccgggcagagacgctcctcacttcctagatgtgatggcggccgggaagaggcgctcctcacttcccagataggatggccgccgggcagagacgctcctcactttccagactgggcaaccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatccccgcacctcgggaggcagaggctggcggatcactcgtggttaggagctggagaccagcccggccaacacagcgaaaccccgtctccaccaaaaaaatacgaaaaccagtcaggcgtggcggcgcgcgcctgcaattgcaggcactccgcaggctgaggcaggagaatcaggcagggcggttgcagtgagccgagatggcagcagtacagtccagcttccgctcggcatcagagggtgaccgtggaaagagagggagagggagaccatggggagagggcgagggcgagggagagggcgagggagagggagagcgagagggagagggagagtgagagctctggcagttctttatagcaatatgagaacagactaaacacacttcttaaaacaaaaacaaaaagagtggtgggtggtctttttagttataagacaaagaataatattacaggtgatttataagagagatatgatcaactcatcttcactatgtggacacaggacagaggcagagggtagttgggaggttacacttagttttggtttgatacatgtttgagggactggtaggacatttgtttggagatgtgtagaagtcagttgaaagtgtgagcaggattggggatttatttctttaacaagaattattgccactataatcaaaagtttgccagaaacttcgaggtagctcagtggaagtgttttgatagctgacaatatgagtgttgttctgcaggatgtaaatatcaatggggaaagttgttctgtggccattatagattttggaaatattgaataaaagttgtattcttttaggcctacttagggtttgttatagactttagtaagtattttgaatatttaagaaggttatttagtatctgcacaaatgtatttcctaaatgtatttctaacagaattctttcatctgatcaaaatgtgggcataacattgcatagaccacactggggaatattggttggaacttaaatgaaaggataagagttgcactgggagacttttacagggaccaggcaaagctgagattgctcagaggacagggttaaatctgatattgaagggaaggagggagttgaagtggaagcttgaagaggaaaccaggctgagaatgggaagttgtttgtaggtaagaagagtgcattcgtgggatgaggagcaaaggagagagagaaagagggagagagaagagaagagaggaagaagagaagaggaagataaattaagaggtaaaatcttaaacatgaaagaatgaggtcagaagcatagatggtgggttattcttagagaagagtatgcatgttccatttttggagacagtctatggagatagagatggataattttgagggaagggaaataaaatcttttaaatgtttgaactattacaaaagtttaagggtggacagttaatattgatggggaatctgatgcaataatgaaagcaaataagaataaacattcttattttaaatgtatgaagatatactattcattttcagtaactattcacgcggtagtgtggagggcgtagttgggaggcaagaatagatttaaaaaggatttactttttcttaggaaaaaactcactggagatggaatcctatttaaatgccttgattttcgtcatgtttactgcggtatacccacgccttcaattatgcctggcagatagtagagactcagtgagtactttttgaatgccattgaatgatgaatgaatgttagacacagccacagcacatcaatagtgcccacatgccacacatggctttcctttaagctctttcaaacttgtgtccatgaacgaaaagactaagctcttgaaaagacttggcgctaagccctgtagccagggagagctgcttagggaccctgtgggctaaagatagcactaaagaaatggcataggcagtggagcgtttctcctctgaagaaagcacatacagagtacgtgctgacccgtgccaggagttggggctagcgaggcacatgggacacagcctgaagtagcaggcctggacagatggaggaagactggcttaagacagggcatcaggtaccggagctcagtggcagctgaagtactgtagtctgggagacaccagacctcctttaggaatgcattagccactggaattcttagagcatacaagtaggggagctccaagaggtaaaaatggatttcctgccagtgtgatgcatggcgtcttgagtaggatttaatttaatttggaaaataacggagtgctgacacatttgcaccatgggtgttgtggactagttcatacttgttacatgctagggataccaaggaattaataatcttcgttacatcacagctataagacaattttaatcaaatctatcaatctaaccctattatccctccaatcccagcagagtactgaaacacagtttgggctgcatttaaaacaaaaaaacccaccaaatcctttaagaatgagaaaagaagagaaacatttaattttggaatatgtgtaggtagtagctcatggccataaaaaacccccaaagagtagaggcttaaggtaagaaaagaaattagatggttagagtaaatgcattgagaaaaacacaggtgtacttacaaagtatgttcgtgaaagccaaaaaagtaaagccaatatagtattaggcattcacttctctgcaaagatgaatttaaatcaaacctaatgaataccttatttaaaattttaaataaaaaattttacaaaatgttttatacagctctcacccatctaaatgatcagttattgataaactcttaggcattccctaaactagaaaattttcatcccttgacatggaatttttaaatgttctgatagctgttattaacatttttatcactaaatacatcagtctgaaatgagtttaccctggagttagtgttacttctagagggtacttaacaatcttcaatggatttagcaaagagtattttcacatttggtttttacctgattgataaatgcttttgtaatcttatcaagcattatagaaagtcattaaaaattgatcttaggctttatcatctttttttttatttataaacttctgtgtaactaagaagccagagaagcccaatctcagagatttttccttagagatataagcatatcgacaaaacatcgtagcataccgagatgacatgaaatctcacaagttcaatgtgtatgaggcggatggagaaataatactgtaaagtcattggcttcaaacttcctgggatggaaatgtttgtaatccaggcttaggttttacaagtttcaaattgatggaggattgtagaagttgggggaataatagagcatgttcaggtattttggttgcaaattaaggctcttattttaatataattttgtacagtccttgaggccctgtggaaaattgttaattgaagggattgaatgtctaaaaaatattaaatatcttgttttagtttggtaaatggctcctggtagtgacaatagataatatgacacgcaaataccttgcaaatgggaaagaggtagtacttagttggaccataagtgatcttccggagctctgcctaattcatttgagcatcacatatatattttttattattatactttaagttctagggtacatgtgcacaacgtgtaggtttgttacctaggtatacatatgccatgttggtttgctgcacccattaactcgtcatttacattaggtatttctcctaatgctatccctcccccttccccccacctcacaacaggccttggggtgtgatattccccaccctgtgtccagttgttctcattgttcagttcctacctatgagtgagaacatgcagtgtttggttttctgtccttgtgatagtttgctgggaatgatggtttccagcttcatccgtgtccctgcaaaggacatgaactcatcattttttatggctgcatactattccatggtgtatatgtgccacattgtcttaatccagtctatcattgatggacatttgggttggttccaagtttttgctattgtgaatagtgcagcaataaacgtacatgtgcatgtgtctttatagtggcacgatttataatcctttgggtatatacccagtaatgggatggctgggtcaaatggtagttctagttctagatccttgaggaattgccacatatttagccagaataataaaatgtttatttttcttcatatcattggtaaattcacacaattccattttgtgtcaaaagtaataaatgaaagtgagaaccagaaaacagcacattgtgaacaaaattaaataaagacctacttctttttaaaaacaaaaattaaaaaaaagatgcattaaaaaaacattcaaaatatcctttcacttagaagcaagggaaaacccggccgagcgcagtggctcacgcctgtaattccagcactttgggaggccgaggcgggtggatcacccgaggtcgggagttcaagaccagcctgaccaacatggagtaatttcgtctctactaaaaaatacaataattagccgggcgtggtggtgcatgcctgtaatcccagctactcaggaatctgaggcaggagaatcacttgaacctggcggtggaggttgcagtgagccaagatcacgccgttgcactccagcctgggcaacaagagtgaaactccatctcaaaaaaaaaaaagcagcaagggaaaacgaattcttgtaaataagccttgtgttaaataggaactcatatctgtggcaataggctttttagaatttcataatataacagactttttagaatatcataccactaggaactccacttaccaaacctgagatgcagccaaaactatacatgaagcaaaaccgtatcttttaaataataaaaagtaacttggttttcaatttatgaatcttaaaagaataccgtactaaaccaatcaggatagagaattgataaagattaaaaatgaaattgatgaattagaaaacagaaaaacattggacttaatcccagatcaaaataaccaaataaagtcagtagtcttataacttcattttacagaagaggaagtagactcagacgttaacaatagactcaaacattaacagcctgctcatagttgccctgctggtaagtatcagagtactctaagggcatagatgctaggctctgctgcatttttttcagtgtgaagattggaattatccaactggccaattagtctaaattctgggtaacagtttatagctttaatggctagaaagtggtttgcaagtgatactgctggaggctataattgcttgaggaagccaaggaaatatagtaaaaaccagcagtcatttggggattgctggaggcttggacaataagggtatacaggcatcactacagcctggaacattatgatcaagagccttattaacagaagaaataatgaacgtagacacatgatttcagagaatatttgaagaggaaaatctgaaattgttaattagccttttggcaacacatctccataaatgtatgctgtaatgatcctgtattccattaattcttttagactcccgtatgtgtatcctattcatcatccaattagattccattcccaaattctgcagatttacaatacaacatcctgacaatgtttcgatgcctggtacagtttttaatatgtcggtagatagatggaaggaagtaagtttgtttgatttaacggaaaacagtaagaaattttcgaaaggggagaggggtgctatacataatgacttccttccaaagtagttggtatggaaaagagggcaagagtaactttgcagtggagcaccctgacaaataccacctcggccaggtaaccaagctcgacaccaatagtgataagtcatgttgatagtatgtaccttttgtataagtgatgagaaagtctttttgcctttttggtcttccccaaaacccataaccccagtctaatcatgagaaagttatcagacaaatcccagctgagggacatgctacagaatacctgaccacattcctcaaaagcgccaaagtcatcaaaaataagaaaactctgaggaaatgtcacagccaaaaggagcccaaggaaacatgacaacccaatgtaatgtggtgtcctggatgtgatcctggaacagaaaaagaaaattagctaaaaacgaagaaaactggaataaagtgttgactttaattagtcaaattgtattatgctttgtatttctgttgtgttttagaaatgattaatagacatggtggtggctcagcagaagctgggtggttaaaagatttgtggtgtttaagcctgaagaaagactgggcacatgcaaagtggtgtggcagtggtttccatttcaaaacactttcagggcctcttgatctaacttttggtttctatcatttctttttcctttttattttctaaacctggaggaaccacaaattattacagatgaaatacaaacttttttttctaaccatgaaaagtactgttctccttctctgagatcatacatgtagctgggagggtaggcatctgccaagttcccagacctctacctgtgcttcccatgccagttgcagtgtgtagaggtggcggatactgtggttcaaattttgggggtcatccagaacatcagaagccccaacattttgttctttcacatacagtgttgtaattcatttctcttctgaccttgaagtccatgatgagttttcattgttcttttaaactttcctaagttctcaatgtttccatctacttcaaacattccttcactctaatgttgctactgtggagggtaggcaggagcttgtggatgtatgggtggtgctcatataagacagtccaggatgcccaatgctgtttcctttggtctcttgaccatgtggagattgaaggtctacagcctagaaactggcacttcatggtgcacagagatggattccctcccctgggcctcatgactacctcagtgctgtagcttttcattttgcttccctttagcaattgaggaaactcaaggccatgtgaagggaagtgacttgtctaaacttctacagctgggaagatggcagagactagattggagcccaaagctgagtggaatcaatgcttgcctcctgctttggaggtgacttggggcccaacaccccaggaggcacttgcagtgtccagctaaaggtttcatggcatctgtgttaggatgcccatggaggtactgccaggaattcttcccattgtcctatgaaatcaaagtcctgggacactgcatggaggcattccacaaggtggtgagcgtgcatgtgtgtgtacgtgcctgcacacacgtgtgtgcaggcacgtacacacacatgcacgctcaccaccttgtgaactggttttccgcctctgaatgacatggagataagaaatttcttactttcctctttgaccctagtctgaggagacattaggagggtataggagagcaaattctctgtctaactggcagctactgcttagctccaggcaagggatgccatggagaaatgtggacccagatttgccaattctggtaatttttcaaaataatctagacatccatttttttaaaatgtgaaatctacaaattttaaatcttggcaaaaatgatcttttagtattgttttgtaatcacagtttggactaaaaaacacatatctctaggcatctgggtttgtaacattaaattccctcttttgctttctttcttactggcagtgagtgcaaataattcatttagaaagcataagcacctagattcttcaataaaaacagactgtcttcaatgaagagaaagaaactcacagaaagtatccaaagaaacaatttttaaaaattagataatactactgaatttcaggagaaaaaaaaaattttgtttgactagagctaattaaagttgttttcagtgagatcttaatttcaagaaaactgcttttcatgactttttaagatctatgtaggattacaaaattacgtttgtttgagaagagttacaggggtcaaaaatctatccttagatccttaagaccgcttcataatatgtgaaattgttgctgttgattttttttttagacagacgggtgccatctaatggtggtttaagaaatcttagttaaacatgtgatccttattttttaaaggacctaaaagacaagagttatcttactacttgacagagacactgtcacatactcagatttataacctatatgagcaaactttgacttattttattgcttctaaattggcctcaaaggatttagattagtgagattttcattttgtgctttgcaaatgtgggagagagaaagcacaattgaaacccataatcttctagagctccacagagctctggaattaaagcttctctacactgttcttcctgtttccatggtgggcatatgtagtccaaatataaacagctcgaatggcttttgtgatctgttttttgatgactcatgcaaacgggagtacatgagctcatggaaaatgtcaagcttaaatattctagaaagaagatagaaatcagaagttcagttacatgagttaaaagactttatgtaaccccaacactctgggaggccgaggcaggcggatcatgaggtcaagagattgagaccatcctggccaacatggtgaaacctcgtctctaataaaaatagaaaaattagctgggcgtggtggcacgtgcctgtagtcccagctactcaggaggctgaggcaggagaatcgcttgaacccgggaggtggaggttgcagtgagccaagatcgcgccactgcactccagcctggtgatagagcgagactacgtcttaaaaaaaaaaaaaaaagataaaaaaatagaaaaaactttgtgtattagatcagatatttacttgccctgtttctgttatgtaaaatgttacttttcctggaagtatttgtctgtactgcattattgttcatggaaatggccattgtagaatcagtcttagtatgtaccatggcaatttgtgatatcatggttacttttctggaaaaaattattgtgtgtaggtacattttttgaaagtttacaagcgtaactctcacacaaatataaaatgaacatgtcaagattttattcaacccattagttagtgaggaaactaatagagtgttaatactggtgcaaaaagcatttttggaacaaaatatttacaagaaaattaataaagaaatgataaggtaaggtttctgggtgagatgtaaaactggttaacatcctaccgggaaataaagctgtaacttatggattatatgtttcactgtacaaaaattacttgcacttttcagccaagtaaaaggatgatgaaaaaaaaagaaaaagaaagtacttgcacttttataggacaaatttttcccaatttacatgtgacttcactaagtctgagatcttttatcaatggtaaacaattgttgatttaactaagtgtgttttattgagtggtctgtgccttgtatgatcattaaaagcatagtccacacactactttttggcttgtattcaagcttgggatacctttttcttaaaaaataatcagacgttagcctcatgtctgtgcctatgccattgtcagagtaaaataactgtgtttgtctgaatctgacaaaactaaataaggcaagggaggatgaagagagtctcttgctttctttttctataccatgcttttcctaccttctcattactctaagatggtgggttaatctatttctttacttgttttttcattaaataagcatgtcttgagggtcattgtataccagggactgtactaggtggtggacaggtaaagctattcaagatgggcaagctcaatgtcctgcaggtgtttttgttctaaggagagaaacacaataaatgcaaatagcgacaactacaaagaaggaaacaaaagggcattgtttaaaagaggaatattaggcttccaggtagacattcgtgttgggaatttatttattgtctcagctacacaccataattattgtagaactcatcaataaaatggcagtttccattgactttcactacacctatccattcattctccagggaagggtagacacaattatggtaacttgcactttcctagaccacatgttgtgaaacgtacatcaatcaaaagtggttgccctctacacctagggggcagtagatatcctggtattcccctttatatcatcctgggatttcctttgatgctttgctgtgtttgactcttgattgctgatcctatattttcttctttcttagtttacttggtttattcccttgtttagatggagaactccctccagtaacatcttgagaaagggtatgtagagacaaaagttttaggtcttttatattaggaattatcatgatattatccttccacttaactaatagtttcattgggtatagaattttaactattaccttcagatagttacctttaatatagcactttacagaaaagggttttcaaacaattagagaaacctgcaaggacaaaaggaaggcgagaggaaacagttgcaactcagttttggagccagaaggcaaatggatgagtagtgattctcttagcagatccaagaaagcttagcagtaagctaggaggctgagaaatagccaaatttatacagaatagccactaaaggcacaggaaataatagtatcaggtacctttaaaactttggtggtgagtgagcaactaggtggggagaaaactgctgcaggagatccttaaaatcatcatcccttccatcctgtgctgctgctgaccccctgcttacccctccaaatctggtgttcattctccaggaaaggtaaaacaggatctcttgaatgatgatgtgagccgtgtttgtgggttaggatccctaaataaaacaggggattaagtgaccatatgatgatcgaattcagagactccagttttttacccccttctactaggtcccagatgtcctggtaattatatctgtaccctttaggtgggagaatggaagattcttctttggggaaactgatcaatgtaagagtaaagttttttctgtagatactaaaattgggactttctaataagtggttcactcgttcactgaaagttgacaagccacatccttctgcacatgctcagaactttcaagtattattttggtcacttatccttgatcatatgaagatatgaagatccatatattcagagcatcccagtcatcagtttagtctcataattttaagtatatatagatgatgaagaattaccagatatagaagacagattccagaataaataacaaattatttttgttaatttagaggtaacaaagaatacaaagagggaagattttttttaaaatcagtattttctaagatactttacaaaatcattggattaatggaaaaataacaggatactgttaaattcttagaaattgaaaacgatagcataaatttaaaaatagtaggataattgaaatttgatgatgaattaaattcttgggaagcagagcaaaaatcaaagaatcggtaattaagatataaggaataagatataaggaaatgagaaaactatcctcagaatatcagtgtgaaataataggagttctaggagagagatcagtgaaaatggagtgggggcagaaatcactgtgaaataataaaggaaactttgtccgtttgaaggttatgagtggcacattgaagggaatttacagagtgttcatccaaatggacaagaataaactaattccaagatgcatcattctgaagtttcagaacactttacaatgagaagaaccttccaaagggaggacaacacaaacaatcagaacgggtcacaaacactttagaatcaaaacaattttagattttttagtagcaacactaggagtttgaaaacaatggactgaggctctcaaaattctgaaagaaaattatttttacctacaattctatactcaattaaacctttagttaagtggaaggataatattgtgataatgcctaacatacaagacctaaaacatttatctttacataagctttctcaggctgtgactggagggtgttctccatcaaaacaagggaataaaccaaataaactactaaggaagaagaaaacatgggattaacaaacagaggatgaaacacaggaaaggattcaaagagattccaggatgatagaaacaaggatcccaggatgactgttgcccatcatgtgtagagggcaaccacttttgattgatgtaggtttgataatatgtggtctaggaaagtgcaagttaccataattgtgtcaactattccccaagagtgaattgatgggtgtagtgaaagtcaatggaaactggcattttattgatgagagatacaatgttgatggtatgtatctgagacaataaacatattcccaacaggaaagtctacatggaagtctggtattcctttgttaactaacatcttggaaaggtgtgctgatttctatagtctgtcttctgtaggaatacatatatttctgtatatatgtacacacataaacaatctcttgagagatataaatgaagttgataactgggattgactgtgggtaggagcagcatatggctggtggagggtactgtgagggaggcttattttttactgtttatctttttattccttttaaatattatgccacatgcatatataagttatttaaagatgaataaaataaaatgtatttcttataaattaaaaataaataaaaataaagacaaataacattaactacagtctgagtaagagactattcgttttatttattactttaaaaatgtttagcacttactctatttgtaacattagagtactttgcttttgaaagttgtaaatttaaattctgttttggtttgggagagggcaaagatcattttttttttggtggtgcttgccaaatacaaataagacagattaagaatgcttagaagctgaataattgatgataggaatgatgaagcttctcttgttccacaggagtaattctatagttttagaatgccccttagtagatgtaatagaattcaagtaattctaaacttgaaaaccttgttcctttaggatcatattttcagtattaattacctggtggtcacaccatgggaagatgcttgctatggcattgacaaggtaaaagatgaagctaataaggtcaatgcgttcattcaattctgcactagtaatgtttgtcttttcaggcccttgtcccatcactcatagatactgtacagttgtttattctgaaatgtaaagagatagagtcaactttcaaattgagggaaggttttatttttaatcgaagtcgattaatgcaaaattaattgaattatgactttctttcattgtcttctattgggtcctaattctcatttattttactctcttccttattctactccgtttctatatagttattgagacatagaaaaaaagactctttgactctttccttttaatcagaatatgctatacctattacatttcctaaggtgcccatcatttatttgagtcaagatgggaggaaggtactgtcctagataaacaggatttagaatttattgcttataatgacacgttgttgatgaattttataatatttgatgctcttatgggctacgtaatccaggtaaaaaataaagtagggaaaataggagtaggtttttaaacaggaacaataaagcatcgtgggaaacagcaataggaataaattaatgtcagactaatgtaaagaagcaagatattggggttccttggtgacaatcagaaggggcttagctttttcaggacactgagtcaatatggtacactcttgtcctgctgtgttctattctgaagacatccttagtttgtctaagtgtcttattagtcattaccagttttgaggtggaggggaaaatattagactgtgagtacagatggtggtaataattgcatgggaacagaagatagctagcgtggtgtcctttcatgaatccttagagaagaataatactgttgaatgttagagtgggacagaggggactttccactttgtttatcctaatatgagtttgcagtatcacaaactggagattggcggataaatattgatgttgaaagtgacggaaaacccaacccaagccagctagagcacaaaacgtaatttattgtctcagaaactgaaaactctaggataaagctggattcaagagcttaagcttgattatcaaaatgtggctcctttcatccccttggctctgtggctgtgtttgtttcatttccagactgtgggagaacttgccccaattatcacaatcccaaatacagtggtagagggaatttccattcttatgcttaaaggaaagtctcctaattgtgtcttctgtcttcttggctttgattgacctgatctgaatggccaaccctatgactctgtttaagccaaggaacatattttaagtatctttgtgttctcggtgattgatgagcacagggcgttgcatgatgtacaggtacacaatatacaaatgttatgttaaactgtaagctgcttttctgaaaacaaccattttacattgtaagagctggtctaatatagtccagattttaattctgaaatttttttggagcaaaattaggtgacttgttggagagactgaatatgattactagaattcaagaatttgagactttctgcctgtgtgctatcaggactctgtcagaacctcacagtagaattcaggaaataagcaagaaattaaattacatatcatcttagcatgctaagagatctattaagagataagggatatagtggaagaaagagttttaatttcttttgaatcatacaaaacaaaagtgagaggtgggagaagaacatggatgatagctggaaatgagaggatttgaatattggaatatcatcccattagagaagaggaatgatgtcagtgatgctaaaattattctttcacagttgcaacagaatacaaattacgcacatcatgatcttaaaacatatgtttgaaattcattttatagagaagtttaaaaataagtggtctgatggggcatgaaaaaattttgttaaatctagtaagagaaaaaaatgacctaaaatagatttaagacttatgtgctgtgtcaattactaatgccttgtcttctgagtttaatttaaaaaaagggaattccaaagactagatttttagtgtgatagaggaaagtgtacctagctactctaaaaaataaactattcagcatttgtgtaattatgcctgtcttctaatgggaacttcattttcaaagctttttttaatctttaaattctattgaatgccaactttgcccgaacaacttttcatacagtgtgaaaagatgaaagcaaaggagatgcaattatcaatgatgtcacagaatttgaggcatttccaatcatgcctgtgtgctcattttgcataatcaaaactcactgatggggaccaatttaaaatgaatttactgacttaaacacaggatcttggagctctaattgcctgggaaactgtaagaatgcagcatttgagctcattggtcctgacataaaaagatgctgttaaatatttaaagtagtcaagagagctgtagtgtcatttaaataaatgtaatgtttattagagtaataaagtgaaacttttaggagattcataattatgcaatcttatgagagttttggttattgtgcatgagcttgaaatatctgaatgcttggaaacgtagcataaatgatctatcatattattcaaggtggtgatgtgtgatttgttgaaataaaatgtaaatggcagtacagtgtggttattgggtagagagtttggagttagcctccaaagcctacatagccacttaactgaataatattgcatatgttgactaacccatctctgctttagttttctcagctataaaatggtactaatgctatgctcgccttcttcatagagatattgtaaggattaaatgtgttaatgtatataaagtaccttaaaacagtgcttatataagcatttgctgttatgatcactctgtaaaagtcattacggtttttcttccgaatgcacaaaatcttaaaatgcaatatcagaatatgaaaaaacatatgaggaagttcgcacatatagcattgaaaagttcagtagttaactcataactacaaatttggccttttgtatgttcactccaagacacacttctaacacgattcctcacactctaggacagtaattctcaaagtgaattataccaaggatgagttggatcagaattaatagggctacttgttaaatgcatattcctggtcctcactttagactcactgaatcagaatttttgagagtgagaattagcattttaacaaatgcctgaggtgatcctaatgcaggacagattttgagaactgttcttacttgttcatgattccctctactcatgctgtaatttcactttcactctgtctcacattgcacttcagatgtcttatttctctcagttcatggttctgtcacgtctcctgttcaaggactatagatttttctttcaaaatcacagtagattgtagttgatctttttctttcacattcaaagcctagtttactaccttctccctcttccattttgtgctctcttcattgtaccttgttcatttccttgccactatttgtcctaagtgggatgtgaaatcattctggctttagaattccataaaagaccttcacctggctttggtttagctcagaactgctccccctttcctgtctcacacatgctttgctttttcccttccatttctctcatctttttcatttcctttctttccatgaacattcctgggttggaagacagggaagagtttgcagctggtcaaggaaaactcttcttcagatttcattggtcttctggcaggtttgcctggagagaagggacaggtacaaaggaagtcccaatccttcagcatctctgtccctgttagcttatatccctttcctggactccatttgaactcggcatccctgtctggattttagagtcagaagtgtgtgagacatcattgagcagtctcagactgcattgtctgtatatacttaacggagaacattgcacttaaatcctaaaatatatcaggaactcatatatttggcgtgtctaagtataaagccatgtgtagccaagtggaaacaccacatacaagaaaattgtattacttcttggccaaggtaaagattaataggaagcattttggctcatagagtatgtaatgcagctctcctttaaaacacgtgaactttttatgttcgtgtgaatgatcacatagatccacgggaatcttaatgatccgtgagggaaattgttcacatttttagaggtatatctacattacaaaacagcagcactttcaggagaccactgcactgttgtgctttggaaagcacttgaatcccagagtgctgaaagtaggaacagtattgatgactcataaacacacatatcatagtgaaaaaaaaaaaaaaaaagaaagttgtcatggaaaaaaaggaaatatatactttggcaaatttaaagcaacatggacattttcttagacgtggtcttagtattttagctagtaaaatgaaagaaatttaagtcctggaaatttatcccttctttgaaaggattagaatttctttgcaataactaagaatttaaaaaattctcaaagaagacaagtttaaggaaaaagtagacaccaaccaagaaatcaatttattgctaaaaatttggcttcaactgtttcagttttggctggtatttcgtagttttatttgtgtaaatatgggctttaattaaatttccatgttgctgcttaggtttttcttaaaatgtggatgtcaataaattttttacatgaactaaatttaataagtaagtttaacttacagctattatcttggtatagaagctaaaaagcaaaaagtacttctgaatagtagaaagagaaccgtaagaatagaatcgtgtttttttaacttctgtcgtcacatatttgagtttgatggcttaatagtagatgtatttatgtcttagttgtttgctgtctaactcttcatactatgtttatatctatagacaatacaatctaatgagaatagattagatatattttgtgaataatatttttttctttttgttttagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcggtaagaaattattatagctctatttttactgaaatagatatgacgtttcttagttttaatggcaaggattttttttttctgtttgagattttgagcagtttcattatgataaatgatggataatttgcagataatgctattccatttttatctcttacaggtttatagagtgctccaacataatcatgtatatttaacagtactatttttaaagatatagactgatcattttgtagtgttcatatatttattttagaacaagaacttttcattttgggtaatttggattgtagctatctctgctcagatatactatctattgtaaggtggtgtagagaaaacgtatggaatatttaaaagtagagaaacgacaatagtaaaaaaaaactttagttatgtccaagagctcttttagtgggaaaaattaagtatattaacttaagtaaatgttgggtagaatttgttaaactattgatctatctagcacacaatttagttactgggtggattgtgtgtgcataagtatgtgtctatttttaaccagaaagttatgtcatgtgaccactaagagtattgctatatttgagtctcaaagtacttatactttttgtttgcaaaaataaaatcttaagaaataggcttaattatcacattgtgaaatattataaaaagagaagatgaagaaaaatgacctatgaacgaatccagtgctataattttagttatttgtgacatatatctatatatagaaattatttttagagtacacattatatgagataatctttttcataaaattttgattgaatcctaacaattttttcaggttcctttatcattttcacaacttttcttaatggtgttgtaattacttcctgatcattcttccttttcattgtggttgcttctaatttttacagttacgaatgttattctggtgaaactgtttacatatattttgatttttacctatttcgaattgttaaacgattttcataggctgaattactgtgcttttctgtttgtttcagtggctcttgataactctttcttaaagcttgtgtcattttctatagtaaggtatattttccaacacccttcacaacttacttggatttctcaagtatttaaaacttaatttattgttatgtatgagaactagaaattgactaaaatttccctatacatgatttttattggtactaaatcaaatattttttctagtagcttaattactcattttgagctctttcgtgaaagagatctcattttgatcgcacaagctcatgcagaatcttactaataatactgagaatcttaccagtaatgctgatttcacagaataagatcctaaaaagttaaggaaaagtttatgatgactaaaacatttgaaatgctaaaataattagatctttattggagatgtgggagaatataagtacaactttaggttgagtttgggaaagagcagtttctttgaaactgatagggaaataattgattttcctgacacagtttttggcaggccacatacatctctttcttttccttttctcttttttgttgatatataatagttgtacgtattttgggggtatatgtgatattttaatatttgtatacaatgtgtaatgatcaaattaggggaattggggaatatccccaatgatccccaatgatcaaattaggggaatatccctcacttcaaacattaatcttttctttgtgttggaagcattataattcctctcttctagctattttgatatatacaataaattaatgttaactataatttccctactgtactatcgaatactggaacccattccttctgtttttgtactccttaaccaacttatcttcattaacctcttcccttctcagcctctggtaaccaccattctactctctacctccatcaggtccacattctttagctggatgagaacatgtggatgagaacatgagatatctatctttcagcacctggcttatttcacttaacataatgacttcctgttacatccatgtttctacaaataaaaggatttcattctttttgatggctgaataatattctgttgtgtagctgtgcatatatacaacatttttttgagaattttagctataatttgtcttattgttaggtttgctgttgtctactccagatcaatcaagagcagagaaaaaaattcacataattgctttcctatataattctttttctatgtaatatttgttttcgtttcacagcatgaacaaatgattttgtttagaatcatttcttttttccttttttttttttgaggcagagtcttgcactgtcattcaggctggagtgtagtggtgcgatcttggctcactgcaacctccgcctcccgggttcaagcaattctcctgcctcagcctcccaagtagctgggactacagacacacaccaccacgcccagctaatttttgtatttttattagagatgaggtttcaccatattggccaggctggtcttgaactcctgacctcgtgatccgcccgtgtcggcctcccaaagtgctgggattacagtagtgagccactgcgcctggcctggaatcatttgtttatttctgaagataagttttttcagttgttaaatatttatgatttttgtttttgtacaccctatctataaacataaatgtcacttgatttatgctttttctcttgattgctgtaattaacatcagttttacttgtcctaatactgtgttaaataagaatgatctatattttgcatttgatagctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacaggtaagtccgtgtttcctccttataaaaattataaggaggacttataaaacttataaaaatcttttagtgcttaacaatctatctatctagagatgagccaattcagataactggtggtggtattcatagaatccagaactgacaacctcttcagcgcttccacaatctggttattccttgatcttgttcagaaactctgcaggtagtttttggatccattcagcttactcgggaattgccatgacagttgctccagaaaactttgccttccctttggcctttttttcttttattcctcccctgctaccaaatgtacaaagaatgactgtgacttctgagatcaaaggacaagaatacaaaaagcgggcatggaagtgggaggtccctgtgacttaaattcagagtaccgctgggagaaaaacctgaatagccttaggtttaattgaactttatggcttggtttattaggttgaggcaatgactcgctaacaccattctggttgttttttctaaagaacattaagaatttttttttgaataattgtgtcactaccattaaaatgtttgtgaaaattacacttgaaacagttatgttttgctcttttaaatcattctttaaaaaatatacttttgtgctgctgttgaatatcagtacaaatgttacagaaaactctccattttataaacagttttaatgttttatcttcagtttggttctgtgattcatagaataactaattctaaagttccagtaccttcaatagcataggaaaaattacattgaatagaattttgtactgtgtacttaattctgttatattagtgataacatagtaattataactaatttataatatagtattattagccagtgattatttataattatactatcatatattattaagagtcagtgactaatggttttcaaaacttttttgaaaatttttcatttggaacttcttaaccatattgatgtaattagaatgtttacttaatctgtgcattaagattacatatgtatttttattatattctgaataactacttgaagacaaattctacaaaaataaatttttaacttattattttatttttaattcattattttatttttgggattttattttagaaaccttcagcaaatgtgaagcttggatggccaaggactgttactgtgacaatattatcaaatgacaatgcatttggaattatttcatttaatatggtatggacacaatttgatgataattgtggttgctagataatagtttattaaattttaaaaattagttttcatgatgttagctagtatcatgctgtgttttgatatttaaataaaatttgctttaactttgtccctgtttcacattctgtagaccattcatttgttctacctaagatgtttgtgaattgaggacgcttgtatgatcgtggtcatcttttgtcctaatctctttctgctgattgttccacctgactcctttgttaactcttctgtctttaactcagatataccacccattgccttttcctgatttccccaaatgtcacctaaagaaagtgttgtttgtttgtcagactcttctgaaagtttggagttaatgggagatgagaaagcatattgaaagaatacttttctttttttttaattattattattatactttaagttttagggtacatgtgcacaacgtgcaggtttgttacatatgtatacatatgccatgctggtgtgctgcacccattaactcgtcatttagcattaggtatatctcctaatgctatccctcccccctccccctaccccacaacagacgccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtattgtgccacattttcttaatccagtctatcattgttggacatttgggttggttccaagtctttgctattgtgaatagtgccgcaataaaaatacgtgtgcatgtgtctttatagcagcatgatttataatcctttgggtatatacccagtaatgggatggctgggtcaaatgatatttctagttctagatctctgaggaatcgccacactgacttccacaatggttgaactagtttacagtcccaccaacagtgtaaaagtgttcctatttctccacatcctctccagcacctgttgtttcttgactttttaatgattgccattctaactggtgtgagatggtgtctcattgtggttttgatttgcatttctctgatggccagtgatgatgagcatttcttcatgtgttttttggctgcataaatgtctccttttgagaagtgtctgttcatatcctttgcccactttttgatggagtattttttttcttgtaaatttgtttgagttcattgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacaggtaagtctttaatctatcttgaattaatttttgtataaggtgtaaggaagggatccagtttcagctttccatatatggctagccagttactttcaaaaaacttactatgaacttaaattgaatagcaggtattacatctcttcaaaattctgtagtcatcccaactcttaggttttcccattaattaatattttctgaagattgaaacttcctttcatttcactcacctttgctcaatagtgtattttctgttccttaactgaattcctgtggctctggccaatcctgtgatcagagagttttatctttagaaacaaatacacaaaatagggcccttcttgagataaattgtttccagctcctaaaaccaagtttatctccaatacaactgaatctggtcgctaaattttagactccagtaacattcctgactcggagtctccttgaatcacattactaattataattaataaaacacgttgcaatacttcccagcttttcatttatttttagattgctactacaattggttgtattgtatgtcattttcttggtaccttaacttatctttgaaagaagtgggctataagtaaatatgatctttatagtgcagtatctttgttaaaaagggtatttggccaacctcagtttagtagaaattcggtaacctccattatactgtcatttacagacattaagttaattaatcaaccatctcttttatttgaatgataaggaattgaatgataaagaattgttaatgatgaagcaggctcccttaattgctaaatttctctccatgtggctttcctgctacacttactctctgtgtatcacctccgacctcatactgatttgtttaaaggtttcttttgttgttgttgacattatatatcttagcctatgggaatgaatcctagtttctgtcatgggtcctaggtccctgactggtgggggtctcagtgctgccaggcagcctctgacatccttaaaattaaactaaataaccattgagctcacggtggtgctcaataggctggctttgcttttcagccctgaggatgattatgttggtagtgaagatgacattgatgatgatgataataatagcaacatttactgtgccctcagtatatgtcaggtactaggataagcacttgatgtgaactatcgcattgaaacctcatcacaacccttcaagacggacattgctaaccccagttatgtatggggctactgagttttgctgtcaccctgagagctggcagctgcttctgtagcctgtatgtacttggctgtgtccgtgttcctcctcttctaccctgagtttccaccagctgaaccagcatatttcttttgaagtctttgctttcacctcctgcagagatcctgtcctgaaagttattagcagtgtctgcttttcactgacaagctggctgatgtggagaaagagtggttgtggacaaggccaagtggtggtcccagtgacctgctgccttggtctggaggcttaattcatgtttgtgacctcctgggcccctgtgagcatttgagtttgtcacctttcaactaaaaaacctttaaattcctcagcagaacagctagttgatggtagaaccaggacaagaaaccacatcttttgcctgactagtttttatgttccctttacactattctttttaactttttcagcattttaaagctatagttcattgatgctaggaaatatcacattcttatcgtacagtgtggattgatgtgtctgtggaaattgagcgtttctgaggtaatagtttttaccgcctcatacctctgattgctcagctcctgatcatctgtgcttgctttcctcaatagcttccctcaatcgcagtgagtgagcccaagggcagaaatgagtctatgcctcttactctcatcagggaaaagggaacctatggaatggtcatggtgacttttgaggtaagtttactctgaagtcattttattttatttatttttatttttatttatttatttttgagacagtcttgctctgttgcccaagctggagtgcagtggtgcgatctcagctcaatgcaacctctgcctcccaggttcaagtgattctcctgcctcagagtcccgagtagctaggattgcaggcatgtgccaccatgcctggctaatttttgtatttttagtagagacagggtgtcaccatgttggccaggctggtcttgaactcctggcctcaggtgatccgcccgccttggcgtcccaaagtgctggggttacaggcgtgagccactgcacccggccctgaaatcactttaaatgcgaacactggggttcataccagatggctgcaattttgaaaatcaaagttccttgtataataaacatgacacaatacaattaaaataaagatgaatacttttctgatctgatacatttcatgattaatataaaaatgttttccttgctgcttgtgtatacaatgcttacatgaaatacaagtaacattttagatatgtgggaaaaataaatcataggatagaataataatgttaattctataaaattcatggaacttttatgataaatgttttcaaagacaggaaattttaaaatacccatggattacttaggtttacataaaattatttaatatgttgtctttctctattttattttattttattttttttgagacaggatcttactctgatgcccaggctggagtacagtggcactatcatggctcactgcagcctcaacctcctgggctcatgcagtcctcctgtatcagcattctgaatagctgggagtacaggtgtgcatcaccatgcccagctaagttttaatgttttttgtagagatgaagtcgcattatgttgcccaggctggttttgaactcctgagcacaaatgatcctccctcttcagcctcccaaagagctgggattacagtcatgacccaccatgccttccccctgccccccatttttttcagtacaccaaatggatggtgtttgtagccattgcactccaccatgggaatccataaatgttacaggatgtggcatgaatatgataagctgtaggtgaggtgtatttttcaggggctagctctaatcattttatttgattgcttactgaccatgtgccaatcattgtgtcaccacattgctgttctatgagatacacatttaaatcttcaactaatttttgtgttttttaggatccacaacatgattatatactattttcaaacattagagtattagcaatttcagataccagtttctttcctaattattaattgtaatatcaataaaatggaagcatatttatttaacacaattctatggtagcatagaagagttctgttcatgcttgtgggtgtccacatcatatggtagttatgttaactacacagaacatagaatagcagaagacaataatgcatgaaaaacacagtaaacactaactaaatatgcagtagtcttgcaagttttacactggaagcattacacagtttttcaggtacttaggaatatgcatttagacaataaatttttgaaaatttttctgataaatattggaaaaattagaaaataattggctgtagaaaggataaatcatccagagtagagtgttttcaacttatctatggatgtctaaagttattttatcaggtttgtagcctgttttttgtttaaataattataagtaacatttttggagtgcttaatattgccatatactgttgtaagtgctttatattgattattactgcatacgtatagcacccctccctggcacttgatctctctcatgctattcttaattttttctctatgatacttattatcatctaacgcatacccattcatttatttatcatttattcccttcctttaaatgtcaggactatatggaggggaatttgctgtgttcactgctaaatctttagtacctaaaagagatgcagcatagagtactcaacaaatgcttttttaaatgaatgattttatttattcttcacatcttcacatccagcttgtgaagtggaaaatactggtattacttgagggaatttactaatcttgaataccctttcttccaagaagaaatatttgtagagttttttttttcccctcaggtttaacataatggttgagaaaaaacagctcgtagaaaccacgtagtttaatgcagttatagtcaatatctataattacgttataggacctattaatttgaagggcagaatgatgtatgggttagtgtaattcttgcagaacatctttaaacttcagatttttgtcagctgacatcacaatgatgctttctcagtcttgtgaagtattttgcatttattgatggcattttgtgtttctttgcaggtagagggtggcccaaatccccctgatgaagatttgagtccagttaaaggaaatatcacctttccccctggcagagcaacagtaatttataacttgacagtactcgatgacgaggttggctaatgttacatacccaaatgggacaaggattctgtgttgcaggacacagtcctgtataaacttagtgtattgtggccagtcgcacctcagctataaatagctgactgttctggaatacatcttattactatttatcttacttaattcacattaaattacacatctaaaagctgatgaatctgaatataactggcaaccatacatcatacaaatatttaagcattttgtataccctggtaatcaatttttgttagtgctttcaattttgagcaagaacaatactaacctagaataaatattttaccataaaagcaaagaaaaattctactgcagttggtattcttttgtttttatttttttgttgttgtttagaaggagtctcgctctgttgcccaggctggagtgcagtggcgcgatctcggctcactgcaagctccgcctccagggttcacgccattctcctgcctcagcctcccgagtagctgggactacaggtgcctgccaccatgcccggctaattttttgtatttttaatagagacggggtttcaccgtgttagccaggatggtctcgatctcctgacctcgtgatccaccagcctcggcctcccaaagtgctgggattacaggcatgagccaccgcacccggcttgtttggatatttttaatgttcacatttatgggaagatttttattatttttatatttcacattggaactagcaaggatagagatacatgatacacctagcttaattgctaagaatgaatctgaacaataatgtgcaaggatgtcccccacatgagctaaacgagagaaaacatgactttttataaaagaaactaagttttgccagaaaagaaaacaaaaagaaaatagctggcaatttgtaaccctccctctaccctcctacaaaaattctgaaactaaatcacaagaaaactcaagagaagggaaaaaatgtattagagtattagaagacattattagaaaagaatttttctcttgaaaaaaaatgaaatatttggaagcattgatatctccagttcctctggttctggaagcaagcaaaaaaacctttttgttttaagatctcagagcattgaacgggctataatttggggagatgattaattatacattttgattgtaaatttgaaagatcaatcgaatcataacattttatttttaagataaatagctttgctttttatattgctgctgatggaggtaaaagcatgcatttttttcacttttatttctaaaatagagtttatggtgaatgaaaagctcacacagcacagtggagattaaccccaagatttctctgcagcagcataaataaaaggaaaaaaaaaagaaagaaaaaaatgaaaagcaaaaattgcactttaacagtgtcagcatttttcctagtagtgactcttacagctttttctccagagaggcatgatgtgtatcttgaaaagcatatattggtgtcacgtgtttaactcctgaattaacaaccatttggagaaaagcaagaataattcacaaggaaaactaacaatttttatgtaatgtttaacgtactttccagattcttaggtattattagactttcagtactacttctaagcatatcaaactgataaaactgatagaaatgtatgacagttttttactgtttaatctttggagttatctaaggaccagttaaggctgaaagacattatacctggacttcattacttgtactattgcttccttacgttttcttttcctgtgtaaaatacattatttacctgtggaaaatattttattaattggagactaaacaagcctttctatttgctccctcagttaaagaatttttatttctatgtaattgtattgaaacataatgacttgttacactttagtttatttgcaggtgttttggctgttgatgttttgcctctgtttatattcctttaacaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtatgatttattttaaatatattgctaccattattttattatattattccagatttaagttttgtggtgttggacacaacaatgaactgttagaatatgtgtcattttttcccacaaagtttcatgacaaactcagaaaagacacacacacacacacacacacacacacacacacacacacacacaagaatatgtcattttttctaccatggcttcactgttttctttcttatttggagtgtgatttaattatgcaaatgattcatagtatagtagttccctaggacacattcacatatctacaccttcatattaaaaatacttttttccgccaggcatggtgactcacacctgtaatcccagcactttggcaggcttgggggaggattttctgagtctaggtgttcaagaccagcctgggcaacaaagtgagaccccgcccacaaaataaaataaaataaaataaaataaaataaaataaaaagattagctgagtgtggtggtgtccacctgaagtcccagatacttgggaggctaatgcaggaggattgcctgagtccatgaagttgaagttgtagtgagctctgatcacaccactgcacttcagcttgggcaacagagtgtgacccagtctcaaacaaacaaaaataacaaatcagttatttttttgttgtatagattctgtttttatcagtgtctaatggacaacttgacattgggaaagcttatctaagggaaataaagtgtactatgtgacaatatgtatttcttttaaaacatttaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggaggtataacccttgttatgctttatgcttgttaatatttctgtgctgtacaagaaccaaagaatttggtcatacacatcaactttatgtttagtttgaagggacaggaaaaacactggctttgcaaatgatagttttcttactcagtattccttctgaaaataaatattttaccctctaaaaaattccacaaactgtgatttaggaatatttccaaatctgtttttggttcatcttttgctctattatgtataagaagtcatcatttttagacataaaatattaataaatattaaaattagaataacatggaaaatacagagtttgatcatctcagatgcgagaattctgtactttaatattttattcctttacttcagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacaggtacttgtatgattaaaataatcgtaattttggttaaccttcaagtgtactaacctgtgtgaaagaattaactgaacattattttgaccttgttattttgccgtcatttatatgttgttactaaaagttgtttaggtagtcggaagagagattatgcctgctcctaaggtatataagtataaataagacaagaatttttaccaaagttaatattttaattaagtgacattaaaagtacaccagacgtgaaatgccagtcatgcaagtcagactgtcatggatgacatagtagagtaacttacaaactattacaggggagggcgagagaaagagaggctaaccatgctttgaattgatttgggaaaatatgacataggaataggatttgtaggataagtatgttttcataatgaatattgcaaggaaaatatttcagaaacaaagcaatatgagatatatattttttctttttttttgagacagggtctcactctgtcacccaggctggagtgcagtggcggcatctcagttcactgcagcctccacgtcccaggttcaagtgattctcctgcctcagcctcccgagtagctgggattatagatgcctgtcaccacacctggctaatttttgtgtttttagtagagacggggttttcccatttttggccaggctggtcttaaactcctgacctcagatgatccatgcgcctgagcctcctaaagtgctgtgattacaggtgtaagccaccacgcctggcccaagaaaaattttataaatacttttaaataatatactcaaaaatcaatttctttgtctaggtagactctctggaccttcaactgtttagtaaagtccccatgacgtatccttccattttatacatttcatttcttctgttaaccaaaatattatttttatggccaaagtataaaatatctgcactcatttatgatactgttgttgttttccatgtgttgattgcttgatacttaaaattctaaatcaataaagggtacttattaaattatgtaaatcaattaaatacagaatcaggtagtgtgaatggactgacaaggaaagagctaaaatcttatgttgccatacattgtgccaactgaagtatatagcaaatgaaatattctatttcactaatttctttgaatcatgccacatttaaatatgtttcatattttgccttgattttgttttatgatggatttattattcctttctctggagtttctgattgtcccttttctgtatgttatcttcactatattattgagatcttgctgctgtcttcctgtgtgtgttgaatgttgagtttagctaaactaactgctttctgtgcttgtttcacatctgttgtctgggatttttttactgagctcctgaattttcttgatctgttgcgtttctcttttgggattatgctgtagttttgttgtagtatatctaccctcaaacaaatgtgctgaaagtatatatgtaaggtaaactttttgagtctttgagcacctgaaatgtgaaattttatactcatattgatagtttggcttggtagaaatttctggattaaaataatttattcttcagaacttgaaaggtattgttgttaagcttctagagttgcagatgagaaatttgaagggaaggaaatgatttatcttttagataactcgatctttgtctctgaaagctttttacaactgttccttggtgttctgaattttgtaagactgtgtcagcacttggtagggtgaccgttttcattttgaagactcccgcgtttttttaagctgagcctccaggcatacttgtgctgttagggcatttttcgaggactcttgtccaaggggcttagtgggtgacctgttacggggatgtaggatttgtcagtatgtacgcgacacctttttgtaatatacctacacagagggaggcatttgccatcttccccagagccctacactaatggcagtagatcctgatcttcatctttattattattaatttttgttttcttgcgtctcctccaagcgggaaaattttcatgtgatgcgagcttctgcctgtgaggataacttactctctggaggacccttggatttttcttggagtggaaagatagggaacacggctctattcacaattgtgtctggtttgtcctgtggcttgtggatgccagggagtctggatctgtgaagtgaaatactgcaaatggccacgcacatgacttgggcccttgtgagcattaagttaaaacaactagaatgctgctaccagaacacatttagagctatatttagaaactaaaaacaaaaacaaacaaaaaaatctctgactttatacaaaaacatgacataatttgtttgcttttaaaaattgattttattaatatggaagtgcatattgattttaccagttcacacttagagtagcatttctgaagtttcaagactgtgtgggattcaattttttgagtttcagaatttaatggaatttttttgacattagcacttgtttgtcttctctgctgtcagtgtcctcaggtttcagggtttcagaacattcccataagtatatgtttaagggctttttttgggatttttttggtcttactgttctcccttctgtttgtctccagtcttgcataatctacaactcatgcaagaaccagattattaaaacaagtggaatgagacagagatttttacacagttgcttttgctttcatggaagcctgggcattctggcatatgtggagtagttgcagtgatgtgatagaagtttgagaattgatgatgcagaaatgttgttttggagttacagagaacgtttttgttatcatttgagctttctaatgtcttttctcataatgcctcaaaactagtttttactgtggataaggacagtaaaaactgtgctaatatataaaaaaatctgtaccaatatcagtatcctctatgttaaacttttaatcttttgaaaaagtccaatatttctatccaagtaactgcagagaattcttgtataaatacatccttattaggaactttgtacaagtcagatattatcttagctactctgcttcagcattctatataaacatgacaattaatttttgatgacacttgaaagctaagaaaaaagttgaagaaggatgtaattaatatctgatttttggtgatcctgggttagaaagttgcaccactaatttcagactcaattctttatgtatctatatagttaaaaccaaaggtcttacagtgcagttaatttatcacttgcttagggtgaacaaggcattattagtcactgacacaagtcattgaggttcaaaacagctgtaggttctggaaggctagttggaataagagggctgtgtagtttgcatagtacataatggatgagcaactcaagaataggaagcctcagcctctgcatgcaaagttgaatgaaactaaagaaagcagaattctttagtcgctcctcattctttagtaaccctctcagctaaatacgttagtctgagatgcagcttttggcaagcatggggttactaatgtgctgtcccagtggcaaactatctgaaataaagaatgattctttatgaatgaatagagcagtttgatttagcagatggaacccagacagacaaaaaaaggcttataggctaggaaataagccctgtacaattaacattttcttttccatcagttcatttcataaccatctacattttctttctatttgtcaaaaatcctatatctaggattaattctataacttttttgataagtgtagggaaatatgacttatatatttctttctttttagaaagttttgtgtaaaaattattgtttttttcttgatgcttaacacagtattatcagtttagctctttttgaatatacagcaatgacaatgttcattcacgaatgtgtgcttggtcatacatgaccagtgtattttagaaatatctttgccttataacaatgcacacccttatatttatataccattcaaatatacatattttatttaactttgtgctattttgtaagataaataaatatatatgtgtatatatatatattccttttctctagaaagaatgacagttatgtgactttaattatttatctttacattttatctacattgtaaggtaaatgcagtatactaaagatcacgttttattttatgtggcttcatctatatgccaatacttgacaaaattgatcaatctaatttttttcttttttcaaatgaatatttaccaaaaccaaaattattcatgtctttctcctgtatatgattttttaaagcaaaatgtgtgacatttaaaaaagacatttacttttactattaaaatgtactatccatcgcaaaataggagagaaatcagtaccagtcctgtccacgtgtggaaaatcaatttaaatcacaggtctactggtgattacttagtgtcatcatttcaatattataaagcctaacagagggctttaaagagtggcagagacatgttttattaagttaaaagttgcattttattttaatatttaaaattcctatggtttttgcagtcctgtgacgattacctattcctgcattcctgaagtgaacactgtgtgcattgattgagaagttaggttttgaaaagttagaatatttaagacgttgaatgtttgtgatttatcagaattcttatagagctcagattgtgtagaagggaggaattaacaaatatttattgtgaagctgctgcagtttcaagtctatgtcaagcctacgtcatgtattgggaaaatgctgaaaaggacacagacccacaagagctctgcagacctgttgggaagtaaaaatctggaatgaatcaaatgatgagaaaccagcaatatgtaaaatgtataactgcagggacactatatgttatacattgcagttctttaaatgtaaagatgcatgaagttataaatggagttctgagtagtcttctgatactggattttgtctggaggagaagggaaatgggggatgattggaagtgtgggtcagtggaagacaggaaggagatgtggatgactctctgatatttggctttaaggtcaaggtagttggatgtaggtggcaaggaggaaaagcaggtggtggcactgctgatgatactagtgaaggggcatggaacagggacagtgatttctgttttggatattgtatatgtaaggtgtttgtgtgacatttatatgatgtctgtggcagttagttataatgatttggaattagagggagagatgcagagattattaaggagcaggcataaaattataagataaagggtttaggcagacccttggggaataataacaattgaggggcagaaagagctccagaggccagggaaggagattgaaaagggatggtgaatgagagaggaggagaataacattgcgaagttattggtgacctctacctacgcttactttgtcaccccatgctgttaagcttttttaaaaaatttatattctatcaattcttactactttttgtgtatttgtttattatagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtaagtaggctctttcttactgatgggggctaatgagtatgaagtaatgtacagacactatttttaaaataagatcagcatatagggttaacatcttaaaaagcttcagcatgtacaagaagccttcagtatgtcatttgaaataggtaactgatgagtatgtgatttttccatcatcgtttacagtattagatagaatgaaattggaattaattgctcacagtgagtgtcggatattttgatgtgacagctttcagatagttctatgacattcgatactacagtggtagccaaacataaacttttttttttttttctttgagagaggattttactctgtcgcccaggctggagtgcagtggcgtgatctcagctcagtgcaacctctgccccgggctcaatagatcctcccacctcagccttatgagtagctgggactacaggtctgtgccaccactcctgcctattttttctttgtatttttagtaaagatggggttttgtcatgttgtccagtttggtccccaactactgagctcaagtagtccacctcccttggccttccaaagtaatgggattacaggcatgaggcattgtgcctggcctataaacctttttttttttttttcttaatggccaagacatggtaccacaggtgtgcttgacctacttcatttctgagcattccatatgcttgggttggagtgaggtggccaggttgggccttatgcttgatgatggagatgatagtggtaaagttgtggaatgctaaatcttaagaattttttactttatatatacaatatatgtaaatttttgcatatagacatacaaaacgttcacatgcacagcaccccatccctccccttgcccccaccccgacatgccctggttgaatttttctcttagggatggctcttccttcagccttaccatttcctgagtcatagttgatccctgagaccttctccaagtcccccacacttaaatttgatttaaacctagttgaggtttggatcagaaagaaggagagctgtttttgttatcaaagccttatgttaaaatatggtgacctcaatttccattgtatattagcttctataaatggacagagaagtttcatttttcaagatggttttgatttttcatatttttctgaatacactcttttcttcttaaaacggaaaagcatttagtttgctcttaaagagttgattgcttttatcttagatagctgtaaatttaccgtttcatatttttcccttaagaaaaattagcttttaggaagttttgggctccttggacctgcattcttccctgttgggaaacagcagaaaaactaggagttttcctttgtttgttccagatacagcctggatgatgcccactccctcaaggtgattcagggccccagccctctgttataagaatctttgctcactagtctcaggttatgacgattgttagctgaagtagcagaatgattaatggagaaaatgtcttgtttttttttttccaagatgagcttaaagggcaaagaaaaaataaaacaggatactcctcttttaggagcataaaaagaatagtgtaatctagcattaaatattcctttatattcctcctttgaaaaaaacttcatcatgatatgcagcgatccttttattatacattttttaaagtgtactgcccttgaatgaaacctccaaatacaatttgtttcagaattattataatagcttccatttatttagcttatactgtggagaggcactgtcctagatactttacttaaacaattcctaatcctcaccacaaacttgccaaatagggaatcattagctttatttcacatgagaaaattaggatcagagaggttaagtaacttgctcaaggtaacccagagtcatgataaaaatatctgattttatttctgtggtatttatcctattggttagaattttttttttaattttacccccatcacttaggatgtattttatatgagataattttccagttttaatcaccggagtttatttttcagtttatattgtgatagtaagttcattttattttcagagaacctctaatggaaatatattctttagcaagattgctgtatgtttttcacaattctttgggttttaaaatatttgccttttattaaggcaaacccagattagacacatttttgggtgagggtagttttgtatataaatttgattagcaaaaattaataaaaatatatctaaagtgatttccatgcttaaaggattgtttggttgtgttttaatgcatttaatagttcgcttctctatatagaatacatatgttcacacagtaatatatgtacaaactaatatcaataccaaagcttatataatttctgaacatatattttagaagaaattgttctgttcttttctttttataaggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacaggtaataacccatttaggtaatgtttagtatcatttatgtttgagttctcttcaataactttgattttttttttactcttttttttctatataaagtaaaaaaaaaagtcaagtaaatagtgttatactggccttcagacttttctgttatttgttgatggcttctgattagactatgagtataattatatctttcagtgaatttttaccctgcttttcattgtgaagaagcactacagagagaatttatggaaggtatcagataaatatgaaacatagctaatatgttgttatattaaaaaaaaaataggcaccagcaaatctaaaatgttaggttaagcaaacagttctgctggctttatgttcaacagaagagaggactagagcttgtgagtaaaaagaaaacattaatcttcatgtaataaaattctcttttttacatggaacttaaacattaattttatgattattttctaaagaatcaaaaattgcacaaaattaagagatactttttcagtaataaataataagaatcaacagcatttctcagtgggtaatttatattaagaaaacttcacaatctctcaaagagttttttttttcagtttttcagaaaatcctttctaaatatataaaatactgtgtttaatgatttaataattctaaaaaatcagaatcagtcttatccctaacacaagtctctttatatgaaagttgattcatattagagaaggttactgtgacttgagggctttgtgcaattcatatttagaaacaataaaattcaagataaattcaagggacattttgtgttacattattcaggactaaagtagtaagttattttatatagtccatggatctctctataacagtgtcttatagatttttctttgtagatgctttgtctaaacacatttttaaaaatctgatgggtaactgatttttatttttatgtgaaagaaaagtatagaatgtaagcaacaaattattgaatgtccactgttccttttgctttctttcaaaaccacgttgtgtttacttcctttcttacataaagagtaaaacaaaacaaccaaaataccaagcaaacaaaaaaaccaaaaagcaaaaaccaatttacaacacacacacacacacacacacacacgctcgcgcacacacacacacagagtctagatgacttatggttttaatatatgtttcagactcgatcttaagaaaaggtatttcatacgatgaaaaaatcagtaaaatgtaatgaaatgtaaattggaaattatttttttcatttttgtttttttccttaagtaaggtgtaagcattcagtggacaatcttgaaaacaactaaagaaacagaaacagtgatgataaaccaatgctgtgggaatctgtagaaactttgttagcttagctgacagtttctactctcaactaaatgtttaaagaatgatttacactatccatctgcaaattgatagtgactattctttatattctttctaactattcatttttaaatcttatgtaaacatttgaaattaagtataatttttaagggtttattttgttcttctttttctatcccctatgggtaaaaatagtacatagtaaaaaaagtacataaggaagtacaaatcatgaggtagaaaatttcagaaattattggttcttttcaaatagaggaaattagttcaaatatatattaaaatgttttaatttgactagtaattggtgcatacttgtattatctcatttgtgtgtgaacaagaatgagcaaattacatttgagtgttcagaaacatttagttaaataaaatttagatactgtattttatcaaaaactccctcttaattttgcaaatttttaacaaaacttgagtgaaagaataaatgaatgatagcaagcatgattacaataaatcacatcacaatattgcaatgaaaatagttaacagtttattgtgataacagtttataatttcctctcaatgtcaaatccaagttcaaattctctatatttcaactcaatatagacaaaagttgccctgatactaaaaaacttgtggtgctttcaaataacatgctggttaaaaatattctatttagttttcctcaaatcacaaacaatgtcattatgccagtttatttcagaaaaattttggtgtatgtggtatataaccctatatttataaatggtgcatttgactttaaaaatgaagctctagggctctacatttgacatgtgctttcaaggctgtttgaaaatgaaatacactgtggatttggaaaagtgttttggtttcctgatgccaagttgtatttaagtaatttttggcagaattaaaaggtgcaatgatatggcttcttcagtatgttcctgtgcaaatgatataggtatagatttctctagttacacagttttgttttttctaactcaaagaacaactggctttagatctgagactaaaggtttttatttttttttaaatctaattaaagctactaagtaattataagcagggctgaatgaaatttgttcagctgctgtggtttgtgagcctgtacagtgcttggcaggcacaggcgccttggaggaggcctggaaaggaatgtcttgaatgggtcttgacaagcttgctggccatggggtcatcttccataagtgggaactgccgaacctcttgctagcatttgtcaatagcaaagaatccagggtgcagagttcccataaaacgcacattactagctcttgggaaaaaaggaagcctttctttagctttatttttcccttgccattctaagtttctcacagtattagtgagattttagcaaatggtgccctgcctcctttttccccttcccacacttctttctgtgttgacagggtagaaactgaaaggtttgtcgtgtattttgggtaagtgtacaaaataataccttgtttttggtgattcagtattttgttttgcaagtgattgtttttggacgagactgctgttctgcatgattacaggtcttgggaaattttgcttgtccacctggccatgcatgctttgtgtgcagtttcattttctaatgataaggggagcttacacaaagttgtttatttatttttggtcctaagagttttgcactgtgaatgcatttaaagtattttgaaatttgagaattagtgtaatgacatttagacgaacttaaaatttttaactttccttgtaggtccacataacctcaagaacaattactgtgctgtacttctgaaatttttacccaatgtcttttatgaatcttgtagcttgtttaacagagaattagcaatcaattatctgaacggttccattggttttctgagagcatctaagcaatttattgcttatatctcagagccgtatacagaacttttcagaatttgcatttcacttaagggtagcatattttaagaaagtttaaaaataaatttgtttaatgttcagaatggatttttatattttgcattctgatccagttttttctttcctagcttatgtggatataagaaattttaattaatgaggatattgatataaatgatggacaaatttggtatgaaaattatgactgttttaacaatataaaataactctcctattatttagactattctgtggccactagcatgctaagtattatcagatttctaaaaactagggaaggatgacaattcagattctctgttaaataggaagtgagctttttttctacatatttctacatatgaattgtggtttcattgtgatttgaagtctgagcatgaatatatttttggttcaataggacgtgacatttcgcaaggtttagagcagcttgcaggattgataattcttaagagcctgctggcttttaaactctcagaacattgcagtccaagtccctttgatcattctaattatgctttgaacgttaaaaccagaaatttaaaaaacatgttgttttaatatgttcttttggagatacgtaggaattggtataacatgtcatgcatctcagatctattctattcttttttttcttatattccctacattttcttttatactaaaagacaaaaaagcacaggtttaaaattaaggagaatagaaggcatttgaaaccacaacatattcctaaaatgtaatcacaattgtgtttattttttatcagcgtggcttgctttagtccatttagttatccagctattatgtgctctattcagttagtataatcttatgtaatgagttttaaaaataaattcaagtgtatgtaaaattgaaacacaattttgttttaagctatcttctaactacatgttacaaattaaatttttctaaaactggaatcaaatctgcaaattttgatgctttatataaataaaatatattgataacatttggttacagtattcttggtgtacatatgtagtgtttggtttttgtcaaataaaaaaagatgtaatgaattcagaaatagaagttctttcataactgttatgagtaaaactgttttgatcttaaatgatttcaacacacgtgaattcacttaaggtctaattcctcatagccttccttttcattatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcagagataacatccacttttcttaccattttagagtagtatcattgtttctctttttctctttttggacaatgtatacgtatttctggtgtctcttaattgataggagaatgttaatttttaaagaaatgataccacctcttttgtcctttcagtgagttatatgcttctgaaactttgagtatattaatattcttgaatatttatgtttttaaatttgttgtgaaaagtcaactttataatttccatactttgacacattcactttagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtggtaatttattctgtgtcttatattgtatttctgtttactgaagaagaaatataatttttttagttatttctttagtaactagttatttctagttgctcaccctgccttagaaattacacatagtgcggaagttttttttagaatcatatttaggaccatgatttttatttcttacatagtatcgtgatgatactgatgacttcagttatattttgataccatttaagcatatgcagtgcaactcaaacactcaagaatgagtccatccaaatagcgagaaccttaaaactaagaactactgctacggaactgttgaggtgactggaaatgataaatagtttatttttagagcagtgtctgtctggataaggaaatcacacttgagcatgcagcttcctgtaactgcttttagcagatatccttacaggactttatgataggtgtgcctaattcgtcatcattctgtttcccatgccaactgacttctaaaatcccaaactagaaaaaaatgagtccatttactttatttattatatacctacagagggaggaacaggctaatatatttttatatgtaccttaaaaactgtgctaagcaaatagttggcagttattaaaaagaggtgttgtttttatttttgtttatttaaccgatttctttactcatcattttaaaagtttcgtatgtcttcatatgtattatgtatgtttccatttcacagctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgaggtaaatattgcatataactttctgccttacttgttgtagttgatcaataattattttttattaaataattaaacatctggtaatatattttgtgataaaagtttgtaataaagaactcaggtgtgacagtgtctgaccataaaccagaagagcagtattatgttttggtttccctgaagacatgttgaactctagaactgagagtggtcagtgacactgctcatgtatccagtatcagggattcttagttggagaggcgaagccctcggcttgtatttagtccctttgaaggcaaggtcatctatcaagtgtcctgtggtgcagtctcagcaccgggacacggggtcgcatgagtcatggaccaaacatggcatttcttcttacagatagtaaagagaaagatcttaataacaacaggaagtgaacctttcctaggagagtgacacttagaacagctgtggaggccagtcccctctccctcagacccattcctcaagagacaaaattcgaatacctttctgttttagggggaggggagcaccagttcacagggatgacgtgaaaaagaaacagcgtccacctggggatccatttaggctcagaaatgtggggaatcaaatcttgttaggacatggagtgaggcctttatgacccatgcagttaaaacttcagtaaggtttgtaagaagcctttgtgagctggctgagctttagttactctaaactctgctctaaatgttcaaaaagttatttttatgtttcatcttaaaaatcaacatgtctcccattttcctgcagaaataatatgacctctgtggtatatcagtttttagcttatataaggcaaaatatctatatttccattaaatttcatagttagtctaaatgaagtggctgtttgtatgaatgcacatgaaactaatttttgggggggtctgagtcttacctgaatgtgttaggggaagttctgcctccgaaaaggaaatgaataatggtagtgttaatggtgcttttttaaaaaaactgaataatttaagaatatatgatgtaatttatatgtataagtcacctgacttaaaacgtgtaacattttccaaagattccagaagaaatggaagaatttaccgttatcctactgaatggcactggaggagctaaagtgggaaatagaacaactgcaactctgaggattagaagaaatgatgaccccatttattttgcaggtggtattgctgtcttatttgaatgagtttacatatttcttaaatagtatatataaatgtatatatgcacgtgcatatatacatttatatgcacgtgcgtatatacatttatatacatatatatttagcaatttttttcattgaacattttcaataaagcacaattgatgcttgtttaaagattttgtaattcattcgaggattgttatttaattgttcgaagttttgactaatacttcaaaaattttttgaagcaaaaagaaaataagtactgttttattatctttttccccctttcagatttctcggtatttttttttcttttgtgcagaaaacacttctccatgtgatttcttcaaataaacagtctagttggttcagggctagattatgtattagaaggacctgagtattatgcctaatggatggccatacactataataactaatttttaagggaaatattaattaaaatttcttcgttttgccactttaacgctttcttcagaactgtctttggccacctgaggcatcttttggttttgtttatgaaacggttgttgtgtaactctttcttgaatccttgttgtcagctatatatgggttaatttacctaatgcaggaattgcaggaatcttgtaagccttttgtattttattgatttgtattctttctttcttcttctttttttttttttttttgagatggaatattgccctgtcaccaggctggagtgcagcggcgtgatctcggctcactgcaccctccgccttctggattcaagtgattctcctgcctcagcctcctgagtagctgggactacaggcacacaccaccacgcccagctaatttttgtatttttagtagagacgggttttcactatgttggccaggatggtcttgatctcttgaccttgtgatctgcccgccttggcctcccaaagtgctgggattacaggtgtgagccactgcgcccagcctgatttgtattcttaaccttcagttaatgtgtacttaatgaattagccttatgttcaaccttctggtaactgctgtgacaaatataaaacataagatctctgggcctgttctcaaggaagttacatcctcaacttagaaatgaggtttatgaaatagtaagcagaggatttgaaatagcatgcaatttgctgagaaattcgatgttgaagataatggatttttgtaggattaaggcaagaggatggccattgactgttgaaataatcagagggtagtcatgtcagagttgggaacagagctaattattttggcaaagacacagtacaaggcttctctcttggagggcagggagaagcacaatgtgatctgaaaatatgtgatggaatcagaaaagctcatgtgttctttctttgtggatatttcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtaagtaaattatgcttttttatggcagatctgcctcagtgctttaataagatgaaattaagcactgcagtccaataatgaggacaagtagggcctaactacatttgtactattcaagagtaaaattatttcattgctttcttgagaaatggggtgaagaatgtatgtgttgaacctttatgtacttgttgaacctttatgacatcctttttaaccttttctttatgatatggcacaaatagaaaattctgatatataagtaagtgaattcttacagctaaaagtaacaggacttgggaatacggcttccctaggtattgcttagtcacccagcgacttaagggataggtatcctgtagcattttccttggagcagggtgctggcacacttgattgggaagcttaattctgtaggcagctaacttcaactgtttgataattctctggagccatggccaaaatgaatgacaatctgcaagtgaaaaagatgtgttcgtccttctccatactgtaaatgaaacaggatgttttaaccccactctttgggatttgagaatgttttggctctaccttctgtaaattggaaaggcctatggcttctcttgatagttattttattcttttaatagtacaaggagtttttttttccttgaaccttttgagagtaaggtaaagacatgatgtcctatcaccctaaatacattagtgtattttctcctatagagatgcccccatgagctctaacgtttgcatcgggtcaccatgatgccctgtctgccacccccagtggaatgccaacgttgtgttccaccttgtgccttttggactgaaagactgaggaagagaaagagatctcttaattattgttttagctgtgtctttcattctccctatctctttgactttcttcattgctgtctctgtttctattctgcttcctctttttctccttttgtctttctctgcctctcatttttcacacagcttaacaaagaagttaaaactaaaaactattatcctgtgaggaaaatttgaatttgtagaataaacccacaagggcaatttcacaattgcaaaaaacatcgtcagatcttacgtagactaaaaacatttggtgaatccattcgttgttctaaaatttaaatgaaaggagttgctacagataaaaataattttagtgaagtaaaagtggaaaacaaagttttactgtgaaatacagaaaagcgatgaaggaatgatattattaatattattattttttacggagtctcactctgtcaccaggctggagtgcagtggtgcaatctcggctcactgcaacctctgcctcccaggttcaagtgattctcctgcctcagcctcccgagtagctgggactacaggtgcacaccaccatgcccagctaatttttttatttttagtagagacaggttttcaccatgttagccaggatggtcttgatctcttgaccttgtgatctacccgcctcagcctcccaaagtgctgggattacaggcgtgaaaaatgatattatcttaatagaatttatttactctagaaataagttcttgatgacatttattaacttagtgtgattctggtaaacatttttgtctcaaaaatatcactgtggttaagctgtcattaggaaaaaaacgccaatatggttaaatagtgaatgaatcaaaacatcctgaaccttttgtaaagagtaggggaactgacatttttttttcttttttgagatgaagtctcactctgttgcccaggctggagtgcagtggtgtgatctcagctcaccgcaacctctgcctcctaggttcaagcaattctcctgcctcagcctcctgagtagttgggactacaggctggcaacaccacacccagctaatgtttgtatttttagtagagacggggtttcatcgtgttggccaggctggtctagaactcctgacctcaagcaattcgcccgcctgggccccccagggtgctgggattacaggcgtgagccaccgtgcctagccagaaattgacgcttgaaaaagaggtttagttagtttgtgaaatatgtcattgggaaaatatatttattaatatttgattttgagagagagagagagagagggagaacacaagatgtgattgggttactggcctgaggtatgtgtgctacctcgtactgctgctgcatttgtctttaatatttttccagaaatgatgacatttgagaatccaattactttcgttaagaaggctcagatgacaaaaatctctagagcttgtgattttttaatacatcctttcttagctctttcctccttttcgatgtcaaaacatcaaggacttgtgggacccatgatgggacactgtagaggcagcatctctgacatgacctagtgctggcagtggctgtttatcctgatgctaatcatttagagcatatgctctgatattggatcaaaggatatggccatccttcaagcccttgttaaatattgctagttcatcttgcagagaaacagaatgaattttcagcaccactgggacatgtttcattacaaatgcatatgataatagaaccctgccaaaattaggttttattattatttatttttgttagattttattatatgctctttatttattgtcagcgttttctacacaatgatttgctatttttgtgtcttttttccattgaattatcaagtgaagttgagtacagttgtatatttgtataatttttattgataagctggtttgctatatataaaatttgtttctataattttagctgtaggtgttgtatacatctgtttttgaaagtgttagttgcatcagttcagcaataaataaattctgcgcaccggttactgagcatctatttttctagggcatggaattgaataagaatcattagtccaatgagcttatagtaaaattatgtgtatgtctgtatgtgtatgtgtgtgtgtgtgtgtcccaatataatatgatcattgttatgatagattgacaaagagcaaagtgccgtgggagcacactggagaggcacttagcttaacctggggattcaaggaagaattcctggaagagttgttgcttgagctgggttctcaggaatgataagttaggtgagtgaagatgggaaggacttttgctcccctgtgcaacagctggagtaaagatgaagagataggcacttcagggaagtgatgagaagagacccaatgtgtaggcaataacagtgccaatatactgtgcaaagaactggagtagaaaggaatcaagcccaaaccatggagactactttgttctatgtacaaccagatcaaactttgctgcctgaaggcagagatgtaaagggaaacactcaagccagtgattccaatgaacacagacagtagtatttttatgttattgggtagtcctttattatttgtatgaaataaaagaatccacctaagaaatttgaaaatagaagaaattatgtttttaatttctaattaagctattgaaggtatattccttttgtgaagaaaagtgtgtttttcaataaaatagttcatttgtaactaaaaaaaatgggaactatttcatcttgaaattatgtaggcatctctctttctctctctctttgtatgtatgtttgtacttatgtgtgtatacataaacatctttggaaatatggagcagtattttgcatttattatatgaccttcagtgaggaaattcttgctgaaattttcaacttaattgtaaactttcttaatttaaaagtataaattttacagcaagttagctacttctttgttattttgtcttttccacttttaatttaggtgatacagtagtatatcaatatggagtagctacagtaataattgaagctaatgatgacccaaatggcattttttctctggagcccatagacaaagcagtggaagaaggaaagactaatgcattttggtaagcatatgtagataaggcaagtttaaaattgggtgaaataaaaccattaagtatgtgaaattctgaaatattccttcaaaatttaaaaattggttaagaattgagtaatttcaaagttggcagtctgaatgagtggtaaactttgtttatgctgttgccacttatcttcaaaaaaaaaaatcttttagctagtaagcagaaattattctccccacccccctcgttcaaacttcaatcctttgtgagactgagaaacttgaattattcaagatcttcaggaactcttctctcagatgatatgtgactacccccaccctgtactttgcttttggaaaactttttccaactgtcatttagtattttttgatggagcttagaatttatctttcagtttggattttgaagacaagacttttatgactgtttctcttttattaaagttctaccttattcttctcttcccatgaaattcttcatagtttgcctcgtagaaccagctggtttgtttcttttaagacaatagatagtaaaaatatgtttccttaataacacaggaagctctcattagagtaagattcactacttataaattttctttaatttattttgtaggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtactgtgtttttccatgtcttattttatttccatgtcttatttatactaaattttacattttatacttagataattagagccatatacaaaatgcaattggtgaagtatttgtgtcatgactatctgattttaaatgttaaaatacccttcttgtttcaagtgttattcttaacattcacttttttgatatcttagtttggttcagttttagggatggaggcctacatccatcctcaaacatgcaaatagactttctccacaccaactatagtgtctccaacaagacgttagtggaaggtaggaggtaaggattcatggtagcttaaagcttgatctttgtgtcataatttaagcaatcaattttcgcatcacttttggttttaaaaagcacagaattaaacctttctaattcatatactcttttcaggcttgactgattatcaataaaattatgctgaacaaatattatttcatatcctgcccctaaaatgtggtgaaagccacatggtgacactacttttcattgataatgagtaaattatttaaccagaagtttgtctgctaaacaaattcttttttcttcacattatactagaaagtacttgaaattctagtttctcactcataaattttcttgttacaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatcattataagaatcatttacagtcattcagagatagccactataaacattaagcatactgttaacatgttcgtatacacacactgtatacatatttcacaatttttcttctttattgtcaaaatgatacatgtatattgcatgaaatttgaaaagtatagaatagtattaagatgcagagtgaaagatgccatattccctccatgaaccactgtaacatattggcatttttataacttttattttgaatgatttagcattgtaacttaagtagttaacactacaagtagagaaataatgatcaggtttgtcccagagaattagtcatagaagcaaagtgcttagaatcctcaaatatgtataatgttttacatttataaggcattttccatacattacctaatttgtacttcataataattcaatatattaaatagaggtcagagtcagtaaataaattcgctagcatcacacaggcaagtaacagaggaaccaagacatgaaaataaaccattaactcctaggtcagtattccttttaacataccatagagacagaactaaaggagatgtgatcatttctatatccttgactccagatagcatcctaacagtgagaaccatgatgtggttttgtgagaatcaggggaacttatatcattacagttgccagataattcaataggagagacaacataggatttcccattgaatctggagctccagtgaaaaggtgtttctggtttgctgggcaggaaggtggtctctgtagtcggtatgggagctgtcatgacagtaacatgccagatacttgtgactaccctgaaagacatctgggtggagatttgtgaaacagcctccactgaggttattgacaagaaatattgcttgtacttttttttccagaatctctgccaatatctcatcttgcctaaagatcttacataaatatcttagttgagttattagagtacgaacaggtaaagaaaggagaactagtgaaagcatgaaaaggtttgttattgagatatagtgacacagttgggctacatgttattattatttttaaaagtccccaagacttacatataatgtttctgagaagaaatatttctatttttacatctattctcttagttgtttggatagagagatatatttggcctgtagaaatacttcttatgaattctcacaactttaactcaatgagtgtctaacatatcaagccttgaagttcttaaataataatatagtactgaagtttaaaaattgtgatgaggctaggtgcagtggcccatgcctgtaattgcgcctcaagcgatcctcccatctaagcactttgggaggatcgcttgaggccaggagtttgagaccagcctgggcaacatagcaagaccctgtctctacaaaaaaaacaaaacaacaacaacaaaaaaagccaggcctggcagtggactcctgtagtgatgtccttgctatttgttagtctgaggtggttggattgctcgaacccaggagtttgaggtcacagtgagctattaacatgccattgcactctagcctgggtaaaagagcaagatcttgtctctaaagtacataaataaataaatacataattaaaaattgtgatgaataagtccatttttaaatgtgcaagagtaaattttaaaataccatagaataaatttctatccaaatacgtgcacatacatacatgcatacgtgtgtatgtatgtgtgtgtatgtgtatgttcagatacttttttttctagaaatgttgacagactgatagaagttacttttaagtatatcatctaatttgaagatagttaccaattcttttagtacaaaatataaatcctaatgattatggattccttttttaaaatcataatagaagataatatccaattcattgtatactagttatgcaaaagtttcatttatccaaaaatatctttcagtaaaattgtcttactttctgaatcacacgtaaaatttaggacaggacacttgaaggtattgtagcatttaaacttgtctctaatttcaggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagaggtaagtagtgagcttggagaattttggatttaaaaattcattgtaggtggatttgtttgggactcggctttctttcatttggtaagattggttgcgcatctactccaagtccagaagtatgctagggccagtgattgcaaatataaattacaaaattcttactcttatgagttcaccctttggatcaacttaatgagctgatagaagtaataacaagttagcaaatgaaactttagcaattcgcctgaaagttaatgctcttcaaagaacgtatgtgtatactctacctatttatttttggctactgttttggatgtcattaaattgaatgaaataatatatattgaaggcttgtatgaataattgtatttgcaactttattaaaatatgattttttgatttttttttttttacatgtgaaacgtacttgagtagttagttatcactttcttccatgttgggtgtaaatacctttcttatcaaccttcttggccagcttaattcattaggctgtcttactgtccttatcagttctttccatgttttcaaagattcgtaatcatcttggtttcctgttcagtaatgtgagaactcatgaaactacttcccaggtgttctgtgtgacagcaacagcttggtgaccatgaaaggatgccaaggaacaagagtctttctttttgcaagttgattctaattggtttagaaggatgtataagtaaattgaaatgattttttaaaaatggatgagtagagtttgaaaaaaaatctaggtcataggctcattctagcttaaactgggatgtctgcctctctggagtgtctttcttgccactttagccctttggtttggtggcagtcttaagagatcttcaaatagtatggtcctttttttacatcagaaatagcatatcctagactagcaataacaaatgtcatacaaatctacaacttgaaaagaaagatgtttacatatagtggataatacctttaaataggtattcagctatcaaagaacttctacatattacattttatgcacctttctgataatccataatataggtgcgttattaaccagtgtgatagtgatattaaccagtgtgatagtgacattaaccagtgtgattattttgtataatatgtgtcaacattttgaagatctgtataactcagtaactagtatttttcaagtaatcaatgcatattgttgcaaatcatgcctgggtaaaagactgttccaaagtacaaggtagaccagtagattttaaagtactagagtatgtttccaggttgcagctaaatgctaagaaactgccacttgtcaaattttggattttggtataatgtcaaggaaaaatacccataattatctgaaaagactagtaaaatcctcttcctttttctgttacacacatgtatatataaggctggattttctttatacactttaaccaaagtaaaagatagaaacaggccgggcgcggtggctcacgcctgtaatcccagcacttcgggatgctgaggcgggcggatcatgaggtcagaagatcgagaccatcctggctaacatggtgaaaccccgtctctactaaaaatacaaaaaattagccgggtgtggtggtgggcacctgtagtgccagctactcgtgaagctgaggcaggagaatggtgtgaacccaggaggcagagcttgcagtgagccgagatggtgccactgcactccagcgtgggtgacacaagactctgtctcagagaaaaaaaaaaagaaaaagaaaaagaaacagacaaattgattgcaagaggagctaggagaatccagctgtcttctattaagccagacattaaggagacttttaaaaatataaaataatacccccttatcactaattttttttcgagaactgtagttatttctcataaaatatgttgtttatgttagcatgtaatgggtttattattgctgtcttaaaatgagttatcaatatttaaatttttaatttttcatttgaatatggaaaatatcagcagattttaatgatatcaacaaaaactctctggggttctcaatagttttgatgtgtacaggggtcctgaaactaaaacatttgagaactgctggtttagtctgtgcttgtaattatcttctgagttcaaattttatgatcacttgcttcatttttagaaataaagactacagccacttccatagattcttctccattatgttgttgcaatgacattgacaatttaacgttaaaaaaaattccctcaaaatttctgaatgcaatagagaccctataaagactctgggctgggcacagtggctcacgcctgtaattccagcactttgggaagctgaggtgggaggatctcttgagcctaggagtttgagaacagcctaggcaacatagtgagacccccttgtctattttaaattgaaataaaaattaaaaaaatttaaaataggccttctgagttatgttatgcttttacctttttcatagattaatatgacataaagtaatattaaggttaaaatgatagcataatgacatcttaaacagataatgaaaatatgtagactctgacatagcctgctatttggcacattgaaagagaaggtaattattctgtgatttgttttctaccaaccaggtacactatgtcccggcaaagagcaggtgcttaataaactataattgaaagaatgaataaaacctgtgaagcagtttagggtcctggtgaggcatgccaaatagtgctttggattccaagtgggatctgtattgaacagaagatggattttgttagatctatagcctagtaaccacattctcatgtttcttccccatattttgttgttctgtgtatttcctatgttattttctctgtaccatattttagcactgtttttacgtgtcctgccaaattgtataccacgtaattataaattaatgaagttgctttcatagtgattcatagaacttgctaatcgtattgttttattttttataactaatacttgcattatatgttatatttataaactatggcttaagaatcaattaaagacactttgggaagatcttcatgaaaacaagaatatcatttcaacttggactatatttgtttttaagtgcctaccatgtgctatgtgaatagattccttgggatataagtgatattggtataatccgatatcaccaatcatcacccatgcatgaaacaaaattaaaaattaattggatttgtagctttaattttctattgcaatagagaaggccaattcatggttcagaatactgcattattttttctaagaaaataggtttcaaaaactcgtcttactatttctgtttattattactgttctgatgatctgaatatttggcaaattcctgacttaaaagaggagacggtagtgagtattattgtgtctagtgagaaactgtttggggatggtttgatgattattatggatgttaggccccttcatatactggcctaaatgtttgtttgtatcataattctaaactcaattagatgaatattttaatattagaaaaaaggtttagatatttattttctatgtcttatgcatttctgtattaataattacataccggagtctagtatttctgaaagtgttgcccttggatgaccttgtcagaaatatctaatgcttattactggacattattcctgactcaggaccccattcctggatcacaatctctggctaggggagaggggaagtttaagctgaattagaaaacctttttaaatgaaagttttcatatatagagtatacacaaaaatagagaagataaaggaatgagtcacagtgtactagcttcaataattatcagccttttggcaatattgtttaatcatttttggttaaacaacttttttttttttttttttttgagacggagtcacgctctgtcgcccacccaggctggagtgcagtgatgcgatcatggctcactgcaagctccacctcccgggttcacgccattctcctgcctcagcctcccgagtagctgggactacaggcgcccaccaccatgcccggctaattttttgtatttttagcagagacggggtttcactgtgttagccaggatggtctcgatctcctgacctcgtgatccacctacctcagcctcccaaagtgctgggattacaggtgtaagccaccgtgcccagccagttaaagtactttttaaagcaaacctcaggcgttatgttatttctctgtaaattcagaagtattaaaggtggatttgcactgagaatcctggtagttttttttttctttttttcttttttttcttttattattatactttaagttttagggtacatgagcacattgtgcaggttagttacatatgtatacgtgtgccatgctggtgctctgcacccactaactcgtcatctagcattaggtatatctcccaatgctatcccttccccctccccccaccacacaacagtccccagagtgtgatgttccccttcctgtgtccatatgatctcattgttcagttcccacctatgagtgagaatatgtggtgtttggttttttgttcttgcgatactttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctgtttctccacatcctctccagcacctgttgtttcctgactttttaatgattgccattctaactggtgtgagatggtatcttattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattgtctcccattttgtaggttgcctgttcactctgatggtagtttcttttgctgtgcagaagctcttgagtttaattaggtcccatttgtcaattttgtcttttgttgccattgcttttggtgttttagacatgaagtccttgcccatgcctgtgtcctgaatggtaatgcctaggttttcttcaagggtttttatggttttaggtctaatgtttaagtctttaatccatcttgaattgatttttgtataaggtgtaaggaagggatccagtttcagctttctacatatggctagccaattttcccagcaccatttattaaatagggaatcctttccccattgcttgtttttctcaagtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttgttttggcttaggattgccttggcgatgcgggctcttttttggttccatatgaactttaaagcagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcctttgtaagttggattcctaggtattttattctctttgaagcaattgtgaatgggagttcactcatgatttggctctctgtttgcctgttgttggtgtataagaatgcttgagatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaatgttgtcaaaggccttttctgtatctattgagataatcatgtggtttttgtctttggctctgtttatatgctggattacatttattaatttgcgtatattgaaccagcttgcatcccagggatgaagcccacttgatcatggtagataagctttttgatgtgctgctggattcggtttgccagtattttattgaggatttttgcatcagtgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccgtttggtcctggactctttttggttggtaaactattgattattgccacaatttcagaacctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatattccctttatcattttttattccgtctatttgattcttctctctttttttctttattagtcttgctagcggtctatttattttgtcgatcctttcaaaaaaccagctcctggattcattaattttttgaagggttttttgtgtctctatttccttcagttctgctctgattttagttatttcttgccttctgcttgcttttgaatgtgtttgctcttgcttttctagtccttttaattgtgatgttagggtgtcaattttggatctttcctgctttctcttgtgggcatttagtgctataaatttccctctacacactgctttgaatgcgtcccagagattctggtatgttgtgtcttcgttcttgttggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcattcaggacttgctttttgaatgtgggtgctcctttgttgggtgcatatatatttaggctagttagctcttcttgttgaattgatccctttaccattatgtaatggccttctttgtctcttttgatctttgttggtttaaagtgtgttttatcagagagtaggattgcaacacctgcctttttttgttttccatttgcttggtagattttcctcaatctttttattttgagcctatgtgtgtctctgcacgtgagatgggtttcctgaatacagcacactgatgggtcttgactatccaatttgccagtctgtgtcttttaattggagcatttagtccatttacatttaaagttagtattgttatgtgtgaatttgatcctgtcattatgatgttagcgggttattttgcttgttagttgatgcagtttcttcctagtctcgatggtctttacattttggcatgattttgcagcggctggtaccggttgttcctttccatgtttagcgcttccttcaggagctcttttaggacaggcctggtggtgacaaaatctctcagcatttgcttttctgtaaagtattttatttctccttcacttatgaagcttagtttggctggatatgaaattctgggttgaaaattcttttctttaagaatgttgaatattggcccccactctcttctggcttgtagggtttctgccaagagatccgttgttagtctgatgggcttccctttgagggtaacccgacctttctctctagctgcccttaatattttttccttcatttcaactttggtgaaactgacaattatgtgtcttggagttgctcttctcgaggagtatctttgtggcgttctctgtatttcctgaatctgaacgttggcctgccttgctagattggggaagttctcctggataatatcctgcagagtgttttccaacttgcttccattctccccatcactttcaggtagaccaatcagacgtagatttggtcttttcacatagtcccatatttcttggaggctttgctcatttctttttattcttttttctctaaacttcccttctcgcttcatttcattcatttcatcttccatcgctgataccttttcttccagttgattgcatcagctcctgaggcttctgcattcttcacgtagttctcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctggtgaaagtcattctccatccagctttgttccgttgctggtgaggaactgcgttcctttggaggaggagaggcgctctgctttttagagtttccagtttttctgttctgttttttccccatctttgtggtttatctactgttggtctttgatgatggtgatgtacagatgggtttttggtgtggatgtcctttctgtttgttagttttccttctaacagacaggaccctcagctgcagggctgttggagtaccctgccgtgtgaggtgtcagtgtgcccctgttggggggtgcctcccagttaggctgctcgggggtcaggggtcaggcacccacttgaggaggcagtctgcccgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtctgagcttccaggctgctttgtttacctaagcaagcctgggcaatggcgggcgcccctcccccagcctcgctgccgccttgcagtttgatctcagactgctgtgctagcaatcagcgagactccatgggtgtaggaccctctgagccaggtgcggggtataatctcgtggtgcgccgttttttaagcccgtcggaaaagtgcagtattctggtgggagtgacccgattttccaggtgccgtccgtcacccctttctttgactaggaaagggaactccctgaccccttgcgcttcccgagtgaggcaatgcctcaccctgcttcggctcccgcatggtgcgcgcacccactgacctgcgcccactgtctggcactccctagtgagatgaacctggtacctctgatggaaatgcagaaatcacccgtcttctgcgttgctcatgctgggagctgtagaccagagctgttcctattcgtccatcttggctcctccccctggtagttttttttaatggacgcttgacattcgaaagctcttttagaacttaaaaaatttactttattgtacaaaatattcattaaattttctataaagtgttgatatatagcgtgtaactgtacattcttttattagatatgaatagtgatttttttaaactgaaaatattcaggaagctataggttttgatgaaggttttagtaaataaaaatatagttaggtaacttttccctgtgacttttgcaaacaaaatcctcatcttagtcctaaatgctatgtgctaatgcttactgacttgataaaaatttaagtttgtaaaagaaaccattatacatttcttagtgtctctttggatctatttaactaatgcctcttgctgaaaagggaaaagattttatatttacatattaagattaatggtttattaatttaactcatgagatgttacgatccccattttcagaggagactgtgaatgcttgataagtggtagaatgaggaagctcaggactgcttggccttaaagccatactctttccaccacacatttgctcatgtaccattcggctagcatgaaaatcctgatgtagatccctaagtggaaattaaatctgatgttgtattgacacctgggtctcaagctgcattctcctcttctgtccaacatcttaaggttggagtgccctaccttcaggacagtcagttccgccatgacatgatggatggattcttaaaaatcatcacactatgccagatgcataatgagaaacacagaacttatggaaaagatggggttaggaaaacactgctcaaggacttggtcgttgacacttaaaaaaaatagagacctgataaaaatgttgtacacattaaatatttaatacttataaaccacaatagatatggcatattatctttaaaaaactttaagtttacttgtagaagtgggcatcagaaggattgcagcttgtgtgttattgtgaaatgatagaatgagcattatctaaaattggaggaaaattataacactagatgtggttaagtgtggctagtaacacaggtgttgaactgagtagctggtagttgtttgaggtatgtgtttgaggtatgtggcttgtttcacgtgggtacaattttctgtgttcaccaagtttcttgtggatgaaatagcacttataagcaaatgcaagttgaggctgtattcaaattgttccccaatatattatcaattgcattggaacaatttcatgatttcaaaataagtgttatagcagaattaaatgtacttggtcctcttctcctctccatctacactccccctgctgtcgcaactggttttcgaataccatttgtataattatatatttatccaccaattttacatggctttaaatatcatttatatattgataacttccaaatttatgatgtcaatctcatcttttctctaaaattccagactcatttctttagttacaacttgatgcatttctaggatatttatttcatagacacttcaaactaggcatattttaagccctttgattcttacccaaaacctgtgactgatacaggaggaaagtcaaacctgcttcagagatgcctgggcttcatatgttgctacttgctgtaagtgggctgatgcttctctagtgccctaatcagaggtgtttctgaaggtcagagggcagagctgtaaactgtccacttagccatttatcttttgtggatggagaaatggcctgaagtatgaagctactgcttcaaccctgagcagtgcttatggtgtagttgatcggtgaggggcttggaagaatcaagactagagacaaagatgtttggggagaagtcatgtgaatagattgccaggagttaacactgagtatgagggggtgtttcccaaaaggttctcaacaaccgtgaaatcagagtgaggctctgttgcatatcggccagactctcctttgtcaccacagtgccattaacagcatgatggtagggatggaggttatgcataggtttgacagcatgagctccctcttaccaagactgatgtagcaactggtggttgctgaatgtccaaacagcaagcagcagagaccaaagctaagtacttctcaataaaccatttactggtacactgatcccaaccagactttatcactccaaaggaaacagcaattcattcttattggaattaatactttggctaatgtatttactttagcctcctaatacatcctaatacaagcaccatcatctgaaggcataaagaatgccagctttaaccacatggagacccgcatcacacggcctcaaagggactaatatgaaggaggtgtagcaatgggtacgtagtgataggactgattcactggcctcaccatataccatgtcacctcaagtagctggcctcatacaatttaatggcctgttgaagacccaggcacagtgctggcttaaggacagcttcttggaaggttgaagtattgtccatcaggatgcagtgtgtgcattcaatggctggtatctgtttctgtgtccccaataactagaatgcagaggctcaggcagcaggaggtaaaagtgagactgacccctgtctctgctacttttagtgacctactgcctgaatttgtttcctactttagactccactggattagaaattctggttctggcagtggggctgggggaagaatgtgcctgctaggagacaactgagggccccactgacctatcacctggttgttttgggcctctcatgcccatggaccagcaggcaaataaaagagttagaatgttgcccctggtgtactcgatcctctttaccatgagaacacccaggttgctgctgctcagtgaaactcagaggatttgctggaacatctggtgactccacactcattgataactttcgactattgtcggtttgtagacaaatcccaaatctgtcctctccaaaatgtcagcaccaaaatggctctatcttatcctgatcagagatgcttatggttcatatgaaaaatacagatggcattttatatattaaaacttgtatttttatctgtattcatttttggttcttttttctccaaactatatatttgctaacataaaaataaaattgaattgagagactgaggatttgacagtaggaaggccttactctaaatgatattccagctgcttccaccatagagttttaaagcattatcttaaagtgtttagataaaaaattttccacttgaaaaaaatacctctaggtttatatgataaaaacaccaacaaatatattaagcatggtataagatgccctctttgatctgactgttgttcccacactaggcatctctcaaggatctccccatttggcacttcatgccaccccgccaaaatgataccaccaaatatactatattgcttcttatgtctgtgcctagaaagttctctctgatgtcatgttccaccctctaccccaacccccaccccatttggtctgtctgtgctgagcccattataaaattgcaagtttgtctttctctttagaattctacttatccagagaaaggactatgcattaaaaactattttgcaaccatagcatatggcacagtggttggaacacaggaggtatcaatgaatgaattacttgtgcagttaagacattataattctttttgctttatttatctctataatggaatgggagaaaatgaatgattgtaaatatttcttagcagtcaaagtttatctgggggaatgcagaggcctcgttagtcccttttagagaggtagaaagttgtagaattaagtttatggtaaaaggatttcatggaagcattgtaattttgtcactgatttgaattgctatgcacctattaataatttacattcaatttcagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggtaaaccctaccttttttgttcctttgaaagcctcctggaaagcttttcctgaagtgtttgttctgtaatttctttgcagcttttgattgaagtgtcgcttcccattattatttacaactgtaactgatacattagaatttgcttcaaacatgtctgctgtaaaacctttatcaggtagagttagtttcttcatcactttattttgtacagaactttatcatgacatttttgcgttggattttaagtgatttcctatggatctgtctcctatgatagattgggactggggccatgtctaaccccagcatactgcatatgtcaaaacatgtttgtttaattaataagaaaggagaaattgttttttcactttaaattttgaattaaattttgtagagcatggctcagttattcctattccttttataactttttttggattaattgcttgtgctggactcctaaggcccattatgaatctattttctaaaatactgttcctgagcacgtcaggctctccttaggcagacgctagccacagatacattgcccttgcttcttatcctatcacatctcatcatagaacatgcagtttcttaattgggaagtctctacctgttgttggtaataccacggtctttggtacaaaaaatatatgatattatattgataaatcaacgtatcatatatgatgtaatactgatgcatgtataggctactgtcagaaaatgctactgctcagcacctgccttagtctgttgggactgctataacaacataccttacactgggtaacttataaacaacagaaagttattgctcgcagttttggaggctgggacgtctgagagcagggtgcctgtagattctgtgtctggtgagggcttactctgcttcaaagatatggtgccttctcaatatgccctcctcacggtggaaggggcaaacaaactccctcaacactaattccattcatgagggctctatcctcaagccctcatcacctcctgaaaaccccatcttttaataccatcactttggggattagattttaacataggaatttgggggacaggaggataagacattcagactatagcagcatccattatttttaaggaattaatctattcagacttctctttctctttatatgtctatatacacacatatgcacacacacatacaatgttttaatgttttaatttatgcagaaataagtcgtaagtggtaacttcatttaaatataatttagttgccttttgaattttcttctagtaagtaatttctaaatgcctcattgcttagtgcctctggatatttatatttttaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggtaacctgctccttttgcaagaaaaatcctctcttctctgggtgtacttagttttgttaagaacttcttaaggcactttttgcaaatgacggaagtagaatgccttcagacctcctaatttctaaactctttaacttgtatgctactgttttgagagacattgtttatgagagaaaatataaagatcagtttccaaacttcaataatatgttttgaaaagtttttgcaggattatttaaaatggaacaaagtatttctgttcatagctatcaaatttctttaatttaataattatcctatggtgatttgttaacacctaagtaattgaaatactttgtaatttatattttattaagcttcaagaagtgaagctatcactctatattaatttctttttgtcttatgcttaatagtgacaattttctcgattggggaactatcacagatgtctgtcctagtaaattgagaatgttttctgtattggaaaataatatttcttctatgggaatgaatcaagaacatctgttaaaaggtttgggtagaaatcttgagaggcttttcacctttagttttcatagttaggttttgtttgtttgttgatttgtttatttttaagtgttgcaactcctttaaggtgccatttaacctgttctactatatgttctagaatgatttctggagagtctaaaaaaatatgagtaaaagttagaaaatatgtattttaaaactgtatcagtattcctgctattgatgctgctgtgggaagaaaagctttctttgagtaaagacttggaaaattaacaatttaactttcattattctgaaagcttatgaacatattctgtatcaaaagcatgttagttaaatctttgctaaaatattttctaaataaagtccctcagaattttggcctggtgatcaaaataattgtgtaagatcgctttaattgaataagaaattcttgcacagttcattgggacaatgccctggcccctttgtctccactaggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccaggtaatttactcagtccttttgaagttgtatttgcacttgtaaaacagacataatccttctctggaagggatatacactgtacctggaacatagtgactcacgcctgtaatcctagcactttgggaggcaaaggcgagaggattgcttgaggccaccagcatgggcaacgtcgcaagtcactttctctacaaaaaaagaaaaaacagattagctgggtgtggtggtgcagctactctggatgctgaggcaggaggattgcttgagcctacgagttcaaggctatagtgagctatgatcccaccactgcactccagccttggtgacattgtgagactctgtctctaaaataaaaaaagaaaaaagaaaaataaaaaaagaaaagaaaagaaagaaagaaaaaagaaataatctactttatctaattaattggagaatatttatttagaatttacattgaacattattcatacacactgaagtgttttcaatgttgtattttacttgtcttcttagcatttataataatttgggatataacaaacattctgattttacaaatttgtgtacagaatgattgtaatctattcatatacagaatgattgtaatctaatggatcagtcttttatatttcagaatgttgctggcacattagaatttcaaccaggagaaagatataaatacattttcataaacatcactgataattctattcctgaactggaaaaatcttttaaagttgagttgttaaacttggaaggaggaggtaaggctggtgattcaaaaatgttaaatatttgcttgtctacccatgctgatgaaagtagattcctttagggaagtaagttcctttgaattaatcttacttaaataaatgaataaattattagtttttgaagagagcagcctgaaagttaataattgcttaagatacatgataatatataccataatatatgtggtaatataatctatatcaatcatttttgattgataatccctttcttggtaaaaagaaaattttcctctttacataaacttttagaattagttttagaaattaatattcaactcatagtttcacattgatatgctttcgctatgaggtttggttaattctgagtaatatctctgtttattatatggacagcatgttcgtgctatttttcccccttattattacccactgatatttttctagaagagacgtgcttttagagtgaaaagtataagtgtactaagtcaccaaattacagttttcattcatggtaggttcccctaaggtcacctctctcttttctgttttttgctgtagctctgctagatctatctacagatataacgctgtaaaatctggtccttttggatgatctataatgagttgattattaataaaagaagtcaacaataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtcaagtagcttatagagcttaattctttggagagtcaaggacttatttcatgctttttgactataaaactgatgaaactgatgattctacataaggtagccacaacctgaatagatgtcttacgctagccaaagtatatatggtgttgaacttcttttttatgacttctggataatgtgggagcaaagccatgtaccagatatttgctgcaaatccattttgccttttggatctgtatgatgatttcaggttctgggtgccatacattctcatgtctggtatattcccatcctattgacaggcaaaaacacagggcaaaaggagaagagagggcagatcttacactagcatgtcaatcaaggatattggtagaagcgtatacgtatggatgtggctttgctatttttactctcctttttttctattgctgtcatcactgcccttcctatcttctttgtttgcaaacatttggtaaaataatggttggggtacaagatgtattagagggaaaggtataaccactttctctttattattgccaaagtactttatattttatattttgatgatattatttattttccattattttatttgatctttataactcttagtccatttcgtgctgctataacagaataccacatactgggcaatttataagcaatagaagtttatgtggctcatggttctcgaggctggaaagtccaagactgggggactgcatcttttagggcattctagatacataataacgtagtggaaggctccacatggtcagagaatgcatgtgagagggcaagagagggctgaacttgcttttacaagaaacccattcttgcaataatgaacccactcccaggataacaacattaatttattcatgagggcagaggtgtcatgacctgatcaccccttacaggtcccaattctcaacacggttgcatttgcgattaaatttcccacatgtgaactttggggaacacattcaacccatagcaacaacatttctataataaaagacagcatctttcataggtgaggaaactgagataccaagaagtttagtgacttgctgaaatttttacagctggcatctttcacaaccaggaaagcagaattgttaggtgacttgtctaggactctttccacaatgccagtggccagagggtgatcaagtttgagaatggtaaataaatgtggtggggatttgaatgtgtggatggaaggaaaggttagatgcatttctcaatattgaactggttgttgtgaatggtaaggtgattatcacaggcatattaggcctaagtgtatgattatataatcagataaatatattttaaatatctaagatattagaaaataatttacgttggtgtaaaaaaatgaaaatttaaaaataatactagattgacagaattgggaagtaacagttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggttgatggaagtggtagtggtgatggggacatggaattcttccttccaactattcacaaacgtggtaagcagtttttccaaggtcctttactattataggtttttattttaacttctcattttagagacaatactaaccacttattgacacctactatgtgtaggtcctttacatattttatcttattaactgtcacagaaactttatgaagtatgatttccttcatgttgtagtcacccagctagtaagggatcaagtcagaatcacatccctttctgcttccaaaacccagactctccttcttgtatgaacctaatgtagtttcctgattctaattgtgatagaaatttcacttgaatgtcatttataaaaatggttgtttggaaacattttacatagctttgaatacataaaaagaggtcaatagaaaatttgtattttcgttttaaatacatcacacttattctctgtacaaaaaagaactatgaatccttatatgtaaaatgtaatcaaaacaaatggggagtaatcccagcactctgggagaccgaggcgggctgatcacctgagctcaggagttccagaccagcctgaccaacatagtaaaaccccgtttctactaaaaatacaaaaattagccaagcgtggtggcatgtgcctgtaataccagctattcaggaggctgaggcaagagcccaggaggctcttgaacccaggaggcggaggttgagtgaaccaagattgcgtcactgcactccagactgggtgacagagcaagactctgtatcaaagaaaaaaaaaaaagaaagaaacaaatgggaaaaataaataaggaagaaaataaatggaaggatagttggcaattattgaaggtgatattgaaaagaggatgccttttgaagtagatttatatacaaacatgattcagctttttacctcaaatatttttttcatatatgaaaagcatacttagaatatttgtttcttgaagaagagcattttctaatcctcaaatccttcttttttcacaatgtcagattttatattttagtgtcagaactcatgatttcactgccttcattcctaacttccatcagtgcctaatgcaacctctgtagttaattacactattacttttagaattgttcattttctagtctgtagacattaatgcaacataaaatttgaacatactttttaggaaaaacttaaatgctgctttagatcatggcatctttttagctacagaatgggactatttaagatcaggagagatagatttatagtatcatcacatgatgaaaaaataggcctaggattcatgcacgttggaaaccaagaatctgttccgccagaatgggaaactacttattatttcatgaaggtaagagtcattttggctcaagttcttttgaggtcagaaaggtcgtgggagaccttcctcatatactctgtgtggaagaatgttctctttcatagagaagaaaaagaaaaacaagttttccttattcatctccaagtgcttatgcagcacttgtacatcacgttggtgccaaagtagagaaaggtcataaaagcatgaatatgtgtggcacccatttgtgtctgcctttctttctaaaacaaattagaatgtactcaatgaatggaaggactcttttcaaaaagttgttccttggctttttctttgatttgtaaattactgatcatcattttttttttctatttgttggaacttgttcatgcagccagtctaggagtggcttcccaaattctagtgacaattgcagcctctgaccacgctcatggcgtatttgaatttagccctgagtcactctttgtcagtggaactgaaccagaagatgggtatagcactgttacattaaatgtgagtaccttttcttccttcattcctagacactttctgttgttttaaaaactgtactgtgctatgaaagtgtgttttatgctttcctttttttgtgtaggctgaggggaatgagcctattggcacaggcaatacaaattggtgatcaaacagtcgtttggcatttatttttgtctttagtattgcacatggagtcattgtttaattctgaagatccttgaccctttaaggaacataatggagctgtactacaagtatttatcttacatagatttttgtgtttgttcagataggctgtggtaacaaacatctctaaaatatcaatggctagtacaacaaagaattgccttcctccctccctccctccctcactccgtccctccctcccttccttctttccttccttccttcctttctttctttcttttttcgagacggagtttcgctcttgttgcccagtggagtgcaatggcgtgatctcagctcaccacaacctccgcctcctgggttcaagcgattctcctgcttcagccttccaagtagctgggattacaggcatgcaccaccacgcccggctaattttgtatttttagtagagacggggtttctccatgttggtcagtctggtctcaaactcccaacctcaggtgatccacccgccttggcctctcaaagtgctggaaaagatttgtttttcattcgtagtatgtatatgtccaacttaagttagcaaggggctctgattattagtcactttaggcaccaaggctatatctcagcaggtgcttttatcttcttggcggagggaaatgtggatgtgaagaacagcataccagctcttatagcttctttctggaagtgatttacatcatttctacttaacttccttgatcaaagcaggtctcctggctgtgcctaatgtcagtgggtgaagtgcaatcctatcctgtctctctcccataaggaaagaaaatctaaaacatgggtgaactggcaataacaataactctatatgatgtgtgtgtttgtgtacctactctgctttgttccagtagaaattaggaaggattcattgttcagtgactcacaggagctagctgcttgctcagcttccatacgaataatgaagaaatatcactcaaacatatccttctgtactattatggcagattttcaataaactgttgtgcgataaattcaacaccttagaaaggataactaatgactcaggaaagataaaaaaagcgttaagggaaaggatcaacttttataaaattactgtctctaaattttattttgatgtaaccatcatatttcaagaataaataaaaattactcttagttgggatttacttggagaaatttttaaacttttcattcttaacatattattgacaaaagcatatcttccttcttaaatgtattttcttatactttgggtcaaatatgttttttgatgagtttgtttacataaaatattgaagataaaagtaaatgtgatttgttttaaaatgagttttacagatcacttttcagaaaaacaccatttatacattccttgcaatgaaatatataccatttttgcagtgagtgtgaaaattttatgagtgtgcctgaatgtaatatgttgttaatcacatttaatttattgggcataaaagatacacaaaaaatagttataatttaaatagaagctacgtttttttcatcaatttatagtttcatgcaacaatcgcctttgaaatttcaattgtgttttatttattttttttaagagatagagtcttggtgtgttgcccaggctggagtgcagtgacaccatcatagctgactgcagcctcgaagtcctgggctccagggacccttctgtctcagtctcctgaataactgggactacaggcatgtgccactgcactcggcatagtcactttttaaatatcctctatttgtaagactctctgtgggccttcaaagatggatagtatatgacccctgcctgcagcagtcttgtagtctggagaagaacttatataaaataaaattgtgctgctatcattaatgtatttataagcctctaagtaactggctttaatctctcttttaatagattttaatattaagtattttgtaggttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaagtaagtatcccttagtgtgttattattattattagctctcagaatcctgaaacaatcagttttaaattttatttaatagaaaattctataaaaagtagtaaactctaactttgaaaatgtcctcttacaacagtttacctgtaaggtaactggaagccagacacatttttttcttagaaattatgttttaaaagtcagtagaaagtaagatgggaactttaaaattatctagcacactctattataacaaggttggtgtagtcttgaggctgcctctgatttctggatgagtggattcatccactggggttgctgtaacaaactgccataaactgggtggcttagaaacaacagacatttttcctcatagttctggaggctgggaagtgccacgattaaggtgccagcagattcagtgcctggtgagggtctgcttcctgggccttgtggagggttgaggggtctctgtctctctcaggcctcttttacatggggactaaccccatttacaagcgtctcacctccttaacctaagggctccacctcttaatactatcaccactgggattaggatttaaatgtatgaattttgaggcaggagaacacaaaccttcagaccatagtaacacagtagttcagtgacagtattaattaagaatgggccgtgcagaacaggtttgtcagggaagaaggcgaagcggttaaagaggcagtaatttagagtatgatgatttgcagctagtttttgaggtcaaggaactaaattagtttcctactcaatcttgtaactgaaatgcagttttgttttaatggcacagtgaactaattagaagagcatcattctgttgtaatattatgtaaagtgatgattaattatactctaatgattttttcctttttgataacttttcaacacatattaaaatatttctgtaggtaactgttcttttgttataaattctataataaaaatttctctagaatgtaagctacactagagcagggacattctgtttagtttatttttgaatcccgaatgtctagattaatgctggtgcatattaaacaatacatattcttaaatattcttaaatataaatagtagggctgggcgcggtggcttatgcctgtaatcctagcactttgggaggccgaggcaggcagattgcctgagctcaggagttcaagaccagcctgggcaacatggtgaaaccccatctctactaaaatataaaagaaattagccgggcatggcagcacgtgcctgtagtcccagctactctggaggctgaggcaggagaattgcttgaactcaggaagcggaggttgtggtgagccaagatggcgccactacactccaacactccagcactccagcctgcgtggtagagagtccatctctataaataaataaataaataaataaataaataaataaataaataaaataaatagtagagggaaaaccccaaatgagaatcctatttggctgatggaatcttgctgaggtttcttgatgacttttggccagttcttagaattttgatagctttctgtgttctgtgtggatcttctgtctttcagttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtaagaaaagacatctaaaaagcagtacatacagagggatgtaagcacagagggacatgtatccttgattaacacagcctctcaaagttgcaattaggataatcaactagaaaactagaaatactcttgtatctttttcaagggacaaatctagagtctttttttttggggggggggatggagtctcgcttgattttacaatttttttatttttatttttattttattattattatactttaagttttagggtacatgtgcacaacgtgcaggttagttacatatgtatacatgtgccatgctggtgtgctgcacccattaactcatcatttggcattaggtatatctcctaaagctatccctccccgctccccacaccccacaacagtccccagagtgtgatgttcccctttctgtgtccatgtgttctcattgttcacttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaatagtgccgcaataaacatacgtgtgcatgtgtctttatagctgcatgatttatagtcctttgggtatatactcagtaatgggatggctgggtcagatggtatttctagttctagatccctgaggaatcgccacgctgacttccacaatggttgaactagtttacagtcccaccaacagtgtaaaagtgttcctatttctccacatcctctccagcacctgttgtttcctgactttttaatggctgccattctaactggtgtgagatggtatctcattgtggttttgatttgcatttctctgacggccagtgatgatgagcatttcttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaattttctcacattttgtaagttgcctgttcactgtgatggtacttacttttgctgtgcagaagctctttagtttaattagatcccatttgtcaattttggcttttgttgccattgcttttggtgttttagacatgaagtccttgcccatgcctatgtcctgaatggtaatgcctaggctttcttctagggtttttatggttttaggtctaacgtttaagtctttaatccatcttgaattaattgttgtataaggtgtaaggaagggatccagtttcagctttctacatatggctagtcagtttttctgaatgggcaaaaactggaagcattccctttgaaaactggcacaagacagggatgccctctctcaccactcgtattcaacatagtgttggaagttctggccagggcaattaggcaggagaatgacataaagggtattcagttaggaaaagaggaagtcaaattgtccctgtttgcagatgacatgattgtatatctagaaaatcccattgtctcagcgcaaaatctccttaagctgataagcaacttcagcaaagtctcaggatacaaaatcaatgtacagaagtcacaagcactcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaggatacaaacaagtggaagaacattccatgctcatgggtaggaagaatcaatatcgtgaaaatggccatactgctcaaggtaatttatagattcaatgccatccccatcaagctaccaatgacttcacagaattggaaaaaactactttaaagttcatatggaaccaaaaaagagcccgcatcgccgagtcaatcctaagccaaaagaacaaagctggaggcatcacgctacctgacctcaaactatactacaaggctacagtaaccaaaacagcatggtactggtaccaaaacagagatatagatcaatggaacagaacagagccctcagaaataacgccgcatatctacaactatctgatctttgacaaacctgagaaaaacagcaatggggaaaggattccctatttaataaatggtgctgggaaaactggctagccatatgttgattttacaattttgttttgttttgttttgagatggagtcttgctctgtcacccagggtggagtgcagtggtgtgatcttggctcactgcaatgtccgcctcccgggttcaagattctcctgcctcagccttccgggtagctgggactacaagcgtgtgccaccatgcccagctaatttttgtattttttagtagagatgggattttaccatgttggccaggatggtctcgatctcttgacctcatgatccgcccaccttggcctcccaaagtgctggtagagtttttatatatttatggcactgagcttgtagactttgcaaaaagttttggccaaattatctatgaatttgaaagctatgatgaccaaaatatgcacaaatcaatgaaaagtaaactgaggaaaacactggttttctctgagtgtactcctcatttttgaaagggattcacttgtaaatgactactgaggaatgcagggaaaatgggcagctacatgctttcagtgcttggcaacagtcttgtctctggatccctttatcttcttgcttatttatttgtgaagagcaaggaagaggcaacagttagtattaactattttatatataagaaaatgacttcattgccagatgtatatataagaagactgcctactttgatagtgccgtcccagcatccagagggagatttgcctgagaactattcaattcgaatctttctagtgtgctttcagaggaacaggaatgtgaatggatgggatactgtgcttgatttaaaaaaataaatcatctggccataatacttgcttgaaaagacaataaaccaggcccatctaatacctaactggtgtaggctggggtagctcctaggaatacctggctgcctgtagagggcctcacacactgacagatggtggggattggttagtgtactaagacattagtcctcagtcttcacatgaagcacccctcctttccccacccacctttttttttttttttttttttttctctcctgccatcctgagcagtactcagtagcggctttcaatctatgcaagaaagtcttttcatgtccagctgtatcattgatgatgctagcgttcccatatctgtgcagtggtataatttatctttccagtggcattacaattctatttctgttcttttttctaaaagtacacatttttttcttgtagttaagggggcctatcttgtaatgaatgattctctatttatataaatagaccaaatagatatacatctttctgaaagtgaaggaatgaacttgagcacccctaggaagtctttttcgttattttgtgacattatcaaacccatttttctactgagaggcataaaagtcttcttgcttagaataaatgtagtcaatatcctcaaaaaagtatttccaagtagatccataaagtttgttacctgatagtttttccctagtatatggaatgttttgatcatattttagaagtcttaacattttacttttggtcttttcaggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggtatgaagactaatttatgtctctctttgacttgtctgcatgtatagatcatagataatgatctttacttttggagactcagaattgatctgatcatgctttctttcttaacctgctgttactgacatataggacatctgtacacagttattggcagttgttagtgattgtttaaaaaagaaattaaatcaatctcttagcatatgtggagaagtcacgaactattggctttagggtgtgacctggctcctatatgtgttttgtgagtcttaggcaattctttagaaaaataatttaatttatagaaatttacacaaaaatttggatttctgggctttcttgataaataggaaatgtggcaatatcaagttccctttcctgcataacatcagtcatgggaaccaaatagcaactgcccctctggagcaggcttgcactgtgcaatcagcttctgtgctcactggacctgtcactcatgtctggtatagacttgagccctatgggctttgtggtttctacttctatcacagtgaaaaataatttggaaattttggcagagcagaccaatttgtatcacagcatgttactctggtttttgtgggttatagctacttagattgcttaggggggaagagaatccactataggatggtgcttggttaactgttatctctgtttcactttgtatttgaaatgaactctgctctgtctacccttcaggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggtgagaggactggctagtatagaatgacactgtaaatcataccgtatctatagtgactagaacagatggccattgtaacattttggagaggatgtcaaataaattattcctgcaagaatgttcaaactatgctagtgtgaaagtgatccttacagttgacaaaagcaggaatattctagaaatagattgtatacatatgccagtttactactataagacttttttgtacaattaacttgcattgttcaacattttggttaaaaggttaaatacatatatatatatgtatatacacatatatagtcttaatttataatacatttgctctgtataaacttttttctttttttttttttttttgagatggagttttacgcttgtcgcccaggctggagggcagtggcatgatcttggctcactgcaacctatgcttcctgggtttaagggattctcctgcctcagccttccgagtagctgggattacaggcacatgccaccatgcctggctaatttttgtatttttaatagaaacggagtttcacagtgttggctaggctggtctcgaactcctgacctcaggtgatccacctgcctcagcctcccaaagtgctgggattacaagcatgagccaacgtgcccagcctgttctgtataaactcttaacttatatttatactcccttttggcttgggtgtgagccagtcaatcttaagtattattgtggtttttcattcattcattcattcattcacttattcttcaaccattgttgagaacttactatatgaaaaatagcatgcgagatgcatcttcttgatatttccttttcctgatgaagcagcaaggtagcaaatataagtacagtatcagtggaaaagttaatcactaacatacattggctgaagataattttattgtatgaaattcaagtattaacatttagatctcataaaattacttttgatagcatttattctttaatagtataaaattttatacaagttcataaaatttattttgaatgctaattgtgccatttttcacttctaaaatattagatattcattagcacataaaaaacatttctgtttttttctctctaaatttaggtggcattacagtatgtttttgttttaaattttgtcaaataattttatttaagataatgtgggaaataaagcatagtatattaacgctccattaaaatgtatatttcagattttttttaaaaaagttataggacgtaaaagtactattattgaaatggtaaacataaacagggatattaaaattgagtcacatgattatataacaatattaaggagtttaaacagcctgtatgtcttatatataactaggttctgttattaaatgttgatgatgggttattctgttacatgctgggtttgtaagtgtaattggggagttcttttagtccatttatatttcattccattttgttcttgtacttgtatgtatatgtttgatttttttcccttgaatcatttttattctaatttcagaactgtgatgctgttaaggaagttttcactgtatttttaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaaggtatatgagatagctacttgcctctgtgggagtgatgagaattgtggggtggtggggaaggatcccttgcacagttaaatcatttaggttttgtggttttttctatgccataaattattttataggttattttaatgtgttaactgaattatgcttattagtataaagggcctttcatttatcatacctattgttagtgaaatgggtaataaattttacatcactgagctctctaaccccagaaatgcattgctctaatctgtaatttgttacaattagtacttaaatataactggcttttaaattaaagagcatttgtatgatgtatgaaggagctgatttccaggtctgttttttttttctttttttgtgaggcagcattgggctcactgagctccttcagaaatagaaaacaggatcttgggaacttgtgacaagtccctggtatccacagggaattgattgcaggtccttggatataacaaaatccttggatgctcccctttaatataaagtggtgtaaaatataatatttgcatataacctatgcacagtcatccatatactttaaatcatctctagattacttataatacctaatacaatgtaaatgctatataaatagttgctatactggactggtttttaaagtttgtattttttaaatttttttttttctgaatatttttgatctgcggtcttgaatccacagatgtagaacctgtggatagggagggctgactgttactacatttcctcaaaatgtagtcatgtttgttatcattgttactttgtttcagttaagtaaagcaataaaaattaactttgtaattttgttttgaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttgttaatatacagaaatgtagtttggctttagaaaaaaatagaagttaattggcttgttaatggttgacatgacatacatagactgacatgactgtacatatatatctttttagtttaaaaaatagattttccgggaatatgtgaattttatccctttatgtttgatagtagtgtctttgacaaagcacagaggaaactataaggcaagttctaattttgtaagggaaattttaataatgacccatgtacttacaaccatacatgttggtaagaagcagtggtagctaggaaaatgagtattaattgataaacattttcatatgcactagacaaatcaggaaatatcatcagagaaaattatttgtaagtaaaagtagcataaactttggtgactgcatttatattacattaatcctaatgataaatttataatactgttcctacacttgagatcactattgtaaaatttcataaacaatatactgatattttacatgatcagctaattagaattaggatcagattgagtggttctttttcaggactggttgactcgtgtgctatttaaaattgggaaagttagtatgtttaaaatagttttctctgggtgtgggacaggtatctttattgagattattgattacatcctcatttgggcagttatatattccacaaaattttaaaaaacatagtgcttttctggttgaaaaagtaatgtatactctaaaaacctcaaaatatacaacaaaatgcaggaaagaaactttgttcctaattctatattttagaacaatccattgtatttgttgtttaactttttaaggcatatacttttttttggaaactaattagaggtcatggtacatatgtaatacgctttttgaaacacataataatcattatgttttagagtaaattttaaaaattgtataaaatatttttattatggttattttctagtcagtgatttgaggatttagtgggatatgatatgcttgacggaagatgggaacaggttagtaattggtaacttttctatttcaaaaggaataatgaaaatgtgacgaggagggagtggaaatgaaaatataaagttggatttttccagtggttatgttaactacaaagaaagttatatataaagaaatagcattatataaattaccattaccatgaattataaccttagcatcacacaaaatggactctattgctaacttagattcttagataatgcagactctcttaaagcaatcttgacactgctgtattgatgaaaatgcagcagggtcacaaaagagagaacatgcatttaatctcctttctccttttccctgccttttcttttcccactccttcattgtctctccagaaagtggggagaaaataaataggggacaccttaggctgaatggcagaaagtattggatttagggacattctgtggtgccctatctactagatcaaattgcaaagtagattgcttggacttttgttgctgtcacttgtccctttgagttcctcttttgttttcttccttcattgcactacttcctggagactggtacttgatgctgtcatctcatcgagttactcaaagatgcatctcatttaggctggttcttttgctcagaatttgacatccctttttagttcctcattttgaccacgattccctaagtgttcctggtttttcaggaaggtattgtgttgatatctgattaaaattatcacagtaatgccagaatgagaatgagactccactttcctaaagggagttgtttctaaacaggatatctttggagctcttttcctagctaggtcactgttcttggctaacaaccaggaagtaaagccatgattctttgaaacaattctaccttttaactttcccataattcaaaatgtccttctccacaatctgtcttcattaatgaaattttacagtgtttgatatgtgaaaagatatatatatatataattaaaatttgcttatgttgcccatgatatggaactgttataattcactcatatttttatttaacttttaaacatagaaattattttgggcctttctgagttctctgtgttggtgattttgttactttggtttttattccattgatgtttttataggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggtgggttcctttttttgttaagcatattcattttcttttctatggatgttgtcttttgtctagttctttaaaacttgatagtttttccctttcattattttgttgaactgtgtgtgtgttaatctgcatagaacttctttgggagaaggctttataatgaactgtttagccagatttaggagccttgcaaaccaataccatgttctagcttgccattctctactggtatgattttaaggaagttaaacctgaaatgcttagttttcccatttgttaaatgattcaaaatattacttcataggtttctttgtgaggattaaatgagctaataaaggtaaagtgcttagcatagttcctggcaagtatagcgtatgcccaagggtagctgttggtatcaaacagtgaaacattggtaaccggttaaaaacaagtaatagtttgtaatcagtgaatattttagcctggattttatattgtgtttgtacattttatgaacaaagtgccaaaccttataaaatttctttttttccttaaaaaacagtaattttcttgaattcttacttaatattttacatcatatgtagggttttgcatagatgggctaatttttgtgtgtttaaaacataacagtgtttttgtcttcgagtaagcctgttttggggtaaataggtattggtagcctgtgtttcattacatagtttatctggaattaaaaaaataattttaccttgaatagttaataaatgaaaaggatatagattgtgtacttggacatctatttaatagatgagaaaacaaattgagacatagagagattaaaagacttgacagtgtcagatggttagtggctgtgccagaaacagaatgtattttactgtattaccttttcccttactgtacttccaacttgcaagtttatttatccatgcaaatattcgagccattttcagtactctacttttattaacggtttggaattgcatgttgtcatagcagtaatgagtaaaagtgaataattccataaatctaacctaaagacagatcatcaactatcaaaaagttatttgtaacataatacagagttactgcaggaatagttaataataatgacaacagtaacacttacggagtgttttctgtgtggcagacactccaccttcattatttcacttaagtttaacagcagtcctatgatataggtataattgtatacaccagattttcatacaaggaaactgaatttgagagagactaaatagcaacaattattcagtggtagtgcttatgcccagctgtgtcaaatccaaagcccatgctatatagggcacctagtgaggagagactttgttttgcttgaactcacgtctgctgcagaacctggcaatgcagggacttttggtaaatatttgaagttatttgagttggaagcataatgaatttgagtagcagtgcctgtgtgagggaaggaaattagtgagagaacctgactctgtttcaggttaaagatggacattggttaaagatgatagctgaaatctggaaaatgaatatgatgacttttgtggacagaggaaaaaaaagcaaattatcggaatggaaccatgaagaacatcagactaaggtgctgggaaagaaaaaattacctgagaggagagagaagcctttgctggagaggcagggagaaaccagggagagagtgtgttttcaatcagttacactgattactccgtaatcagtgagtaatcagtaatcagtgtgtctcatactaacatggccaaaaaggggagttagatctcaaatgggccaaataaaacagtggcaatggtagatgaattttaaaggagtattggggataggaagcaaatatctaaggatgacaaacatagaggtcttcaggggttcctcctcaatgtggctttcaggaggctgcctgttcagtgtttgcttctggtctgtgacaagaggattggaaactcttttaacaatttcactttgctgtgatatccaaaagcagtatctatgggctggtattttgtatgtcttttttgtttgcgttagttttttgctatttaacttatctagtcatttattttattctgttttataagagggtcagcctctaatggattaaggcaaacaaaacaaaacacaaatccctgtccttcacagcatgaagttttgagaagcactgcttattggctataacagcaaggagaggagaagcattggatagaacagatgacgggagcattttggatttgttttgttgaagaaatagggggaaggaaaagagaatcaaagtattagtggtatggaaggtacaaacaagagctgagatcaggaaaggatagacgagatttaaggagggacttagagctatactaggcatgcacttttcagcagtgtgatgaaatttcttttctaaggaatacaaaacaatttggatgtctaggatcaatttaatgaattttaactgtagggccactaatgttgtgaaagtgcatcctatgagcctggatggtggtgctagtggtgagttggagggctctgaagacacggaggccctcctgctgggtaccacaacatcttggagaaactgcagatatgaacacctacagtctgtttggcccagatgaacttcacctgaaaacaatattgtagcctcgtcagtttccaacagctaattatctgcaggagaggcaaagaggaaagattattaattaaaataaatggtccaaaggtgttattggttaaaaatctgctttagcatatcaatctaaaacaccaaattgcttttcttgctggcatgagtgctccctagattttttatgttttctacataaaagttggagtcaatttctattttttacttacttttttctcttcattcctaagccttttcctagattataaattatttttttcaaaaacatattaagccacaatagttcagtattttgtgtatgctttatattaccatgaaaattgcacagagaaatgtgtatcatgatgattttatgaaagtgaattaatgaaaacatcatggtgattcttcagagataaccgctaaacaaatggggtgaaaataattgtgccatgtgagcttttaacagtgttaacgttgcttttagcctagtgttggagtttcatttatgtgattagatttaaaatgtggactatgctgaacttctggctctagaatgcatttttgattcatgggaggaattgccttagtctctaacaatgtattgaattctgtagaatcctatttctacattttgtcctaatgcagttggagagctgcccagtggtaaatattactttctttcaaatgtaatggacagaatttagaaatatgggacaatggattttactgtggttgcacactgggtataaatgtgctctttataaatctgtgctaggtgtttctctcagtcacccagctgagcagcagcataatcatcatgtcatgttcgatggattttaaattttttcttctcttagggacagcgtgaatcttttttacacaaagatttgagcaagaaatgtgattctttaaagaaatatatagaaccgctctactggaaacactcaactttttcttaactgttctttttgacagtctgcttcacattattcatattcctataattgttttatcccgttttcttttttgttatagagggcaatttggatagtatatgtatgtcatgtatacacgaatctattaaatatattttctgtattttggttttccattagttttatgtacattgtagttggtgtttatctttgtaaaaagaattctggtcttgaaaataagtgtctaaaacacttaggtttattaaaatgcattcttcattcatattctttatctgcattaggttagtcctagacaccatgtaacagatctgctttagagttgaaatatgtcactaacttttggtaaactctggatttcgtatcaagatgatcgtccagttatgtagtcagacactttgttatgtaagggttgttctgcctttcatcttgggcaaaaactagaaggctgtttagtacctagtaaagtctttgtcatctaaaaataacatactctctcttaagacttttcttctgtcttttcccttaaatttggaaggctaagcacttatttttaagtttttcattttcctgtgactgtttgacttttcatcctggcagaaggtatctttctgatatgtccagtcattttttccaggaggcattttaaatggacctggctcctgggagtctgcaataaagagacagaataaatacctcccttttgattattgcttagaaaaaatttcacactattcttgctgttgacatgatacattttcactaggcttacaagattatgtgtttaagaaatatttcatttatcttttatttatatgtgcttctctatgtgcgtgtgtgtgcgcatgtgtttgtgtatatgtgtgtgtgtatcatacttcaaattatatttttgcagtattttcttgcaagttactttcatagtaactttttaaattttcagaggggatattgatgaactagtattagacttttagtgtttttacatgtagtaagtttgtctgaatattttactttcttttctcctaagcattttatttttacttttacctaaaaatgatgtatttatgcccaaatctctgtgtctaaacttgcaactgcaattttattattgtgattatagattacccttcaacatggaaattttttgacctgcattttgttttcttgccatttgtgttctctttgcactttagtacttcattaaacttccataattttctttttgaaccattaacaaattttgtgatttgaaaagtttgaaaaccatgactcttatgaaagagtcaccagacaacactgtaggtgaaatagcttaataacttcaaagatttttctatgctttttagtaataaatttttgtttttcaatattccaaacttgctctataagaaattctatatattgtacaatagagagacaccagagtttcacagtagtgtctatattttgttcacaagttttacaaatacaaaatttttaaatggtatgctagcaatggctgactatacatagtccttcattttcatcccaatctttggacaatctgatctagaaattcctgtgcttttaaaagataaaactaagacatagtctactaatgtaaaggtaactaattttttttgtattgacacacttaaaatgtgttttaagaagcctttctaatgcttttgtttatattatccactctccttaaaatgttcattttgttaaaattgtgtttaaatttagtatgaaaaattattttgtttttaaattgaaattaagatggtctctaaattaattaattcatgatattttaagaaatcttcctataagaaatatttgtttagttgtcttcagaaataaaaaatgtggcggtttaaaaaatacttgaaaatagtgtttaaagtttattgctttatttctactttttaaaaaatgtttgaagatattacttatatacacaaaagttacttggatagctaactgaactaaaactaactaaaagtgacatttttagtgaatgtttgtggtttttaactatatgtctatgctatacagtttgattaaggatgtcgtcttctaaatctttttaaacatcattctatccttgcataataataattttttagtgatacagttcattggtatttcttagttgtgttcatcatcatataaagctagtgaattgagcatattttcaacaagtcatatggccattagcacgctccctaacagcttactttatgcttttagcaatttgaaagacatgttatgattttcttcacttttgtgaagtattatatggggaaaaaagccaggaatagaagagatctaaaatatctccattatccaggaaggataactgtaactttggcaaagttacagatgttgatgtacagatttgacacctttcctttgtatttctttttataatacaaaatcattgatggtatatgtaagttacaactaaagaaatgtgattttcaggtatttgcaagcatttttatgcatgcattgtgtaaaatcacattgcatatcagtgtaaggatttgtgcccttttgaaaagtgaaggaagaatttacttgtgttactatcatgaggactttattattttctttaatttacagaacacttatgttctggtgcatgttttggagtgtataaaagtttgtgtttcccattttagcatgtgcttttgtaacttttacatattaaatttcctcaagttctactaaattgaagtatttagaagtggggataataaacaataagcatgtataaagattctagaaaattcaaaacaaaacagctttgtaatgttcttgggaaaggtgctgtaatagttgcatgcttgggatttgggttttgttgagttcaaatgtgaagtttattttccattaagtatttatcaatttacacattttacttgcaggagaaattttacaattccatgtgataagaactttccctggtcgaggaaatgttactgttaactggaaaattattgggcaaaatctagaactcaattttgctaactttagcggacaacttttctttcctgaggtaatactgcaaagaaaagtcgatcacaaatatctagaaagaatggtgtattttgaggaaaatgggatagaaaagcagcactattgtagttattatctttctctcttctccagacctacttcgtatgaattctttgatgatgtatttaattgtttttatcttccttctcattgcctcaatattaagccaagccaatattaccctctgccttgagtagtacattggacttttaatgactagtgtccctgcagcacttgtcttcttttctctgctccagttttttctactcaccattgttgtagaaacctctccaactttgtgctttgagatttccaatagtgttacattgctcaataaataagatttatgttcattagctcagcattcaagatcttccacaattagcccctgtctgcttggagcttaggttcccatgtgtcagtggtttttatttatttatttttaagccacagaacttttgtttaaatgaaaatatatttgcctgcacaatttataaggtgaataaaaataaagcaggagatagttcatattcaataacgacagcgggattgatttctttctgtatgacataggggtcgttgaatacaacattgtttgtgcatttgttggatgacaacattcctgaggagaaagaagtataccaagtcattctgtatgatgtcaggacacaaggtaattcagaatttaattttaattttttttggtatattcttttcgtaaaagaaagaaaattgttatctctgtatttaacaattagatgcataccaatttttaaaatgttactttattatgtgtcccctagaaatgttagatcaaaaaaaattagcaccatatgggaatacttatctttatagactaggaaagaagccctgaaacgttttgctaaatggttacttacagaataaaattcatttccgaaggtagaatttttttgaaattaatttgagacttacaagccaatttgaattttggaccaattatatggataaatcaaatttagtctttttttttttgcgacagggtctcactctgtcaccaggctggagtgcagtggcgcgatctcggttcactgcagccgccgcctcccgggttcaagcgattctcctgcctcagtcttccgagtagctgggactacaggcatgcactaccatgcccagctaatttttgtattttagtagagatggggtttcaccatgttggccaggatgatctcaatctcttgatcttgtgatccgcctgtctcgccctcccaaagtgctgggattacaggcgtgagccaccacacccggcccaaattgagtcatttttaagcaaattatctgggtactttcctcagtttctattcaatttctataattctgataaccagtataaccaataatgacagtaatatgtgaagtaaagaaattcatgatcttccacctgaaagaaaaatggaatgtggcttttgttaacctgaagatttgttagagaagtaaatagaacacttttgattaccttaatgtttcagagagtgaggctatgtttccagcgattaaaagctaatgccaaatcactgttagattcctgcctgacatttttaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggtttgtgttactctagaatgaatggggtttccaggcaagtgcttattaatattctacttgtgtggatgaaagccattgctaaaataaatcggggacaggagaaaattaatatttcttcattcaggacagaactttataacttctttatctttgaaaagattaaaggaattatctgttttcacagaaatgctgtgtaattaacaaacataacatttcagcagcatacagtaatttaggctgtctgtgggtctactaatctacactgggcttggccatgggtggctctattccatatgtctgtcattcttctccgggaacaaatggtagcacaaaagaccaagtgaaaatgtgtaaggccccctgaggtctagggttagaaccagcacatcatcatttttaccttgttctattggccaaaacaagtcacatatccaaattcaaagtctagaggcagggaaatatgcttttcccacagtgagacacccatgagccatcacatggtaaagattatggatataggaaggggtgaggaattgggaccaataatactagctactaaaggtgcttttaggaaaggcaaaaaattcacaaggggatattattgtaaacatttagataattataaaacatttttgcaacctattcaattaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggtaaaactcttttttttttttaatcttagggggagatagtttaataagttttttttattatactttaagttttagtgtacaagtgcacaatgtgcaggtttgttacatatatatacatgtgccatgttggtgtgctgcacccattaactcgataactcatatatttttccttattattgtattaaacctgaagtaactacatagaaggtagaaattgatggaagagtctatctataacataagtggtaacatttagtaagacacttctagtaactttgcattttaagacatcaagtttcatgaaaactaagtttacctgagtttttttctattagtaaaaaaaaaaaaaaattactctgactttaatatcaggtttggacactctacaattataataccagaaacctggtgaattctcttctgcttgttccccctgctggtacctttaaatcatcttatttcttttcttgattttgttgttgttgttgttgttttaatcatacaggggtttctgttcttgtttagatagacaggcctgctgttatgtattttattacagacatgtccgtgataaagaattttcttagggcagtcacctttgagatgccatagacctaagaggtttcaaggagtattttgattacttcaaaggattctttggaccagaaaatccgtgtatgtcagaatctttgttggtagtaggaccacttaaattagagatagggagaaactcaccagaggcagatggcacaaaatgcgattatggttacattaagcttagcataatcattaatgattgaaattgcattttaaataatttttcatattgtggaatctcatgttgttttggggacttagtgtatcagttacctaaatacagttccaagaggtttataaaaatggtactcacggagggagtaggagatagtgtgtaggataggggaagggaaagagggagaaagcatgaatattgcagttgagaaaatatttttcaattactatgtattttgggagttctattttaaaatgtattttattatcttggaggcttgtgcttttacagaattataagtggtgtaaaccatctaccaactgaagtcagtaacttattttgttgattactgtggcactgtgacctaatataacagtataaaaattccaaagctgtaaaattaaaggtaatattatgtcagtatatgggatataacacaagatttgataaagctttcaagtaagttatctttcaaatgtatactctattaataacaatataaataaatggattgattattccttagatatgttagtttttaaagcagagaatacacagtcacccttcttttctctgaggagtctagatttttttgaacattgggtttttgtttccacctttatttgatcctagatctttgcaaccttttctgctccctgattagcactaagattaagagactgcaggcctatgcatataggagcaagctgccctggggagtggtagggaggaagtattgcgtggggggtgggggacattaagagtaggcacagcagtccttctatatcactgaccttgtaactcatgttggtccatatattacataagacaatctagagaccatgattttcacttatattttcacatggaaacatgactccattaaataaagtgaggagaaaagcatatgttggtgagtgtgtactgacattatatatgcataaatatacatacacattgtgtttctttgtaaatattgatggctggctgatcactcttgacatggattttgctaatccttatgtttttggtatctgccttgttttcattgctattatgtggactggtgattaataataatagctattaattttaaagcattttctctaggccaccctacacatatgatttgtgatcattattacaatctcccacccaaaaggagctattattgccccgttatagagatagtagaattgggagttctaaaatttaagtaacttacttaaaattatagaatttggtactaggcctccttgaactgcagagcctttttttttttccatggtgttctattcctccttctacacattagatattaaggtaatttcaaatgttttgttcatattatgcttaaaataattaggcttatatatttatataattggtttacatattatataaatctatatttaaaatgttaaaatatttaagtggtttcatgtgggtcaacctaattacttcctatacaaccaagtataagtttaatacgtttatgtttattttttctaatttacatctgtctactttatggttgcatttttgtatcttctgtatactaattatacagtttaatttaaaaacagtttctgagggttaattactttgagagtataactaaaggaatttaatgagtgtaattttttcaggatgatgtaccagagctagaagaatatttcctggtgaatttaacttacgttggacttaccatggctgcttcaacttcatttcctcccagactaggtatgaggggtttcttgtttgtttctttttgctcacttcaaatgaaatgaagaaacttcatttttgaatcagaagtgatcattgtgctgttttgttaatcttagctatgtgttaaaatatgatgggcttttatatttatttttgatactctcatatattgcaatttttacaatgaacaatgtaaagacattaaaaattattgtgtgatgctctttaaattttacaactattttataaacaaatttgtaatcctcaaaatagctctttggaaggtattttcctttcattttcttttaaaattagctgttttcagtagatctccaaactctcagatgtttttattttcttttaggttaagcagtgctgatatttgcttctttgttgctttattgtgttctctgcttctttcatgaccttttatctttttcttttcatgcttttagaaaagactcagttaattcattacagactgaaaggtaaaacctgagccttggtacaaacttatctagattcctttgaaaagatgtattcctatgtttaaacacaaactcctctttcagtgtggacatttactactgggaaattttgtctgaagcctgtaggtgtgatggcccactagagggtggtgctgagttggttagaaggagtgctggacaggggaaagttaatttggattaaaggaagagaagcatggccaggagcagtggcctgggaaacaggcattcctcattcatttctgaagctcactgtgataactttgaaaatattgaaaggaaataatcagtttctaacctattgtttgaataaattcagttcttttgctaaagaaatagatgattccaatgagtaggctgtttacatcaagtattattacaagataattattattcacactaagacaactaacaaaacaattcatatttctttcatcctcttactgagataatttgaatagttaacttctgttgagtggtttctaatgctcctatttcaagtgctttgtagattagtaatatcattacttacattcttctcattttacagatgaggtagcttaggctaagagaagctgcgtaatatgccccaaatcacacagctggagactggtagagctgacttcaatggtgtggtctgattttagaatctctgctttttagcctcttgtctgatggatgcaaaccctgattttatatgctttcctggacagtgttgttcttttcactctacagagaattacactctccctaccctttccccatccaggcagctaccataagtgtcctagactaaggtagcacctctgaaatttaaaaggtaaagaacaaagtattaaaaacaaaaatcaaaaccaaaccaaaacactaatcaggagcaggattagttaatattttaagactagcccaggagcagggttagtaatattttaagactgaaaccaaaaagccaaccaggagcagagttagttaatattttaaggtattggtaacatactaagtttggtggatagaataaaaataaaaagggaagataagtttactttgatattaatctctcttgacttcaccaaactttttccccatctttcccatgtgtctctacttctgtttgtgtccatgtctctctgtgtctcttttgcacacctctgttttctctgtacctttccttgcacttctttcatttatttttcatttttttttgctctttctactccttccaactgtccccattttcctttcctcctgaaatagtgatattatagaatagagatgccaaatatgttttaactaattaaaataatagaaacaaaatagtaatctcagttgtttattattttatactgttctcagttgattaaatttctataaatcagtggctcttgttagccaaaagtgtccttattcagacgtgataagcattgtctctttattttcttaaacatcttttgagtaatgttgataatacctgtacattatgaattatataatttcaaagggactgtctttaaatcctatatcaaaaatatttttaatcatttatatgtattttaagatatgcttctatgttttttaagattcagaaggtttgactgcacaagttattattgatgccaatgatggggcccgaggtgtaattgaatggcaacaaagcaggtaaggccaaggctgcatgagagccctcttctgggtttcatattatttactatctaccaaataaaagtttctaagggaaaaattaattttttttgtttgtttttgtttttttgctatattataggtttgaagtaaatgaaacccatggaagtttaacattggtagcccagaggagcagagaacctcttggccatgtttccttatttgtgtatgctcagaatttggaagcacaagtggggctggattatatcttcaccccaatggtgggtctcaaaatctatcacagatgacttttacaaattattttataatcattattccttgagaattacagtgatttaggtcccatataaataaattattcttaaaaaccattgtatttttcacagtaaattaggacagaagatttcctcatggtaaaatagttcccttaactattttagtaaatataaattgaattttcattactattctaaatgttattctgtatgcattaactatttcattacagtatttgatactagagaatacaagctgtaatattaaagaatttatatcattagataatcttcccagaatgtttcttacacttcacgaaaattttaactctttcatttctttgtttttgctcactgaaacacgtttagtgttttaaaatacttttacttggtctcttcatgccttttatttcttagccaaatgtttactttcttctcttcccctataatttttttggagacaaagtctcgctctctcactcaggttggagtgcagtggtgcgatctcggctcactgcaacctccacctcccaggttcaagcaattctcctgcctcagcctcctgagtagctgggattacaggtggccaccaccatgctaattttttttgtatttttactgtattttatatttttagtgtattttaccatgttggccaggctggtctctcaatctcctggcctcaagtgatcagcccgcctcggcctcacatagtgctgggattacaggcgtgagccaatgcacccagccccctcttaatttttactttttaaacttaatgttgccaatttaaataaaaagatataaaccaaaatataaggagacaaaattcaatgtaaaatagcttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggttggaacagtttgatattgttgctaagagtcatcctactccattgcttgataggtattgtgctgactgtttagagaaggtaagaaagagacaaaggagaaaactcgggaacatacagaacttgagggttggaagggctcttaaaaagtcacttccgttcattctgatgatagacaagccaaatgaatttcaaggattgaatgctgactgacccttcaaactcctgttttagtcagtggctgagctggttttttttaaaaaaaattttagtttgatgaatatttgcattcctgaattattggcctttatggagaaatttgatttgtagtagaaaatataaaagaattctgagtaacccaaggattggtttttacttttcttgctattttgataaaatacattgatatttctaagtccccagaagcctttttttttttttttgaggctgtggctgttgtttcaagttcaaagagtatatgtttgagatcaaatcattttcttgtagaacatagtggggtggtaaagcgttgtatgaatgaataccatgtgttggttgagaatagtctatgtacaaataacagaaaacccaatgcaaatggatttaaacacatataatttattggtttatttaacctgaggatacagcgacatacacctttagatgaggcaggagcaggacttaatgctgccagagatcctgaggttttctgtctcttttctttgccttttggaatattggcttcattgcaaggctaatgttattcattgtcataagatggtgatcaggaccattcttctgcatttcatataacaggaaagagagagtattcaaattcatgcattcctataaggtccttataaaaatctgattgaaattacataggtgacatgcccacctccatgagtaggagaaaggaatatagtattgggctctctcaagcttactttatatttgtaattttctatttttaaagattaagaaattcctcagagcaaaaagtgctttgacagtgagtcgtttcttaaaccatgccccattgattgaccttgagactatttccaaacccttataaagtttcaataaatatccttttacataaatctctatatatgtggataattaagattatctgttgagtacagtgcatgttgagtgaaaggactcatccgttgccttctttgttagttacatttcaatgtgtacatatacgatagtttctccatatccttaccagcaatttctttagtctttaaatttttatatgccatttctaatgactgaaaaatgtgtggttgtattatacattattgtgcattttttctttcattttcctgattgttagtgagcttgacactggtttgttttttttttactttgtgatcctgtttttcgtatcccttatgtactttcctgtggtttttgctttactggtttgtaggaatagttatatattttgaattcaacactttgcctcttaaatatattgcagatatttctcccagactgtcatttatcttttattataatgtctcttattataaaaatttttttaaatttaaaatatcaaatattttctggtatgcttttaaatcctactttcttaggtcttttcacccaaatgctataaaatattttactatattttctactattttcattgttttgatttatatttacattattgcacatatcaggaatttattcattggtagtgtgtgaggcaaggatacaacttcatttttcttctaaaatgcagaaaataataccctcatatcgtacagagaatgaaacatccattagccattaattttcaacatgaaatatctacccttctttttttccttttttctatccatctacctatcattttcctggactctgttttgttctatttgcctatttatgtgctaatagcatactgctttatttatcatagccttgaagtacattttgctagtttttcaggccaaatatttttctttttctttctctaaattatctcacctattccttaaaaaagtctctttcatatgaacattagattcaaactgagatctataaaacaaacaaactattttgattggggttgaattaaaattatggattaatttggatggatttgacatcactgtaatattgagttttccaatttagaaatataaaatgcctctccagtaatttagatcttttataccattgccttcccttgtgttctctcaaaaccaaactgtaagacaaggatttggacaaggatttagtttatttgagaggtgatctctggaggcctgatgagaaatgaggaggtgagagagaggaaagctgatagatgatgtcctaatgagcagtactgctgtgggcaactgacactcagtcctgctggtgttcctcttagacactgggttgaatgaagcttaggactgtcccatgacaaggaaagaaatctgggctgttcatttaccagctcctatttctgatcatttgagagttgctcttgggtgttaaatttgcaacagttctgtccttactcctgcatgggctgatgctgtcttcaggtagagagagaccactaggcaaataggaactgctgcaggtgactttagagtgggtgaaagggaggtgctgacagtgtctgccacagttatacattaaaattttgtgattttcttcatataggttttatagtttttacattaggctaatttctaagtattgttgctattgtgaataaggtctacttttcttttttttttttaaatagctgatctttagagatattataatagtctttaagaatgtatgatctgaagcagactttctgactttgtgcaccaggtctgccacttcccagcttgtaaacttcttcaaattacctgaatgtccttcaatcataggttctgtaaaatgagaataataatataatcaatatcatagggttattgtgagaattaaaagagttaatataggttaagcaattagtaagttcttaatagtattagttgtaattattattaatataagtgacagtaaaaaatagaacactcttgatttgtgaaggttactcagcttgctttgtgttcttactgtagttctaatattttctcttacattttcttagtagacaatcatgtcatctagaaaatagtgacagttctgactctttccactacttttacaggtgttatctggctgatagccctgggacactgttaaatagtaacaattatgacagacattattattttgtttctgtttttagtgggaatgctgctaatgtttcaatatttgatatttgttgttgacttctgagagatactgcttcatcaggttaaggaagctgccttttatcccaagattactgagtatttttctatcatgattgaatatgttattttattaaatgctttaaaaaattctgtcatttttaagatcatcttaagacaatcaccttaggtaaagagttggcctagttttcaattagacatccacacttttttcagcatttataacctcttctattttcatttgttgctttaatatttttattttggcagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggtacagtaagaagctttaatgagaatggaagtttatctttaatatttacaaaataaatttctcttagatgagcactcaagtcctagaatgaaaaaacaatacttccagcttaggtgttagacaaagacatgattcatttactatgtgacaagtgctgtagttctatttactctgtataaagcgcaactggaaaaatttactattaatagggtaaaagaatatgcaaataataaagaaaatatatgtatggctattttaaattttcagcacatttaaattgcatatgtcactttatattgtgtataaaccatataaaagaaaacccaagccaacttttgtaaacattaagtcccagccaatcatttccctttcaccacatttttgttgaacaaaatgtaactgcttacttcagactgcttgtttgacaacaagaatagtttattggagaaaaaaatgctggatttgggataaatatgatctatactcacagtttaccttcccaaacctctttttctatatattaacaattttctgttcctgctactaaactttattttttaaaacagtttaagtttaaaatgcagcacaccaacatggcacatgtacacatatgtaacaaacctgcatgttgtgcacatgtaccctagaacttaaagtataataaaaaaaaaagcaatttgcaagattatgttgcaaatgtgatttttttttttttttttttttgaggcagagtctcactctgtcatccaggctggagttcagtggcgcaatctaggtttactgcaaactccacctcccaggttcaagtgattctggagtgcagtgacgcgatctcagctcactgcaagctctgccttccgggttcatgccattctcctgcctcggcctcctgagtggctacaggcgcccaccactacaggcgcccaccatcatgtctggctaattttttgtatttttagtagagacggggtttcaccgtgttagccaggatggtctcgatctcctgacctcgtgatccgcccgcctcagcctcccaaagtgctgggattacaggcatgagccaccacgcccagctattcccagctaattttttgtatttttagtaaaaatggggtttcaccatattggccagtctggtcccaaactcctggtgccaagtgatctgcccgcctcaacctcccaaagtgttgggattaaaggcatgaaccactgtgccgggcctgtgattattttgactcattttttattgtggaaaaatacgtgtaatataagatttaccattttcaccatttttagtgaacgtttcagtggcattaattatattcacagcaatgtacaaccatcaccaccatctatttccaaaatttttcatcattccaaggacaaactctgtgcccattaagtagtaactccctattactcctctccctagtaatctccagtctactttctgtctctatgaatttgcctattctagatatttcgcatatgtgaaattatacagtatttacccttttgtgtctgacttccttcgcttagcaaaatgttttcaaggtgcatctgtgttgttacaggtatcagaacttcattcccttttcacagctagattatattttattgtatgtatataccgtaatttttaaatccagctatctgttgtttccaccttttgactcttgtcaataaagctcctattattgtgaaaataaaataaaataaaatagctgattatgttagctttaggcatttttcaagcctgctgtagaaaatataataaatctaaaataatagatttaaagctattttgtctaaaacagtccatctaataattatttttttaaatgatcattttatgtaacttcagcacatttgcaaatgcatattcattgtcatggttttttttcacattttggaaatttaaaaccttaattggtttgtgcaagatcacttacatttaaatcttgaaatatatatataaaaattcaaatttgaaatattttattaattttctattgctttattcatgttttttcatctttaaaatttttctcaaatttgttgtttttttttactgtgacttttttcataaaagactcctttttcacagtatagctatatacttttctttttattaggcaaattaaatgttagagcaaattggattaaataaattttttaaccgacataactgtttttattccaaaaagtttttattttgaggtataagtagtaaaatacacaaatcttaagtatatggcttagtgactgtaaagatatatatatacatacatgtaactaccactcagattaaaatatttaacattaaagctgggcgtagtggcacacgcctgtaatcttccgggggctaggcgggcggatcacttgaggtcaggagttcgagaccagcctggccaacatagtgaaaccctatctctaccaaaaatacaaaaactagctgggtgtagtggtgtgtacctgaatggtactcaggaggctgaggcaggagaataacttgaacttgggaggtggaggttgcagtgaacagagtgccactgcatttcagcctgggtgacagcacaagactctgtctcataaataaataaataaataaataaataaataaataaataaataaatgtatttaacattatcatcacccggaagattccccctgtctcttcccctttccagaggaaactactttctgatttctatcattgaagactcattttgctggttcttgagcttcatataaatagaatcatacagtgtgtactcttttgtgtctggcttctttcactcaatataatgtttaggtctgtatggttgcatgcatcagtagttggacattttttttaatcactgagtagcattttataaaatagaccactattggtttgtctgttctcccactgatgaacgttcggatgtttctaatttgtgcctgctatgactacaaatgtttttttaacagtgaaccctagattagaatgagattaatcaagttatgtagccagagcaggacaaaaagttcacaaaaatgaagacatagatgtaatttttaatcaatgttattttaaaatgcactaaatattttttggacactttagtgcagtatatcacaaagttgaaaatcctaaaagtagtaacctgaaacagatgtaaccatcacattataggaatcagtattaaatcaaagtgagatgatatttttcaaaacatgctattttgttgtcagaaatgttcagtagatttcgctatatatgtgttacaaaaatactgtattctagtaaccttatcttttgattttgttttcaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaataggtatagtttattcataaggaaattatcacttctgaagctataagtagggaatattttttgacataagaaaatgcagaaggaaattgatatctgattattttaaaagggatttttaaaatgaactctagaaaagataggtctagagagaccagttactctcctaactgggagtatcaaaaacctaaactcaccctgttattagaatggtgttattagaattcttattttctcagagttcacactttcaggtaaaggtctgtactattttgtgttttaaaaataataaaaagcaagaaataatagaaagcagacttaactgctcaaaccaagtgaatgactcttcaaatatatattaacatgattgtggttttaaaatttcttctagaggctgacaaatatttattttttatatcataaaaatattttaatagatctagtttcattaatatgttaatttcctgactcatttttttcctataaagtgtttttgatacatgtgtgaagaaacataagaatgacaattttatttctttttcagaatatagagtgcaaagttactgaagtaactgatttttagtattttcttatcatctcatcttggattgtgtaaatttaaaaatgtattaagtatatgctagcaatatgatatatatttcaaatatgtagaatgtatactttttctgcttccctcaatccatgtatttctttcagagccacctccatagacatcgaagaagccaataggaccgtgtatttaaatgtatctcgaactaatggcattgatttggctgtgagtgtgcagtgggagacagtatctgaaacagcctttggcatgagtatgtttcatttcttatgagaacaaaattctgtaacgaaaaaatattgcatgtataagatttatattttttcctttgaattgtatgttattgatcatttgaaaatggaaaacagataatctaattcttttattgcatctataaatatgtgttgaggctgggcgctcatgtgttgaggctcatgcctgtaatcccagcactttggaaggccgaggcgggtggatcacaaggtcaggagatcgagaccatcctggctaacatggtgaaaccccatctttactaaaaatacaaaaaattagccgggcgtagtggcaggcgcctgtggtcccagctactcgggaggctaagacaggagaatggcgtgaacctgggaggcggagcttgcagtgagccgagatcgtgccactgcactccagcctggtcaacagagcaagacttggtctaaaaaataaaataaaataaaataaaaataaaaataaaataaaataaaataaaataaaataaaataaaataaaataaaataaaataaaatatgtatttagtgcctatgccaggcatggcactgaactcgtggatcttagaatttaggggatgggggtgacagaaatgaatcaagtaagtaaaaatcaatgtatactttaaactttagtaagtgcttttgtcaaaggagaagttctaagtgttgaaagaatataggggaatgctttcaaggggtattgatctttgagctaagactgaatgatgagtagagattgattatgcaaaggactgggttggaagaacatggaggtgagagtgagaagctgtgaaggcagaaaactgaggcataaaaagcacacataagtgaagaacttgagtggatagtaggtacagaaataaggaggaatgttgagcttggatagctggacaagaccatatcattcaagaacttaaggaatattttatagttgccagtctttataatagtgttaatggaaagccttcgagtggtttaggaatggaggagagttaccatatgtaatgtggtatggtataatcatatatggattttgaagatattattcacagtgccatgtaaataatgggttgatacagaagagaagtgaagatacagggaggcaagatggtggtagcttagactaggtgttgagtatgaaggtgagggacagggaagtaccaaagatgactcaggcttctagcttgtgcagttggatgggagaaggggttcatgctattcattaagatggaattccaaaaaagaatagatgtattttagtaaggggagtaaaataaatgtggtttaacacattttgaatttgagttacttttgagaataaatttctctagactcaaaagaaggtctctgctgggccgggcgcggtggttcatgcctgtaatcccagcagtttgggaggccgaggtgggcggatcacctggggtcgggagtttcagaccagcctgacccacacggagaaaccccatctctactaaaaatacaaaaaaaattagccgggcttggtggcgcacgcctataatcccagctacttgggaaggctgaggcaggagaatcgcttgaacctgggaggtggaggatgccgtgagccgagatcgcaccattgcactccagcctgggcaacaagagcaaaaactccgtctcaaaaaaaaaaaaaaaaaaaaaaaaaaaaaaaaaaaaaaaaggtctctgctggagagataaaccttggaactttagctatatatattgtatttgaagtcatggaaattgatgtaataatctgaaaagaaaggctgaagatggagaagggaagaggacactatagactgaactataagaaggttcaacttgaatggctgaggatatgggatgatggcctagcaaaggagacttaggggacctggtaggaaactcaggagaaaacaggatggcagataccagcagaagagtgctttaaaatggaggaaaaagtaaacggtgtcaacccctggtgagaagtccagtaaaatgagaacctggaaaataattattataattagcaacatagaaggcattaatgaccatagaaagggctatttgtatagaaagatggggaattaataccattttgaatagaggtgaaagaagagagacctcaaatatatgcaaccatttcaagaagtttggcagggaagataggacctggagaaggtagtagtggtgtggtgtcggaggttttttgcatgtttagtttggagagacccaagcatgtgtaggttggatggaaaaggtagagaaatgttaaatatttagaagaaaaaggagataattaatagtggtatggttgtctagaagacaagctgagatgggatccaaaaaagaaagtctggtttctaatttagatttctgcattacgcttggactttgcatgtgttttttggaagtactcatgagagcacatgtcggagattcttaattgttagcagtcattgcttattcttcatttgtggtcgtcttgaattattgtagagaaggatttgtccatatgtcaggaccatttgggactctaaatgaaaaatctgcagtatacctttaaaagggagcaacataaaaatttaaaatgctggatttttaggaaaggaaattgctattggatattacatgtaaggcattgacaaattctcttgaattagtaatctaaaaatgatcaatcatttatagggagcccaggtttcaaccttgatagttgttcttactgcatcatgttcacaccattaaccaaaatttaaaaagaacttaatgttttggagggaagcagccatgttaagagactatacattttttaaaaaatgtttactcctcattagttaggggatttttatttttgccctttttttttctttttttttgtagtacagaattttaaaacatgtaccagttgtagcagtttgataaaaccttgacagccatttgaaatatgtgagtctgcttggcattcttaaaatgtataaaatgtaagtgaaaaattagataggcataatttcaaatttaatagcgtaaattttttaaaccaaatatcatatttctataaaaagtatttattattataaaatttctcagttatattttcatcagctttacagaagttgataaaaatcatgttctgcatatttccctttaaaatatacatttagtatttatttagttagtttttgagccagggtctggccatgtcacccaagctggagtgcagtggcactatctcggctcactacaacctccgcctcccgggttcaagcaattctcgtgcctcagccatccgagtagctggtattacaggcgcacaccatcatgcccagctgatttttgtatttttagtagagaacggtttcaccatgttggccaggctggtctcaaactcttgacctcaagtgatccacctacctcggcctcccaaaattctgggattacaggcgtgagccaccatgcccagccacatttagtatttatttctaaatacaccttggaaaagtatgtgtaggtataaagcagagctttaacaaattttcttggtttttaaataataatttaaaaatattcttatttgtagtacaaattcattatttgtagttattttaaagttttcccacttgtgtcttttcacactcatacacacgtcatgaaagaattttcatttgtagtcacaaatgcacttgtctcattgtttaaacaataaattagaatagataagtttttgaaggagtaataaactagtaaaccatgatttgtgtttttcagggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggtaaacatcagtatttttttatagtacaaaaataaaatgtgcagataaattttagatgtataatgaataactgtattcttattcctcattttctaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtaaaaacattttcatttttaaatagattactttctttaaaagaaattaagatttgtaagattgttcaaattggaagataatgtatgttttatgttaatgtgaaaaaggactttttgtgagttgatatacattttagcaaagtatcttaatccggggatatttttgtctttttaaaatgacacttagttatgtgtagcttggtattaaaattttttaagtcttgcacttcagattttaactcatgctattagtgtgttcagtggctttcttagttcaactctcctttaagttttcattcccactctgtccttgcaggtacaaacaatcattattctggaaagttctcaagtaagatattttacttcagacagccaagattatttaatcattgcaagtcaaagagatgattccgaattaactcaggtttgattcttttaaaatgaagtgggtttttttttgcttttctttttaacattataattgaaatttaccaaaggtatggtctgctggtttagtataaaagaaaaccaaaatttgattgtggtaaagtagaatgtaaagactggttagttaaaagttaatttttaaataccagagtcataaaatgttatattatcttcaagagccaaggataatgtaacaataaaaatgaacatttaattagaatttaactgaattgcaaaacattgtggagaaacatcacacagccagacagagtatcactaaaaattcatgattagcattgccacacaggcattcagtatcacctcagaaatcccacatttctttagtaaactagatcttgtaattctagtaatgcttatttgataacttttgtcactccttaaacttccatacatgcttcacaattccattttcagctaattcccttgttgaagtgaaagctaccaaaaggggtattattcattttcccaacaccaaattcaaaaacccacttgaaacccaatcttagtcctcattcctgctacgacagagaaagtgtcccttctaaaaagccaggcctctcacataagtgcccaccttgtccttataaggtttagctattccctccatctctgacatctctctctctatttggttactacaatcagcctaaatgttctagcttcacccagcttaaaaagaaattcctcccttgatctcattcccttctagttttcatttcatttcctttctcccttctatagtaagacatcctgaaagaattttctacttgttttgtctttacttccccgtgctcaccaatgacaactgcattaccagatccagtgggtgtttttctgtgtaatcattatacattccaccagcatgtgacagtcacctcatcctcaaatataaatcttaccttgctttctaacacactacacaaattttccttttccctttctctctctgggtatgtgtgtgtgtgtgtgtgtgtgtgtgtgtgatccttctcagtccccattgccagttcctcttccctttcgtaaacttagatgtcttggagttttccagaaagattcacttatagttcaaatttcttttttctttctcttcactcacttggatacttttatcaatcctgtggttttaaatatcagcaataggctagcgtattttaaattatatctgtagcctttcctctgtattccaggcctacatacctaactgcctattgacatgttcacttaaatatatttttggtacataatatttaacatatcccaaactgaacctttgatttccactatgaaacttgttacttcagtgctagctttcatctcaggaaatagcaaccccacgaactcagttgcttaggacagaatcctgggatatttcttccttgattactcctttttattagtgggggggatggggtctggctctgtggcccaggcttgagtgcagtgccatgatcacaggtcactatagccttgacctcctgggctctggtgatcctcctaccttagcctcccgggtggctgggtcaacaggcgtgtgtcaccacacctggctgattttttgtattttgtagagatgggatttcaccatgtttctcaggctggtcttgaacttactcctttttattctttcacatcgagtttatcattaagtatttttgattatatgtgtcaataagtgaagacattttgtctctactcctccctactccaggtccccattatttctcttccacaccattatagtgtcctcctagctgttctctgaatttccttgacctcctcagatccattctccattgagtaactggaggcattttttaaaaatattaattgactaatgttatttctgattttaaaaccactcaatgatttgcaattatacttagaataaatttgaaattatttaatatgggcttaacataggatagctatatttcctgatttgccttggaaagtactggattatgcctgttctggtattgttattaatattgcccctttcactctttaaaggatccctgtttaggtgattaattatatggtcatcctaatggaaggtactccatgatgatcttacctctccagccttaactctcatcattctcccagcactatcagattccttccagtctttattcagataatgacaaattttttctgtcttaagaactttgtcatgttgttccttctaacttgatttcccaaataccttcataattctctatcagaccatcctaattgtcatcttcagtacttgactcattttatacttatacattgacttaattattgatatgtttcttgtttaccttttcctaatagttaataagatccataaagggaaaggtcgctgtatccatagttcttagcataatgtctgtggctcaaaagttcctaattgttgactgaataagtataattttctgtgacattgaccagcttgccttcaggtagggtctgaattttaattttgcatttatgaacacttaccctgaaaacttgcatacgttgactgccaccatggggacagaaaggatttaggtgtttctctgtattctattgctcgagcaattgataataatattgcagcattagaatgtttcttattccgttctaaatttttcatatgtagtgtatttcctggttttagctttccctttccctgctgtcaacaacccttacccagatgtacatttgatactgatttcttttcaaatatcttctctttcattcactctgtgtgtgtgtatgtgtacttatgtgcatagacatatatgtgcacactcacacagattagataagggagagagcagcaagggagcatcagttttagtattttcttatttatgaaagtatctttttaactaaataaaaggatccaagagagtaaacatatggtattgattacattcttgcaagtgctaaattcctagtcataaagggttttgtatttcaacatttccttcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggtgagaagataaagtatttgtagtgtatatataattattgaaatcatctagcattcatatggtatattttatatgaaaatgctcttgcaataattttttactaatccatagaatatttcttgatagataagtattaattgtcagctgtaaatggatttttgagaaatatttaagcattatacccctaatcttgtgttctgactactacctgaaagttatatgaaaacaaaattggaagtaggtaggtaaagttgaaagatacatgaatattttatacgcaggatgcaaacaagtaactttttatatgtatttacttgatgtgccatgaataatttatagtattagtaaataatgttcagaactttttataagactctttcagaatattcttggaaggaaaatttgctttctgctgctgagtagaactttcatgggtaaaattgcaacattcctaaaaaaattaaaaaaaattgtccttgttctttctttaacattatatcatggttaatgactaataatgtattcccgtcatgcagtaaatgcaaaaagacttttgaagtacttcctattaacttgtatttttattggactaaatggattctgaggaaatttgtttcttgatatttttattatagttttattatgtaattttgtcatttttttctgtaacttttgcattaagatttgacttctatttcattattgcaggagatcagaattcaattgatattttcatctgggagatgggacagtcttccttcaggtattttcagtctgtagattttgctgctgttaacagaatccactccttcacaccagcctcaggaataggtaaggacttttcaactgctcaccaattctaaaggtagtatggaaagccagaatgattttaatctcattgatttagatttagtatcacattgccagacactgggtatttttttttttttggagatggggtctagctgtgttgcccaggctggagtgcagtggggcaatctctgctcactgcaagctccgcctcccaggttccgctattctcctgcctcagtctccccagtagctgggactacaggcgtccgccaccatgtctggctaatttttttgtatttttagtagagacggggtttcaccgtgttagccaggatggtcttgatctcctgaccttgtgatccgcccacccaaagtgctgggattataggcgtgagccaccacgcccagccgactctgggtattttaataggaatgtaacatcaagagctttacaatactccttccagaaatcctataattttttgaaattcttttgaatttcaattttccttttgcagattaatactttcagaatggacattggcttgagaataatcagaataactaaaatatggaggaaaatattagtgaagaatgaaaataatatatttcttttgtctagagaaacatgaagagtgacattaaatatatatttttaaaatatgaaagtatgtatatggcaatagcaagtatttgcatttatgaattttttttaagttggagaatgactatgagaattcttccatcttcatgaactctcccaacctcctccacagtctgaaatcctttcttggtcttctgtactttaatccacacatcagaaacataagcaatatttttaatcactgtggtttcagaaacaaagtcgattggagagaacccaaggtattattgctgtctgcaggttgtaggattattttagggttggcaaggaatcccttgggtgggccagtgatgataaggagatgaagctgaggccagtggcatggtgagcttatcaagctggctcatggggtgggtgttcatagcacagggaggagacacagacagtgggtcatcatgtctcctgttgaggtgtctagagaatttgtgagccaagcctgagtggctccacaggtgactctggatgaatcatagtcctgcttttaaattgagatatggcaattctgtatgaattaaatggcacacagttattaatttgatattatatgtaagtcaatgttaccatgctatgaagaattcctctacttaaaagccttaatgtatggttggagaagcaagaaaaaatattaagatactaattcaaggtacaggactatattagtccattctcacactgctttagaaaactatctgaaactgggtattttatgaagaaaaaaggtttaattgactcacagttccacagactgtatagaaagcatgctttgggaggcctcaggaagcttacagtcatggcagaagggtgaaggggaagcaagcaccttctttacatggtggagggaaaaagagagcgcgaagggggaagtgctgcacacttttaaacaactggatcttgggagaactcctctactatcacaagagcagcaagcgggaaatccgcctctatgatccaatcacctcccaccaggtccctcccccaacactgaaaattataatttgacatgagatttgggttgggacacagagccaaaccatttcaatgaccaataccatttgctctgtgaggggtagaattggagtgattaagagagacaagagaaagcttgagctatgtctgcgtggattggcaggacacactttgggcagagggaaaggtatgagcaaaggagaaaggcagaagtgtttatagcattgaggccaccattggtagatgaaagtgccagcgacagaggatttgaccagaatgttgtggtgctgagattggagatacaacactggaatctagagaagatggcctggaatggcaggcacatggtgcgcctgtgcctcaaatcatccagcagttttcacacattttgctcttagaatctattcatatttattgtgtaagagattaaaactgagaaatgttaaagtcatctattttaaaatgacagcaatatactcattatgtgtaaatacaacgttatttttaaaaaacactttctaaaacgaacacttttatgagaagagtggcattggttttattttaatttttgaaaatctctttaatgtctggtttaatacatggtatatagattctactttatgtatttaattaatttttttaagggacagcattttgctcatttgtcaggctataatgtagtgatgcaatcatagcttactgcagccttgaacacatgagttcaagccgtactcccacctcagcctcctgaatagctaggactacaggcatgctccatcatgcccacataattaaaaaaaagttttttttaaaagtggagtttctttgtgttgcccagcctggtcttgagctccaggcttcaggagatcctcctgcctcaaagtgctgggattacagtcatgagacactgtgcccaactgattctcctaattaattaacttttttccatctttattaaggcttgattgacaaacattgtttatatttaagatatacaatgtgatattttgatatacatataatgatatgtatttcctcaattgagctaattaacccatccattacctcacatatttacctttttttgatgaaaacacttaaaatctagtctcttagcaatttcaagtatacagtacattattgttaactatagttattatgctgtagattaggtccacagaaattacccatcttataactgaaagttggtagtctttaatcaaaatcccccatttctctcacgccctggcccctggcaagcacagttctacaatttgcttttttgagtttgactttttcagattccacatataagtgagatcaggcagtacttgtctgagtctgggttctcatgtctgcatctgaattcagtctactccagtattatcagtcatttagcctctgctaagttctgtacactcatgaaagaatgagaatgaagtagaaaaacagcattattatgaaaacagcattattttcattttattatgcaaacagttttgacctctgaaatcctctaaaagggtttcagtgtctcttagatccctggatcacactcagcagtagtgagatagagaaatccttgaaggcttttcaatggcaaatgatgatcaaaggcatgttttacaactcctcatagctttggtgtatagaatatgctggatgaagtaacttgcaactgcctgggcaagagttgaagagggcctttagctggggtgagaaattaggaatgaagattcttgtgagaaagagaaattagaaatgaaaatccttgtgggaaagagaagttagaaatgaagattcaacagcacttgatgtctgttcaaatgtggggagcaaaagttattataccttggcaactgggaggagaatggttttaaattaggaaaagacacagaaaatgtctgtagtgggaaatgtgatgaacttgtttataggtgtctttagtttgagataatatagaagcatgtgtaggtggttagtagagatgtggaactagaatcagaaagaaattggagttaaaggtttggattttggagacatccatgcgtggggatagtcgaactcataaatgttaaagtgtacaaagtaaatgatattgattgcgaagactagaagatttagcacaaatacaggagtcagtatttggaatttttcccttaggtgcccaactactgctttctttatcaagcatttaacatttaggcagtgttaccttcagtcacctcaactactgaccaggaatcacggttatttatgtctaacttttaaattagtattatttttaatttacaagttataattatattacacatattgagtgtaatatgatgttttgataaatgtatacaacatggaatattaaatcaagctattaacatatccatcacttacttaacatttttgtgatgatacagttgaaatgtactcttagttattttgaaatatactatacattattattgattatagtcaccctggtgtgcagatctcaaaaattcctcctgtctagccaaaattttgtaccttttgaccaccaacttcccattctcttgctcttccccgccctggtgactattgttgtaccctttgctatgaattcaacttttaaaagattccgcaactagtgagatcatgcagtatttgtctttctgtgcctagcttatttacttggcataatgtcttccagatccatccatattgtcccaaatgacagaattttgttctttttttgaagcagaatagtattccatcgcgtatatataccacattttctttatccattcatctgttgatagatatatagtttgagttcacattttggctattgtgaatagtgctgtaatgaacatgggagtgcagatatccctttgacatactgatttcaatttcttttgacatattcttagacagaagtgggtattgctggatcattctgttcattgttgggggaacctccataccattttccacaacatcttactagtttacgtttctaccaacagtgcatctgcaagcatttccttttctcctcttcttcaacacttatttttgtgtaagatttattctaataggtgtgaggtgatagcttattttggttttaatttttattttcctaatgattagtgatcagcatttttttcatgaacctgttggccatatataaggcatcttttaagaagtgtcttttcaggtctttagcctattttttttttttttttttttttgagacagagtcttgctctgtcgcccaggctagagtgcagtggtgcaatctcagctcactgcaacctctgcctcccgggttcaagtgattcttctgcctcagcctcccgagtagctgggattacaggcacctgccaccatgcccagctaatttcaccatcttggccaggctggtctcaaactcctgacctcatgatccacctgcctcagcctcccaaagtgctgggattataggcgtgagcccctgggcccggcctagcctattttttaattgggttgtttccttgctattgagttatttgagtttcttatatagtttggatattaaccatttatcagatagctgtatgggtttaaaatgttttttcccattctttgggttgtcccttcattttgtgattgtttcctttgctgtgcagaaactttttaatttgatgcaatcccatttgtctatttttgcttttgtcgcctcaacttctggagtcaatcaaaaaatccttgcccagattaatgtcatggggatattccccgttttcactgagtagtttataacttaaggtctttaatttattttgagttgatttatgtatttggtatgaaataatggatctaatttcattcttccacatgtggatatccaattttctcaacaccatttattgaatagactctctttcttcattgtgtgttcttggcacctttgtcaaaaatcaattggttgtgaaagtgtgagttaatatctgggctttctatcctatcccatttgatcagtcagtctgtttttatgccagtaccaagatgttttgatcataattgctttatattttgaagtcaggtagtgtgatgcatccagccttgttctttttgcttgagatcgttttgtctattcagagtgttttgtggtttcatatgaatttaaattttttttatttctgtgaaaatagaaaaatgataccagaattttgataaggactgcattgaatctgtagatcactttgggtagcatggacattttaacaatattcattccttcaattcatgaatatgggatatctttttatttatttgtgtttttttctatttctttcatcagcgttgtacagttttcagtataccagtcgttcgtctttattgctgttgtaaataggcttgttttcttaacttttttggatagctagttattagtgtatagaaatgctacagatttttgtatgttgattttgtatcctacgactttactgacttcagttatcagttctaagagtttgttttaatgcaaactttagggttttcaatatataaaacatgttgtcagcaaacagagacaatttaatttcttccattcctatttaggtatgtcttatttctttctctcgcttaattgctttggctggaactttcagaacgatgttgaaaggaagtgacaatagtgggcatctttgtcttggccgggatcttggagaaaacctttttcaacttttcaccattgagtataatgttggttacttgtttgttatatgtgacttttattgtactgaagtacatttcctctatacctattattttgagagcttttatcatgaaaggatgttgatttttttcaaatactttgcatcaatttagatgattatttggtttttcttctttattttcttagtgtagtgaatcacatttcttgatctgcatatattgaaccatccataaattccaagaataaatcccacttgatcatggtgaatgattcctttattgcattgttgaattcaatttgctattgtcttactagggatttttgcatctttgttcatcagagatattggcctgtaatttctttttttcttatagggtctttggcctttatatcaggataatgctggccatgtaaaatgaatttggaattatcctctgttcttcaattttttggagtattttaagaaggattggtatttgctcttgaaatgtttggtagcattcagccataaaggcatcaggttctgggactttctttgatatgagtcgttttatgactgatttaatttccttactcattattgatctgcttaggttttctatctcttcatgattcagtcttagtaggtgctatgtgtctagacgtttattcattttttcaaggttatccaatttttggcacataactgtggtagtttctcttgatcctttgtatttctgtatttctgtggtatctgttgtaatgtctctacttttatttctgattttgtttgaatctgcactttttttcttagttgatgtagctaagggtttgtcaactttttcttttaaaaaaaaacaattcttagttttatttatttttttctattgtttttctagtcttttatttatttttgctctttgttatttgcttccttctgttaactttgggcttagtttgttctttttctatttcctttagttgtaatattagaccatttatttgagattttatttctttttcaatacaggcgtttattgctgtaaattttcctttttggactgtttttgctgcataccatacattttagtatattatttttatttttgtcataaggtatctttttatttcttctgcaagtcatttattgtttagagtatatttaatttctacatatttgtgaatttcccaagatttcttctgttattgatttctagcttaatgccattatgatcagaaaacatacttgctatgctttcagtgctcttaaatttgttaagacatgttttgtggcctaacatatagtctatcctgaagaatgttctgtttgcttgagaagaaagtgtattctattgcttttggatagaagattttgtatatgtctgttaggtctatttggtctacagtgtaattaagtccagtgttttcttattgatgtgctgtctagatagtcagtttattgttaaaagtgggatactggggtcccctactattattgtattgcagtctatatcacccttcagatcacttaataattgctttattatttaggtgctccaatgttgggtgtatgtatatttataattgctatgtcttcttgatgaatttaccctcttgttgttatagaatggtcttctttgtccctttttatagttttttacttaaagtctattttacctgatataagtatatctacccttctgttttgacttacatttgcaaggaatgcctttttccattccttcattttcactttatatgtgtcgttattggtaaatagtctcttgtaggcagcatatgattggatcttatttttttttaatacattaagccattctgtgtcttttgatgaatttaatcaatttcattcaggataattattaataggagcagacttgctactgccctttcattatttgttttctgtttgttttgtagatcttttgtttctttcttcttctgttgctgttttcctttgtggcttgatggtttcctatggtggtctgcttttaatcctttctttttatagtttttgcttccacagtagttttctgctttgtggttaccatgaggcttacataaaacatcttgtactcagaaacagctattttaaattgataaaaaattaacttcatagcaaacaaaaactatatttttatgttctctcccctaaaacttttatgattttgatctcagaattttttttgtaatttgtatttcctaacagtttattatagctacagttatttttaatagttttgtcttttaaacctgagagataaatttgctttatataatcaccttacattattagaatatcctgaacatgactatattacttataccattcagttttctttaaattttctcatgttttatgttattagttatcagactttcatttaagcttaagtaactccctttagcaattctatagagcaggccgagtggtaacaaactctcttagcttttgtctgggaaaaatttaattctctcttgtttctgaaggacagctttcctgagtaaagtattcttggtagaagtttttttccccttcttcattactttgagtttattattctactctctcatggtctgcagggtttctgctgagaaatctgctaattagccatattgagacgcctttgaatgcgactatattctctatctcttgctgctttcagtattctttctttgtgtttgatttttgtctgggtaaactcttcattgagttgaatttgactggagaactttgagcttccaatttctagatagtgttgtctttccccagatttaggcatttttcagccagtatttttaaaaataatgattcttggtattttttctttctcttctttgggaactcctgttatgtacagcttagttctcttgattgtgtcacataattcctatagaccttctctattctttttcattcttttttatttttgcttctttgactggataactttaagtatcctatcttttaattcactaattttctttcttctgcttgatcaagtctgctgttgaaattttctactgaatttttagaatagtcattgtattccttatttctagcgtttctgtttgtttttttgtttgtttttatttctttgtcaaatttcttattttgttaatgaattgttttccaaattgcatttactgtttcatctgtattttcttatagttccctgaacttcaagagaattattctgaatttttgtcattcattttatagatctccatttcttcaagatccattattggaactttattaatttcttttggtcatatttccctgatttaaaaaaaatccttatgttggcatctgcacatgtgaggaaacagccacccttttcaggcttttctagtgttctgtggtggtgatagaacttcactatttagtctagcttgggattctggttgggttagttggtagtgaccccagacaagtagactttgttatcatgttttgtatttgggctgggctgttacctgtgacctgggatcaaatggaagtgctggctgtgctctgagatccagtgacatctctggttggggtcttcagtaagtcagagctgttgcctgggcgtagtaattgcctctgatcagtgttgtagattgtcttctctggctggatagtgctgtggtttgggatctatatctgcacagggccacctacttggctgggaggctgggtgaggtgtctagattgctacttaactactcagggtaggcaggactgcaggctatgctgcatagatatgcatggacatgggcttgcctcccatactagggtaaccttaagcacagcactgaggtttggtttagtagctgtttagctgctgtagttgagcagagtcagatgctcccctcagaagacattcacacacatgcacatgactccttgcctggcaagggcttaaggagagccccaggatttggttggattgatgctcactagctgagtctgggcaggactagattcagataattgctgacctgcttttaacttctagcttggagcgaagttaaggaaagtactggggcttggctaagtcacagctctgcagctgggtctgagtagggtcagatgctctctttggataatccgtgggtctgggaagggtcagagggtccctttgtggataatgctgacctgcccttgcttcttggcctggaagtggctgtgaaggagatcaccagggcttggctagatcacagctctgtggctgcatctaggtggggtcagatgctccctctgtgaatgatgacaaatgtacccctgccttctggcctgagaaaggactaaagagtactctagagcttggttgggttgcagctcaatcactaagcttgggtggagctagatgtttactcagcagataattatcaacatgccgctatctcctggcctggggaagttttaaggagagcacgcaggctggctgtggaagctggccagggatttgggcctgggaggcctgtcaactgtgcctcattcagagcaatgctgttgggtattctttctggtggtgtgcctccactggccacaaggcagagccgccaccaagatctgcttgtctgtcactgtgagccctacccctgttcgttgtttctaagtgacctcaggtggtctagccctgttgatagctagtgtttccagtggggcaagacaagggagtgttacctgtgaatgggcccagaatgttggggaagctgaatgtctgcctccaactcaactctctcttccctctgtaaaaacccacagttcccggggaatctcttgtgtgccggactgtgctggcttgggggaggggcaacatagtcaaagagaaactgttcctcttacacttcaattgtagctgttctttgtctgtggtccaaggggttgtttcagcctcactcccatgttctgggatattcatcaaggtattcttgtctctgaatagttgcaaattggatttctgtagaaaacggtggagccagagagttcctattccaccatcttgctgatgtcattctatttacctctcactttttatagattgtttctcacattgtactttgtttccatgttttctactccttcctcctcatccctgtggaatgcccataccacattctcccagtccccagccaccttctacctggactattacatcacttcctggcctccacactatctttactttgccatcagagtcctctgcctgtctctgttctgctcattctttccttaaataacttctctttacattgtcaacactttgactcgtcataaatctgttattatcctaagatatacaacttgagtgacttatcattcaacaagtgatttgttgagtaaattatgtatctttcatcatatatttgtttagtttttgtctacctgtcctttaattttttgcctttattatatttgcttttcttattcctcaagtattcaagtggactaactatgtctccttgagtcacttattattattcaaaatagttgcctaatgaatgtttttaaagatgatgagtgctgcctgaagggccattaattaaagttatagaattctctttaaagatttaaaaaatatataataggcatactttctaaaagaatttgcaaaaaattctgccagagacttattaaaggacccattgtgaggtctctttatttcttttgtttctgtgacttgaggctgtagaagtatgaaaagattgtaggtaattatttagaatggcttattatagatctcctgaaagctgaaattatgcattaaataatgttcaagggctttcttattttgaatgtgtcaaatattttattaaaagtattagattggagctataaccatgaggatcacatatttattctggttaatgacttgacagagattattgggtggtgactgaattctttaaatggaagaagaagaatgaatatgacaaagactacaaggacatacaaacttatcttcgctttcacccttttctcctttagtagttaatagatatttttaagtgcaattatgtgccaagcacattgatagaccctggggaaacaagggtaagcaaaactacatataaaccctgcgctgaagaagttttacaagtagcagggaagagagatattatgtataatcatacatataagtttctagttataaatggataactgctatgaaaggatagaatactttcatactacaaaatgagaggacttgccctggtctaagagatgcccagaaaacttacttaaggaagaatcatttaattgagaattatatgttgagtaggagttgaagaggcagagttgatgatggatcagctctaggcaaagagaggtcaggtggtggtggtgagcatgtgcttttagggaactagaaagggaccaatgtggcccaaatacagacagtaagggaacagtgatactgggtttaactgaagatgtaatcagatagggacttaaaggattatggtctttatcctaaaagtattgagatgcctttcttgaggaggtgatggggaggtggagatagagagatgggcagagagaaagagagagcatgtgtgtgtgtgcgcacgggtgtgcatgcatgtgtggctgccatggaggaaaaacttaaatgttagaagagaagatgtctgagaaagagctggaggcgcattctttagagatgttgaaagatgaagcttggaaagtggtaggtgatgctggttagagaagtagattgattcagatgatgtctcacaagtaaaaccacgggggttggtgatagattagatacggagggagacaagaaagaggatgtcaaagatgagccctaatttctgcaactggtgggtgaatggtagtactgtaacttttgtggtggtgattgcttgggagaggaccaggcttttaggggcagagaaaatgagtttggttggaatatgttaagtttgccattcacatgcagagtaagcactactgattatagagtttagaggagggtcttggtttgctgatatacattggaagtccgtgagtacagaaggtcattttactacaggcagaggttatcttggttgagactattgaatcagctcattttaaacttcagagatgttgagatgcccctgaattaatttttttactcagtgtctccagttttataaaacttgatgaaaaatatatggccatttaaaatgcaaatttattgatagcctttttattgactgccttaactttttatgcaacgtttgctgaagtgtgatagtatttaagtccattactataaataagcacgaacagtggttcttgatatgtaagagtaaggatatggggctttccgttgtaacctatgggctaaaattgtagaagaggctcatatgttcttattcttggtgctattttaatatctaaccaatctcatttgatatcttttttttttttttttttgagatggagtcttaatgtgtcgcccaggctagagagcagtggcacgatctcggctcactgcaagcttcgccccctgggttcacgccattctcctgtctcagcctcccaagtagctgggactacaggtgcccaccaccatgcccggctaattttttgtatttttagtagaaacagggtttcaccatgttagccaggatggtctcgatctcccgacctcgtgatcttcctgcctctgcctcccaaagtgctgggattacaggcatgagccaccgtgcccggcctcatttgatatatttatgttccaatgtgtttatctaggtactggaatttgtacatgtttttctatgatttctcattttttctcccagttttatttaagtctggaaattatttagtattgtatataatatagtaagcccccttccttcttaacttgtgtagatataaatatgtcctttggctattttttacttcttttttagaagcaaccctattaactgatatatatatatacatatggacaagatctaactctgttgcctagggtagagtgcagtagcatgatcatggttcattgcaaccttgacctcctgggttcaaacgatcctgccacctcagcttcccaggcagctgggaccgcaggtgcttgccaccatgcctggctaatttttgttttttgtaaagacaggctcccactatgttgccgggtctcgaacccctgggctcaagcaatcttcctgctttggcctcccaaagtgctaggattacagatgtgagccactgcacccagccttgctttgaactatcaaaagtatggtttcctgataacatttcaaaaacattggaagaatatactttaggagtcataaatttgttcatatcctttggcctaattaattaacttgaagaatttatcaagtgaagataattaacatgaataattctgtctctacttaatatttaataattaaatatacaataacaaatatcaaatgtagggaaattattaaatatattttgatcaaccatatatattatctatgcactgaaatcatagacttgaaaactgtgtagaaacagaaaactgtaatagtatggacatggtgtaatattgttaattaagagttttttgtatttatactgtttataactgtgtcaattatgaattcatatgaatgataactagaaaggaaaatgaagcatttcatgatgggattatgagtatgtttcactttttaaaatatcctaatatgctatctaataaatattaagatgaatataaaagagtttaaaattagtttcggttttagcagccagtaatttcttttttattaaatgggtatggaaacctcatcaagctggcttgatcattctaaagcacttaaaaaattattatttacgtccagttatttcagaaattgaagtatatttagttacctcagaaatcacaatggaactttgagattttggaagattttgctttggaaccgatgcagggagtgtgggaggtgacagtttatatctcactcaagttgttttttctttccttcctgcagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctaggtaggttcaacattttttgctaagtatctttatgttcactgtaattttgtatgacagctcatttccaagtcattatttggtgactgaaaaatatacaaaatataagagctatttatcagcctgaaatttggttattatccatgtttctaatatctattctatcaagtttatcagtattacatgaatattttggattaaaattttcgttatgaaatgttgtgattcttccaaacctttaatatcaattaatgtaatgagtagtctactatgtatatatcttaaatttgttgtagttgacttattttgtatatgcttcttatggtagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcaggtaatgatactgaagaccccacacttgcaatgcaaaatgttttatttattgtatttgtgtattagctattattagcactcagcaagtcatagtttgagtgtcatcagcctctctcccttccctttcccctgcctcccttttatgtgcattctagggtgaattctactgacattttgcaatttacagtcttacacactggactctgagtcaacttgtcctaatcattttattttcagattccttttataggattgactttgaaatgttacaagttgatcttggtctgaaagtttggctctgctgttagctgttaccagagagaaaggatgaaatagatgctaaatgcaatatatactgtgtgatatacacatcacatacaaatatattactatcctattatgctttgttacttctgtggagaggggaagagaatgagaggtggggtggggggagggtggaggagagagagagggttgtaattatatgtatgttggacatgtagatgtcttcctgaggaaagagaaccatgcaaatcctaagttacttccgtgcccagatttcatatttctttatcagcaagcaaaaggacatctattatttgcatcatttagtccttttggtaaagtgaattcttacttcttaatttgagttatagctgcagctatcatgtatctttctctgaaatatttttcatatgaggaaaacctaacccaagtttgcctgcacaccaagagcatgtcctcagagaaagtgagcttcggggttagttggatactctaccatgtcattttggcttagattgtttccatctctctactttgccatcacaaaattgactttcatttggttgtttgaaagctgatgttattgttaaggttactatgttctgctcatgttcatttggggcagagagagatattttatgagattctcaaagtaaagaagacatttcccaaaagactctagaaaatggcttatgtctcattgtccagaactgggtaacaagcccactcactcattcattcattaattcatgcagcagttatttaacaaatgcctgttaggtaccagatactgtttcagatgctacagtcatgttagaaaataagacggtaaaattctttattttcatggtccttaaattctagagagggcaaggggagaaaggcagtaaacacagacataagaaaatatgtactatatctgatggtgatgagtgtactatgaagaaatgttaggcaaggaaggcagatggagaatgcaagggagggagtggaggttgtatgtggggaaatctaaaataggatgatcagtaagggctgtttggaggaaatgacagaatgacaaagactggtgggggatgagggtgtgagctatgtaatatctggggtaggaacatttaaagcagaaggacccatcagcaagagcaaaggccctgcagtgtagccctgcccatctggagcaacaaggaggccactgtggctgatgtctgcatgtgataggggatgaggttcaacaggtgcagggccagggctctgtgtcagggatccccatgaccacccacagtttcgatgagtcactaagaagactcgcaggacctagcatttagtcatatccatggctatgatttattacggcaaagaatacaaaataaaatcattgaagggaaaaagctcatggggtgtaaagtccagaggaagccagggcaagcttctaagattccccctcccacccccatccattgacacaggacacacttaattccccagcattgagttgtcacaagatgtataaaatgttgccaaccagggaagcatactagggactcagtgcccaggattttaactggggtctgatcatgcaggcaccctctgcctggcacataccaaaattctagactctcagaaagaaatgaatgttcagcataaaccacaattattacacagtttaggcactgggagccacttaatagttccagaatggtgggaactctcctgaaattccagttcccagacaccagcggatagccgacctgtgaacaagcctttaaggatagcagtcaggtctgctgtgtgaacactttcctgcataagcccattagcattgtaatgagtttgggccctgagggaattagagagcctttgaaggggaggagtagaaaagtgaatgatctgactcacattttagaaggaacaactctgaccatagtatagagaatagattgtaaatgggcaaggacagaaatagaccagttaggaattattacagtaataaatgatggagctatgggaagcatgaatttgctgctcattgagatatggatgactataggaagagcaggtttaggggataagatgaggagttttggatgtgcttaaagtcttgtgtctgttgcatgcaagggtcagaagtttacactactactcaatctggtccattcctggagctaagcgtagtagatcagcttcctctgaggcatctctgcccaatagggatataatgtgtgcctcatatgtaaatttaagtttcctagcagcctacattttttaaaaagtagaaagaagcaggtcacttgattttaatatattttatttaacccaatgtatctgaaatattttttcaacatacaatcaacataaaattattgaggaaatagtttacatttttcatatcttgtcttcaaattttagtgcgcattttacacttatagactagctacactaactacatttcaactggtcaatagccacatgtggccagtggctactgtgaaggagaaggcaaccctaagacatgaactgggtcttgagtagggagagttagaaagaaacaagaggaccctattcttattaggtactcacttgtttcttcactttcttcagatctctgcaaaatgataccttaccagaaagatcactgatggaaaattgcagctccccaccatcattctgtatctttttatccttataaaaagtttcttcatgacacttataattgcctagtttgtctatcatcaagtttttttttgttttttttttaactagaattgaagagtatgagagctggtatactgctgtgctcacagctttatccctgcacccagaaaagtgcctggcacacattaggggcttaggatgaacctgtcattctgtgggagaggcagaacacttacaaggccttctcaaggccttatacaactctatagggcagagctgggcttcctggggtgagaaccgacatgctctgctgtgtggttccatcttctcaccctgcagccttgcagcagatggagagcacatgctattcctcaactgtttgagaatggtagatttccctttatgaagcttgttccaaaattgttctggagacatacaattactgttattcaatacttgccaatagatactgaattctttcaatctgttcagtagaattcttcattacaggtctttgatgtctggacaatctcatttcaaaatgagatatagcagataatgagaatttcttgaatattttctggctgcatgaagtgctcattttattaaccctcattgatggagggcatggagccagagagagctggctttttaaaaaggcattgtcttttgtgaataaattatgtgcatattttaaaatcaaggcattttatttaggaatgtttgattgcctggagcaagattttattactatgtaacatctgtaacaatgtgttaaaatgctgtgtaaaatattgctaaaggataggatcgctactcaaattagcattctaagtaaaagctctcataagttttaagaaattaatgggggaatctcttttcaggttatcatagtgacctgaatgggaagattttcaaaaatctttacactccatattcttgctttactgcatatggaaaatccaggggtattgtaagaagagattctttgaagcattcattttgaggaacagttcatgaaatggctgacaagagacgttgtgtatgtttggtgaagaatggtgtagtcacacagaaacagataattagtttgggacaaaagaaagaggctaggaagcatagataagaagaaagaaagtaagtaattctatcataagggaaagggatatttcaggcaggaaaaaacagttgtaaaggccatgagctaaggatgaaacaccatcaaaggaggcagaagagcccacagaaacatttccgaggatatgaatttaagaataagagacatttgccagtgatcaaggagaaagctctaattctcatgacatcgttgtgcatggatgggatgttggaaaccatataggtcaagctcttcttttacaaataggaaacaaagacctagtgggattgccagaagttacacagaggaaaaaggcttccctactctcctgactctatatccgttctcttctacaaactttttacatgctatgaatacttttacaaaagtacacgctttctgagtatgaatgtaatatatgttcactgaacaaaatttgaaaaatatagaaacagaaacataaaataatcctaaaataattaacatttttgcttactttcacttagtctgttacttattcaaacatgtgtgttttaaatcatggtcattctatatgactgttttttaattgtcgttttcacttactatgtcatgttgcttaggaccacaaagtttgcaaatccataataacatgagacaaaaaaagaagtctgattaggtaatttcagggaaccccttgtgactttctgtgtattttttcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtggtatgtaatttacaaagttataggaaacacttttaaattatggttactagtgatgtatgggaccaaatcctgccttatggatgaagtgtttgagtttgaccatatcaacactgaattcctactaatcattgtagagagggatacaatttaaggttagttttctggttgtgggtattgttcttttttaaaaaaatataaaaccaaaattgtcctttaaaaagtcattctttctgagtttcagtacattcgttggccacattgtgggtgcattacattgttagaaagataaaattaaccaaataggatcaaaatgtggtttccaggtttaggcacaatggaagtagtaagtagggaacaagtctgtgtaaaacagtcggacttatgaaaaagtagatctgagttgtggagtgatataggttgggcttcctgtaaatagactctgagattgagagttgtggacagaaggattttggggagatacatctatgaggatgtgaggaaggtgaggatgtgcagagggagaagttgatccacaggcaattgcaactgaggttgattgcaactgagttcaggagatgagctggtccttaggagttgttcccagtttagagctaagctattgatatccccattttagcagtccttggctttaggccaccctcagggttgggtataaccttgagtgagacagtttgctgtaggaaagggtgattcccaatgaggagcacagaacctgttgttcctagcagccgagggatgggtacatcagccccaagaagggatctgggcagacgacgagattatctattactggagaatagtataaagttggagctgaggttcaagaatggaataagaatgagccaaataagtacatgattaacaacaagagggatcagagagccttttgttcctagctggaagatgggttgtcttcttggcttgcctttggtttcatagattagtctgtgtatatggcccaaatgcttctctgaagagttcttttaaaggaactctcatggaactgtctcaaaaaaaggacaggtatatatcatggttcatcatttctaggtttctgtattatttcaaacgtgattggagcttctgtatattaagaatgttatagcaaattctattgcatttaatatttactttaggtaagctaccagaactgtaagttgtgtctgtcaggttctatatgttctgatttgtgtttctccagttatcatttcttatataaacatgattacaattatttctaatttaaatatataatggtaccttaaacatagactatagtttggaagaattaattatttcattcagggagctagtatatcttttttctgtaaagggccagatagtaaatattttaggctttgtgagccatttggtctctttcactactgctttgcctttgtagtagaattgtgctaggcaatataagcaatattagcagacaatataggcagcgatagacaatatgcaattgaatgagcttggttgtgttccagtaaaacttgatttgtgacaaatgggtttggccattgggcagtagttttctgacctctgattttattaataaagctcttgaatttatttttttaacttttattttaagttcaggggtacctatgcaagtttgttacataggtaaactggtgtcatggggttttgttctacagatcatttcatcatccaggtcttaagcctagtacccatcagttatttttcctgatcctctcccttcttccaccttccacccttgaataagccccagtgtgtgttgtttccctctatgcgtccatgtgttctcaacatttagctcccacttataagtgagaacatgtggtatttggttttctgttcctgtgttagtttgctaaggataatggcctccagctccatccatgtccctgcaaaagacatgatctcatttttcttttatggctgcatacctaaagaaagaaataccattcaatacagcaatcccattactgggtatatactgaaagttatataaatcattctatgataaatacacatgcatatgtatgttcattgcaacactcttcgcaatagcaaagacatggaatcaacctaaatgtccatcaatgatagactgaatagagcttttgaatttatattctccattgccttttccaggtggaaaaacgaatgtcagcaaaggtagatacatcagcctataatgctagtttgagtaattataaatagtttgtagctgcattgctggagagtggtgtgtgaggtgggaatcagtgaaaaatggcattcaagaagtcctatcagcaaggtcttccatgctttttagcaaatttggatttgactctttagacaggagagacataaaaggagaagagagttgctatgatttgtatctctccctatctttctctctccacctgtgttttagttgattcattgcttagtgatacatctgttcagagttagtcaaaggaaataatccgggcaaaagttttgcagagaaaaatctttaagctagtatgccaccttattttacttttatggatctttgtatatggtatctagaacttagattcccagagagactgtatactttatcttagaatggaattcagtctccagtatttgacaatttggctgcatttttttttattagcttaaagtttataaatggtttgctcttcctttttcctaacaatcttccattaatatgaaagacatctgatttgtagaatcatattattatgttgcttaaatatctcttgctatttaagttataggtttaataaaagaaaatcaatttttaaaatattcttactacatagtgacaattacaaaataaataacatcttctttctttaaaattctagattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaaggtaaatattgttaaatatctttcaagttttaatgagaagcttcattggataatttaattctaatatttataaggaatgtaaatttctctttttatatgactttttcagtttggcaggtcatactcaatcctttttgtttattgttgttaaatctggtaatcatgtgaaattacctagcagtaatgttataggaaatgtgtcttttaaaagatacattatattagaaatattaatattttagttgtgagtacagtagaggtgactgttttttattttactttatctttttcatcattcatctgttctctttcttcactcagctatattttctatagattttcactagttacagagaacaatgagcaacacaatgaaatgtgtacatggcactaaaggtattaattgtttaatccaaaatagtaattagaataattttatcctgtgaagtgtacagtggtcaatttctcttttgagtactaaaatcatcacccaaataattattcatattagctgctggtgaaggttctaagattttcacgtaataacatggacatccagctttcaagtacctttcatttgaatagtcaatgggaaaaatacaacatgtggttatgttcctgggtctttaatatggcaaattaagtttttaaaatctaaacaatgaaataaaagttaggtgctgtgaaatactttgagcctcctgataggcacgtcactgtaagaacaaaatcactcttaatgattagtcattaaatgactttgtatatataatttttcattttttgaagaatcttttgagcctttataattatcatctctgttcaacctgcatatctgtacttccctaagactttgcagcaatttctgttaaagtgtatgacatgtgcaacataggagggtgctttagagaatcagaagtgggggattagaactgggatataatgctaggagtggatggtgattctctgcccaactttggggaccaggaagaccaagcccagaatgatccttgggagtatacattgtctttgttttacttctttttccttaactgtctacaagggatagagtagagtgttccactctaggtccttgtaacagcattgacagcaaatagaaaagactatttactcgtggcatgtttctctcacagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggtaagtcaaggctgcaaagaatgtgatctaaaatagaggaaaattctcttaagtaaaattgtgatgctcttgtaagtaaaaatcttttttttaataaaaggattcttttaaacataaaaatgtaagtattctactgttgccacccacctaagtatttaataatgaataatattttataactggctggcaaaaatgatgtctattacttgtatttattcttgaactggaatattgtttgaatgaattttgaagcactgaatttagattaattatatctgattggatccactgtaattttgttttgtcagtttttaaactaatgacaacaagtgaaatgcccaaatcaatctggttatttttattattcatttaataggacagtattttcctttcatgatatgattacttgaatcaagattagtcttcagatggtttagatctggttttagctatctgtatttatccatgtatgtatggagagagagagaagaacagagaaagagagggggagaatatgtgactatatcagtaatgatgcacaagaaattttaatagtggattagtgttaataatattataaaataataacaaaatgttgttttatattatataaatagtattaatcttatatattatataccatagaatatattatatgttattaaataaatatgatattatataatgttagtgttactaatagtggtattagtggttttaggtaatagtatctcctgaagagtataatttgggaaagatataagggatgggatagaaatgagggttttccccccctttttagagtattttttatctctggaaatttttcattatgcaaaaacaaagtaagaaatttttaaaaattaaatataggcttatatctagattttcaagtctagagcttttgctttaaaaatgtatgtagcatttaccagtgtttcctaaattttcttttgggatattaaatatgtaaaacatacaatagaatatggtcaaaatttcaggatagatttttaaaaattattttatttgctaatgagtgtgaagattccattgaaacatcaccagtgagctagaatattctatagattctgaagtggtcagtgggaatgtattaaaatataacaagaatcttttttatgtttgacagagctgcccattcctgtgaacaaagtcaattatttccttactgaaaaatatcaagtattcaatgcaagttaaatgtcttaaaaaaaaatgaaacaccatctttttcccccatcccccaggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagagtgagatgaactttcatttgtttacagtcatacagaggcctctccctgctgatttggccagtgttttatgtttagctttgcctgtatttatttttaaatagataaataaccaaatttgtcttataaactaattcttaggtctctttgggctagaccaaaggattcaacaagtttactttcattaaatataagagttcagaagaccttttatgcatacttatatctgactattaatttctactttaaagggtgaaatatagaaagttaagtagaaacaataactttagaaagatgacttatgagagttaccattttatcttgcctttcaattatattctttacttaaagggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggtatgccagtcattaacatattagcctttttgagttgtgcttcagacattttgtaggcatccatcaaatgaatgtacattggtgattgctaaatgcattatactctaaatgtttctatgttaagtcaaacaaatattattaattgaaatacaatttattaatgggcataggaagagacttataaagatacaacaatcttacccttttctgaacccccgccccagttttatttaaaataaatagaagttacaaaacaggataataattgacttagaagtgcctaacaatgtatagaaaactgtctgatgaactagactcttcctgtggactttagtttcttttatcttttattttgtttcttaatgccagtaaatatagatatttatttagaatttgcactaaaagtgtggacagtttttacttaatatctaaaatgccctttataattaaaaaaattgactaaaataagagaaaatgaacaaaatagttaaaacttgaaaaattgaaaaacaatattctagatttaggctaaccagtcttaaatattataaaacattccccaagaattacaaattttgtaaacttggcattttgtaatatgtaagaataagatgttttcataccatttttttatcagtaagtggaaaaggcatatgaacaaccatgaaaatgttagtaactttaactagcacctctatctacaggtagccttattttggctagacaaattaccagagtatgcgtcaacttatttgttgctcatggggggcggtagtaaatgctgttaaaaggtaagcatacagatgtagattttcctacacagaaaaacccattattgttaatatttttgaaatcctgagcttttaaagcagatttagaacttgaaacatttcctaagtaaaaagagtggaatgcaatcccagcactttgggaggccgaggcgggtggatcacgaggtcaggagatggagaccatcctggctaacacagtgaaaccccgtctgtactagaaatacaaaaaaattagccgggcgtggtggcgggcacctgtagtcccagctattccggcgactgaggcaggagaatggcgtgaacctgggaggcggagcttgcagtgagccgagattgcaccactgcactccagcctgggcaacaaagcgagactccatctcaaaaaaaacaaaaaacaaaaaaccggaatgcaagtcaatgagattcttatgttaaaagcagaaacaaatacattgattattcattgaagcagcctttcaactttaatgacattatcagcactttatctgtgcatgaggttcaagttccatcattaaccagcatccataggatcctacttattcttaaaattcacatcctctagggaagggactctgtattctacagcacagatttgaggtgcaggcaatttaattaccttctatttgagcatttgattttattcatgtttctatctgtctgagtgtgatatccaggtttttcacttttctctgttgttaaattaaagattttaggtagatttaatttcattttctgataaatgtctgtcagaaacattggaatatttttatgaccaatagtgaaactgcaagctggatcaagttttatttatttatcagtttataaaaacttttaacatagactcagaaaattgaactaaatcctgattataaacatccaggaatagcaaatttgggttttctttctgcctttctttttgactacgttgcaagaacaatatttgaaaccaatgggatttattttaattgtagaagactggtaatttttatgtaagtttcatatcatgtaatattaataccaagcatactgcattttatgtttgtgcaatggtgttagaacctgcatgacattaaaaaaattttaagaataaggatttattgtttttaatctgtaaataatactcttatcacatcaataatgttttatcttgaaaataatagactgtaaatttctgactttgaaataccataaatatacacaactttaaaatgccataaatatacatgccataaatatacacaactttaaaagtattacaaatataatacgcaaaaagaactactttttagtaccatgtttctgagatttttggtttcaactaaaaaattaaaatatatgtcagcaaaaactgtgattacattatttctttcctcatttcctatcttcctccttcttttcctccctctctttctcccttccttcctttctttcataggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaaaaaaaaaaaaggccgggcgcagtggctcatgcctgtaatcccagcactttgggaggccgaggcgggcggatcacgaggtcatgagtttgagaccagcttggccaatatggtgaaaccccgtctctactaaaaaaaatacaaaaattagccaggtgtggtggcgcatgcttgtagtcccagctgcttgagagcctgaggcaggagaatcacttgaacctgggaggcggaggttgcagtgagccgagatcacgccactgcgctccagcctgggcaacagagtgagacttcgtctcaaaaaaaaaaaaaaaaaaggaaagaaagtcttcattacccttcatgtatgagtctcttctcaaggatcttttgagtggtctattgaattaagggccaatcctccagcctgtgcacacagtttgatagtaatgtgagctcttaatatcaggaaattacaaaggggaacagattcctatttattggctgtagtagatcaagatgtacttttcatccataccacctattctctgcctgctttactgccagaccaccaatctggtcacaggcaggattctgtcatgggtctgggtgttacatcccacaatgggtttatctggtgagggatttatattacccactgttatgctagtctgttgtgacttatgtagaaaaaaacaccacagtcaccccccacccagctcatgtatttctctatatttcttctctcttacttctcattggctgtttacttccaagacttgaaagaaggaacccaattattattgattcagccacaaagagagagagagaaaaaaaggctaattaatcatgaaaactaagtatttgtgcagccatatttggtacctagtactaaattatcactacatcttaagtataaaacactataaattccatcataattgttattacatgataactatgacataatattatgaccttacctttcaaaagaaattccaaggtatgaattagccataaaaatatttagataatccccatatactcagcaacttttccggccccatatgtcaccattcccttcatttaatcacttataggttgtcagtaattcacatagatcacttttaattaataaaccaattgctgaaatgcccattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctacttttactgttagagaaaatgaagacctacactagtattcataaataatttttgttcattttattgtaactgcggtcataaactctagtgttttaaacctagtgttaagcacacttgttctgggaaataatatcgttacagctacaaattttcaatttgtcttagagtctaaagggaagatttaggttacccaattcctactgtattgttgaatatgtaaagcatgcgtgcttgagctttaattcattagatgtccatggctattttgattgttgatgataatagtagctgcatgatgctcagccctttgtgacttttttccttgcttatatcctgtctttcctatcacaaaagtttcttggtaacatgaagtttatcttttaaccttaataagatatacaatattgtgcacacaataaacattctgttagcattattcggtgacacagattagattcacagctgaggtacattgagaaaagactgttagtataaatccatcaaaattaacaagctgttcacaagggcaatgtggttaagtataccaaagccctgagaatagcagagacccatggaaatctacttgtgaaacctaaactaaaatgttacatctatggaatcaaagaagacttatataatggattttctctatttttttcttactaaatttcactggtccctgaggagtggtatgaacagtttggagtcaaaataccctaattagactccaggctcctcatctccagatatatgtatatatctggccctcagatttctatgagtttctatgaggcttaaataagataaggtatatgtaagaactgacacacaatagaagctcatttcagtttgttttaaatctgtgctgttgacatcaatgcaaatctcatgaagaaaacaaaacaagattgtattgcatgttaagcttctatccgtgttgaaagtggaaagcattgtgttatattttctgtttgtatagcggatggatgatataggttcaatgagaactttgcttcacagagtcaacatatgtacttcacttatactagatctgttaataaggacttgtatgcaaaataaatagttctggtaaatcaatgtattgaatctcctctctttatctcagattaataaaaaccacttttaaattttgactcgctaaagtaggtacaccataattcagaggacagtttaggtctgtattatgtgaggagcctgattgtagtaacaaagatcccgccaagtctcagtttcttcatatggtaaatgtgcatttcttcttcacgcaggaatcctgcaccagcgtgcccagttggctgatgcttatggacacctcttattcagctggcagctctcaggccctagactctgtccatcttggggttatgtcctcttctaggtcctgggcctcctctctattcacctgccaaatggaaaagtagaggatgtggggtcttgtgtgggtgtttatggcaagagtattagcagcataaatcatttctgcctctattctctgggtcagaattcagtcacatgctctacctaattgcaagagaagacaggaaatgccaactagttgagcatctaggaatagaaagtgggatttggtaaaaaaaatttttctgccacatgataattacatgtaacattctaaattataaaactgcagtcattgtaaacagaaataagattctacttgtttatcctgctctttttgtttttttttttgtttggccttactgaattttcttctttcaggtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgaggtatagtcagcattagcactcctgtaatttttccccaatttgtctttgattttctttttcctttttattgtaaattcagggagcacatgtgcaggtttgttacatgggtatattgcataatgctggggtttgggcttctagtgagcccataacccaaatagtgaatatagtacccaataggtagtttttcaacccacaccccactcctaccctgctgcctcaagtagtccccagtgtctgttgtttccatctttatgtccatgtgtatccattgtctggctcctacttataagtgagaacacatggtatttgattttctgtttctgcattaattcacttaggataatggctcctaattgcatctatgttgcttcaaaggacatgatttaattattttatatgactgtgtagtattccatggtgtatatctataacattttctttatccagttcactgttgatggacactaaagttgattccatacccttcctattgggaataggttgactgatgtctgatgttgagtggaagcacctgccctggtgtgggctgcagggagggaaggatggtaaaaagcgatcatgttggaatgtattggggtctcttggggagtgataagggggtgtaccaacttctagtcctgagccagcaggaatgaagtttgcttccctctcgtgcccgtgttgcaggactcatgactcaattcataaagactttgtcctttggctctgcagtgcagctgcaggccacagatatgcccctctaggagctgttaccaaaatgggctcagggcaaggcctcttccccaactccagggcaagcaacttcacaacttgtctgtccgccattgctgggacactgctgctctgtctaaaggcggggagttgggccctgttcttcctgtaagcccaagtggcacaagcttactttcagcagggattgagccactgaaaaaagcacacacaaaaaatgctttctttgtgtgtatgcactaagtaccagtgggaagaaccacagctgtgtctgcaacagtctagagtgggagatgactccctctctacgactgtccctaggcattggtgctgcccccttcagtgactggccccatgcctgcatttcctttgtcccaaggggactttgatgggctgtgctccccctcccttatgggcagcctacactgtgggtttagatcttcagaagtcctttagccccctgggacccacctgtcccccatgcttcccaacgtcagagccagttgtggggtatatttgcaggagatctggtggtacagtgactctagagcagagagatctcaggcagggcagtggcactatgggtacacaaccagtatggcaccctccatctcattttgggtctgagggaaacataggtgtgcctgcacaagctagcaacctggttctctgtccctgggaagttcctgaatagccacttatagcattgtcttgggtcactagcacagaggggctccttagaagcttggcagtcaggagattgtcagaggagtgaggggaggagagaagcactcccacctactttccatggggctccaagctccttgggggtcaatctctgtggactcttgctgcttcccttttctacaccctgcttcttcccactggccctctgacagatcctggctctcttcccccagttttctgttcagaactgggcctttcaccagtaactttgatcatcttcctgaggagaactggcacctgatgtccctagagagccatctgctcgaggcactgggcactgtgcactgtgctgtcactgctgaggggaatggtgactgtagtcaccctgtgtggccacacctcgagagctgtctttgattttcttttgcatagtattacttgtaaattcatgtgataatatttactatgtctgggatttttttggaaatccatatgcatgatggggggaaaaatcacagaccacacacacacacacacacacacacacacacacacacacacaaactctagatatctgaaatcaaattttttttgaagtttttattgctacataattgatatacgtattttcagagtacatgtgataatttgatgcattcatataatcaaatcagagtaattgagatatccatcaccttaaatattttttctttatggtaggaacagtctaattattctgcagctgttttgaaatgtacaatagattattgttacctatgtcaaattctttttttttgtttgtttgtttttggagacaaggggtcttattctgtcacccaggcagtaatgcagtgatgcgatcatagctcactgaagcttcgacctcccggctcaagcaacatttccaccttagcctcatgagtaactgggactacaggcatgtgccaccatgcctggctgtttttttttttaattttttaaaaatttattttattttattttaattaattagttttttgagacagagtcttgctctgtcacccaggctggagtgcagtggcgcgatctctgctcactgcaagctccacctcccgggtttacgccattctcctgcctcagcctcccgagtagctgggactacaggcgcccgccaccacacctggctaattttttgtattttttagtgagacagggtttcactgtgttagccaggatggtcttgatctcctgacctcatgatccgcccgccttggcctcccaaagtgctgggattacaggcgtgagccactgtgtctgatctatagtcaaatttttaagttcagattctgcccctgttttcccatcaaaactacccctctctcacatttttcctcttctgattgaaggcaaagccaatcaaccacgctggatgtctggatatcatccccagctgcaccctttctgtaatcgttacatgtatttggttaccaagtctagtcagttttccctttaagtgtgctttctgactattctgactgtggagaacttctatactgactcaaaatactgatggtgtaacataataagacaatgtcaaacttacaaaaacttgtagtttttaacatccatgtacactttgaaaaaaaattaaggaagtatttcagccaatcaaaaaactgaaacacaataagtagtttgagaataacaagcatattacagtccatctttatgtgtctcagcctcccacagtgataagaagtgaaggcgcaaggtcctatctactttgaagggggaacataatcttttggcccatggagttggtttctgtaacttgtaagaatgactccccttttcaaagtttggtcggacatttacagatctgtttctttatgtcttcatcagcatgagcctgagaaccttggctggagtatcaaccaacccactgtaggatgcgatttttctggttgcctgtgtgcactcaagtttcttcctcctctttcccttctttggctagttttaataatcaaaagaaggtggggaagcagcatatggggcccagttaagctgagcacagagttgtttttaatgaataattccaacctaaccacaggacagtggtatttaccagtcaaactcctaagtctttttctggaagggaggatggggaggtggaagagacaatctgattataaaatatacatggaaatacaaaatgccaagaatagccagcaactcacaaagaagaatatggagggtggccctacttagccaatgtgtcagataatacacagttaaagtaaataaggcagtgtgatatttgctctgggatgaacaaacaggccagagagaagaaaatagtccagatttgtcagtcgttttatagtttttgcttttagaatcatgtttgattctaaacagctttcttaatacctaaacagctttcttaaattaataaagatgaaaccagaatgcaattaattaaaaaacaaaaataccaataaaacctgattcataaattaaaaaacttagaaaataagaattgacgagaaggaaataattattaaaagagaaaatattgaaaattgtaagagactatataaatgtcgacaaataaattttaaaaacctatgtgaaattggctctagcagatatacagcagatatagaaagtctaaacctatgcacttttgaaaatgaatggagaataaacattaaaaacattaaaagctcagtaggtggttttccaaaggaattccaccaaatatgtttacatggtccatgtcttactttttttttttttttcagtctaatgactcttcttcagagccttcaacatgagatagcacagaaacgaataccttttttcccttcggtattgcaatatgtgattaaggaagtcatcagtgatgccctctggcagtctatttgccatgcacatgttctgccatcattcttgaggtgtgattaccctaatggtattaaatctcaatcaagatgttgcaggaatatcatccgtttacttctcagcttctgacacatgatgactcatgaaacatctaggttgtgtgccctagccatgatctgaaaacctctcacctgaggagcatttagaatttagaaattagtttcaaatgtctataaagattttcctcagtaataagaagcaataatttcccagttaccagattcttactgctagatacacttcccaggtgattaaaaaggttttcttgttttgagcataaaatctacattaaaatggcaaatagtctgatcttttcttccagcgaataagttcatccatttttagagtactgcattaggaggcatggggttgtttctagattccactctctccatctgcttgtttggtcatcagcctggtacatttcatgtacaactgtgtaacggctccattgtttttatatgtctagttctgaatatatacaaagatctatgtctcccacgggttctaatttggttttgaggatgtctttcatcatctctcagttctacttatggctagtggtatccactccatcaataatgcccaggtggaaatcgttctcatagcaacttagtattcacattggcaataaggaaacctagtctacagaagctgttatacctacggtacatcccaggttgtaccaatacttactgtataatagtttcctggactttctcaaaatgtagcagtgactgtggagtcaccattgcccatcttacagggaaattctcacaataattctgttcagtcctaccttggtaacagggcaaagtccttctttcctatttctactttatgcaggacaactaagctccatactttgtttatagaaacatacaactctccggaactgatgaatggtctataggtgatgagtcagggggatattgcactttaccttccttggggagaaaattatgaggtggagattcgtgtccagaggctttttaggaagtgctcttgaggtcaacacctgtgtaagtgaaagaagcaagattgggcagggatgaaggcaaagcatgaggcagttgaaactgatgctacagtatactacagtttgttttgaaatgggactgacccttcagagctgtctgagttagaatgatggtgagttttataatcttgtgttgagcagtcattgtgtatggaccatgccaggaagagcatttgaccatgtgagaaggggttgtcttcagatgagacaatttgcaaaggagcctgtcagatgagggtaataagtcctttccagaaggggaatcttagtgaacatcagagcatccaccactgagatgcagggtacagccacgttcaagagaagtttgttctgaaaagctctccctctctttcccttggtcttttatgatataccttattttttcactgcccactttgactctttgccttctacccattcctgtttccttcctgccccatccactgttgttggtcccaagagtactccctattatgtctttcctctcttgtctttctcttagcagagtaacttctagaaactttgttaagtatcactgtaggctggtaaaaataaaatggtcctgggaagataagaggaaagaaatatacagagaacaactatgccaatactttgagagagaatcatgatgcatatcatttttatctctaccttttcctctgcattctaaaacaacttgaatttgtcctatgcatcactgattaaattttctgcagtttgaattctgtattttattgtttctcatgaacattgtagttttgcaattgcattttttctttgagatttttattattaaatagtattattttaatctcttcactcaagcttttgtttcttcatagttgcttattgttatttttaaaatatatacatttaaaaaattttgtaagggcttctaggaaaatatgtgctccctgcctgagacctcattagatgtacttatgaaaaatctgtaattctgggatgcagtgcatcattcccattccttttactctctacatattacgaattggaaactcagaattgatataaagatgaaagagctgataacagtgggaacactaaagctctgaggtaggtggcagccagttattcttggttagtgtagtctctgtggcctggagttcaaagaagtcaggaaatgggtcttacccccagtattagtttgttctcacactgctaataaagacatactcaagactgggtaatttataaaggaaaggaggtttaatggactcacagttccacatggctggagaggcctcacaattatggcagaagatgaaggaggagcaaaggcatgtcttacatggccacaggcaagagagcgtgtgtaggggaatggtcctttataaaaccatcaaatcttgtgagtcttactcattatcatgagaacaccactggaaaaaacccacccccatgattcaacacctcccgccaggtccctcccatgacgtggggattatgggagctacaattcaagatgagatttgggtggggacacagccaaaccttaacacccactttgtggtacttcttgttatttaggttcatggcgtggaatgtgtatcctctagtctactccaaactgattccttcattagtgaaattttacctgtattttagaaagattttaatctttagtttctttctttctgttagtcttggccctttatggtgtctacatgtgcatttgaagaaggcacaactcatgcaaccagtctctgccagtttaactcagaagtctctttcctacatctttgttttaatttgctgtaaaaatatatgtgctcatggaaaacaaacaaacaaacaaacaaacaaaaacaaaaaaacctcagtcagtacagaaggatgtagaaaaatgagtaaaattcccctgactccttctgaatcttatattcctacttcccagaggtaaccgctattgacagttttttatataccctttgaaaaatttttatgcgtatccaaacatatgtgtcttattcttacacaaatggaattttacactgcaatctgttcagtaacttgctctttttactttataatctatcttaaacatttctttttcatactagctaaaatccattgcactaaaaaaattggttacatatttttcattgcatagattccccttagtatttgatactattgacatttcttcatgagcactgttttactgtggtgtttatagttctcttacattttttatatctttctgggattcacatttcttgtttagtatttagttctgtctagttctcctttcccaaatgtttatatacttttgcagacttccatcacctatatttgtattattttcctctcctttactatcttcgcaatcttggttctcttgagatatgggaagtagccactgaaaagtaaaaaggatatagattttatagccagctagaccttaatccaaatcttcactctactgtttaatgccatgtgactttaggaaaattaatttctctcacatttgggttctttgttgcaaaatgaggataataaggcttaatctaaacaaaggctctgagtattgcatgaaataatgtttgtgaagaaactaaccaatttacagacatttagaaagtgttttatacaacaactgtaatttagaaacattttaatgaaatagcaggttgctacctcaacttaatatctacatcataggataaaaattaaaggctttaaatttttaaaattcaacaccttttctacatcatagaataaaaaattaaaggttttaaattttttaaaaacaggaaaaatttatatttctattttcctgagatagcctatatatagtaccatttctcaaactgttgctctgcactgctattcagcagaatagaaataattgttctgaattttaaagaaagaaagggattccaggttcacatggacttgggaaaaccttgattgagctaagtaggctctttctatgcaggattatttttagacactttaatatactgaattccattttgaatctctaatattcggaatttattcccctatgaaacttccccatcacctttttatcccagaacatttattactatctttcgtaaccattggctgggattttccacctgtaatcacccttttcccccctcttactggttgtagatttctttgagaaatgaagagcatatgatatgaagagctgccttacatatacagtagataaggtggaaggcaatataaacatataaaatatagttgattctcatgattcacagtagccaatccttatcattcacaatcccctacttgtgaatttccctactcactaaggtgtatttgcaacctccaaagtcgatacttctggtgttttcatggtcattcagggacatacagaaagtgttggagaatttgattcacctgatttgtgcatttccagccgaggttgaagaagccaacaccttgactttgtttcagctctcatgttgtaaacaaatgttctttttccagtccatttattatcacttttttaaatttttgtgctttctgttggtgagttttctgtttaaatttgcccccaagtatagtgctgaaatatggcgttcctaagcacaagaaggctgtgatgtaccctaagtagaaaatatgtatgttagatgaactttattcaggtgtgagtcatagtgcttattaaacatgagaaatgtatttgaatgattctaagtttttgccaatatgtacatgtctgcaaattaccacaaaagtgctcaatattgattttggggttacaaagttggatgagtagacaaatgtgcaaataaggaatccaagaatagaggaaccaactgtatataaaatcagtagcaccttggagaaattactgtacatataaagaagtatgtaaagatgtttatggcaatattatttgtaatagtaaatagccattgtcagataaatcttgcaaatagtataaaggcaaacaatggaatccccacagcaatgaaaataatacattgagtctgatagcggtggctcatgcctgtaatcccagcattttgggaagccagagcctggtggatcatttgaggacaggagtttgagaccagcctggccaacatggcaaacccccgtctctactaaaaacacaaaaattagctgagcatggttaacgcacacctgtaatcctagctattcgggagactgaggcaggagaatagtttgaacctgggaggcagaggttgcagtgagctgagatcgtaccactgcactccagcctgggtgacagagtgagaccctgtctcaaaaaaaaaaaaaaaatacattgagtctacataagaaaacatgggtaacctcaacagtgtgcattgaaggaaaaattaaggagacacagtgcattttagagtgaataatatgatgggaagagttttgcaaagggagatcgaaatgggctaataaatgggtcaaaaagaataaattataataaaagaccatttgttgtccagtagaaacaatgctgttgaccgaagtaggaccaattcaaactatgcacctgagatccaagaaaaaaaataagaaaaaataaaatcattaacattcttatgagttaccagtaatgagaaacaatgtactatgagaaagaagtataaaatacctaggaatagattcagcaagaaacaagtggaactgatatgagtaaagataaaaacaaaatcttaaaggtgaaggtaaaagaaaactgaaacatgcatataaaagaccaaggtcttagacagaaaaactacattttcttgtgaattaggccctttactgctgcctttagatatttttgttaactagaagctgccattactaatttaacatcagcaaaatataccatgaattggatatccagtgttgatgaacaacggctggcatctcagggctgtggttgcccctacaactgtgatctaatgtcattcacactttgttttctcctttgaatggagctgtttcttataaagtctatgacctttgtctgtttacatcattgtgtgatcatttggctttctttaaagattggattttcaacggttaacatttttcagtaaatttaggggttgtattcttttcccattttccccataaagaacctaagtggaatttgtattcagaactgatttttgtggagtaattctttctagctgcaactcgtaattctagtgacaaaaaagacacccttaaaaatgattatggacataaacgttattctgctaatgacaacattcaaactttggctttggtcaatctggaaaatgcactgtttctgtcattggatgtagactgagtcccagaagaccattgtgttgcacacacttcaagacacagtgttggaggaggacaggcgtttcaccattcagctgatatcaattgatgaggtagaaatatctccagtaaaaggtaagagaaattcacatttttggaaattaaaaagtaaattctcagaaaaaatgtaataaaaataacccgtagttacaaaaatggacagggttaggtttcataattcctaaaacataaagataccattttccacatgtattaaaggttaagaattttttaaattaaaattataatacccaatcttggtaaggtcataggtcaaagatttcatacagcttagctgtgtaatttttttctaatgaagatgtttattgtagcagtgtttataaaatgtaaaataaaatatgtcagcttcctaaatggtccaacagtaggagactagttaaatgtgtcagaatactaggcagccattcaacgtgacataacaggaaaaactctcaattacattaaaaattaagaacacataattacatggataattgtcacgttaagaaaacaggttttgcaacaacatgctaaatgtaatctgttttgtcatgtgcatgtcttacatgaggttggaattatttatttgaaatgttaatagtggtttttgattacctatattttctaaacatatttacaattatcacactttacctttgtaataaaacattatttttaaatgtgtcatattatgtttagcattatagcctatgtacgtctgttttcatctgaaagtagttactcaaatattttgacacttcagaaacaggcattttaattctcatttgcctccagttgatatgatgatttgttttttggatccatagagaaaagagtaatgattctaaaatggttttattgtgctataaacaataataaccaaccataaaaaactggttcagaaacttttagcatgaaaatttggtgattaatacatttcttttttgccatcaagaactccatcctatgtgactaaaagcagatttaatgtccaaggaaatttttagaattgtagagtatctatcactgtgtatacttagggtagttataatttctgcattttatttaggatattttccattaagggaatgacatcactgcaccatattcttttataagtctttagttagctttagttaactctttcataagtctttagttatctacatcatgttaaaatgacagatgtcacataggctaattaaacatagaagaatatatgattggatcaggataaatcatttaccatatcaaaaaaatttttttgaggcagggtcttgctctgtcacccaggctgcagtgcagtggtgtgatcacagattcctgcagccttgaattcccaggctcaaacaaacctcccacctcagcctcctgagtagctaggactacaggcatgtggcactatgcccagttaatttatttttatgtttgcagggatggagtctccctatgttgcccaggctggtcttgaactcctgagctcatgggatcctcccacctcagcctcccaaagtgttgggattacaggtatgatccactgcacctaattcttaatatctttctgtctgactgtgacacttgctgtgacaagccactcttgattccattaatccattgccaaagaaagtgagagtatagtgatacagctctttgtgtcatgaacccctaatatgtgtttctggaaacaattttctttaagtttctgctaagttatatggatactcaaatacttgatatagttttctatttccatcttaatagaaatatttgacacaggtttataaatgcttacagtcaaatgatagagtcagaaaattaaaaatgaaaaagtgcccccaagaaatcttgcttttgccatatagccagttgacatagctatgtagtcaattgcagtgagctgcaaaatggttactgtagaaacaaattaatgccaatggtagaggagcccttgcttttcatgagcatgatagggcaattactgccaatttttttttctgcccctttcattaaaatgtaatcttgggcaagcgatttgcctccatgtcttcaagacctcaatgtgcttcagagtcataggtaaaatgaggatattaataccttactgatatgagagtcatgagaatgaactagattcctgtgtgtaaagtgcttagaaagtttccaggcatatactaagtgcttatgtgcacctgctacaaagtggtctatatcatcttgaatttaggtagtgcatcaataattattcggggtgataagcgagcatcaggagaagttgggatagctccgtcatctaggcacatcctcattggggaaccctcagcaaaatataatggtaccgctattatcaggtaaggacttcatgatttttctttgcctatatgggggttacgaagttttatttaaatcattagtcttaagtttatcattctcaatacatacatagtcttcaagcattaacattctatatactgttaacatcctgtggagaggagaacaaatttggggcagaaattggaataatatcctgacctatcttgatattagatcatgagaaggtttctgactcttgagtgatttgcacaaattacaccaaggaaagcacatggagttgagatcagaaaatctatgttttcacctctgttctgttactaaacatgtgatataagggagttatttcatctctgcaagcttgtgtgtcttagctacaaaatcattccttagaacatcatcagggccaaacattttgctttcaagtgttctaaaatcagagtctgtattagtctgttctcacactgctataaagaactgcttgagactgaataatttatgaagaaaagaggtttaattggttcaaggttctgcaggctgtacaggaagcatggctggggaggcctcaggaaacttacaattatggcagaaggcgaaaggagagctgacgtgtcctacctggctggagcaggtggaaggggtggaggggtgctatgtacttttcaacaaccagatcttgtgagaactctatcaggaaaacagcaagggggaagtccatccccatgattcagtcacctcccaccaggccccacctccaacacttgaggtcacacttcaacatgagatttatgtggggacacagagccaaaccatatcagggcctatcatataactaaattagtatgatcataggcaagtttgtttctggtaaattttcttatgggggatgggaagcaactatcaatggcatagctgggtttgactttatactttatcctcatggtagttatccagaagtaagactatcccttcccatcagcatgcccttatatgaagggtcttccagtctttagagaacttagacttttcatattttgtaccttgcgtgttaagtgaaaagcctataaatattaatacttctttttatttctttaaaccttctgcttttagtaatcagtttttgcttgtattcctgtcaagatagatttacactagcttaatactttgggtgttactatcttggaactttaagacttcctttggtttatagtttggtaaatgaggttatttaaaagaaaactgttattgaaatggatgaaaattgattactgttaaaagacagagaaaatgtttaagaaaagtaccttcaactgaaatgtattggatatacatttgtttattgttgtagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggtatcaatattagctggtttcttttatgccctttactctctgtgctggtgtgtgcacatgtgtgagcatatgtgtatgtgtgggtgtgtttgtgtgtgtgtggttagaagtgggggatggggaggaggtaaatattacagcatttgtggttggcgtgcacgtgtgtgtgtgtgtgtggtgtgtgtgtgtacggttgacaatggagattggggagaaggttaatgtaacagcatttggtattgtggaggtgcctgtgtatgggattaagagtgggaatgaggaggagattaatattacaaaatctgttgttattatttagaggttaggagtttttcttgaaattccacagattctactgttgatgactctttgtctttttctaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggtatagtatgaaatgcttaagattttaatatcatttttatttttagatatgaaaatgttttcttgtttctattccagagttttcataaactgattaatttgctccaaacatcattattttaacatataatctatataattttataaccttatatgtaattttaacacaatcctggtaaatagaacgtttagttacagacagtattgtctggtagattaaacatccaaatcaaataagaaaatgcattttgcataggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaaggtaaaggagaaaggcaattaggaaaaagaaagcaaagagcagagagaaagagagaaagttctattgtgtagagattaatactgagctctaaagcagttctttccctactctttctcagatttgtgtgacattagaacaggacatacaagggaaattatgacaatgactgagtttttttttttaattttgttaaatataacttccctctgaaaattgaaagtatgtgtttctattgtgtggactcactctgggtagccaggaagttgaatatgataacggcttctaattggtgaagacacagcctaacagctctctaaatcagaggtcagctggtgtggctgaatttgcttcttttgatttccatacttgtgaaagggctgaagggagggatttctttcattggtgcatctgaagtctgtatcgtcttctctgtgggtgaatgacatagatgcttgccccatagttttaaagtggggaaaaatttgagtgaaagctagttggccattaatgtgcaccatgttttcaaggaagataatgaattaaccttaatgagtctctttcattccctgatttagtgaggcagatttgatgaggtggaaaaacatctttagcatgtttaagtactcacaggttctgcagctcacaggttgagagagacctaccagcatctctgcccagatagcagataggtgggcccttcaactagagtaatgcctgcatttagaagaatcataaagacatttttcttgtgcatgaaaatatttttgcctttgtaatgtgaatatcatgctttaaaaactttttaaactaaaatatgttactcagtgacttaagtgtatatcatcccatctgggaaaaaaatattgtgggctcacatacccttcaaattttagatttcccaaaaatgcttctatgcctggcaatgagagtgaatttgtactcctagtaaatatagtaaaaagtttgagctgatcactgactattttaattaaataaatgcaatttggtaaaagtagtcgtttagtgtgagatcatatttgtgttactgaccagctagagcttgaggattttgtcttctttgctactgtttttttaaaaagcagtttctatgtaagtttaattctggggaaacaagtttttccttccagataaatttctaggttttctttgatctcaaaaggtaagtagtacaattagctaatctacagcccatctcagactactggtaacagttactcttatcatttaatattctaaatctcaattttctaattttgccttttatataattcgccaactttcaacctttcaactctaggtagggtataaataccagaatagaatttgggaattgaaggaaggactaaaatggtttatcggcattttttagcatgaggaattaaagtcatattttaaagccttggaagttgaagctttgtttgatgggaataatattaatctaaaaaaagacttcttttgcagaagtatcattacagaagtaaactaccatctatattaaggatagaggaattgattatgattggtttctgtagaaattgaaatacttttctttcttttttatttttctttctttctttttctttctttccctttttctttctttccaaagtcttgctgtgtcacccaggacagagtgcagtggcacaatcatagctcactgcaactttgaatgcctggactaaagggatcctctcacctcatacttctaaatagctatgactgcaggcatgtgccatcatgtctggctaattttttaaaattagtttttagtagagacaaggtctcactcactatgttgcccaggttggtattgagagatatttcttttgaatcttgatgatttagtttgaaatttaattagtgtcatgacactcactatttctttgaataaatcatcttaacctaacactgtaaatctcaaggccgcctgcttacttacctatctctgagtgcactaggtctattactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaaggtaggttcagtcagctagcttgtaagtaagtttactaccactttccaaattacattagtttgaatttccgtgtgtaaattgttttagtttggtgtgggtgtgtgtgtttgtgtttacacatatacacttttatatttatttacttatttgaaatacattttcagttatctttgggtagtcttgaaccttactgtgaatggcaatgttaggaacaagcctgtctagaaaaactatgtttaacattaggattattaaaatgtttctgtttcaaacattttaatgaaagcctttgtaatttgtgcatatttaatttcctatgtgactagaaatcagtgaatattcacttcctaatgaataatcatctttgaaatgaatattttactggcctagagatgcaggtagtatctggatccttgatcttgctttctcgaaacagtccccagtagcagcttgcctaatattgccaattctttcctcttgtagaagcagaatacagaatatatggttatattccttcccaggtaggaagagatggctgcctttctaggaaatgattttattcaaaggcagaatatgaatatgactttaaaaataaatatcttactgctgcatttaacctgattggcttcattgcctctatcaaaattctttggttatctagccatttttaaagttcataaaaaattgctttaggagttggtttataatgagtttatgggtaagttgtggaatacatcactattttgtgaacttcaatctgtacctggaaaaaatcatattacatttttgcattaagaaataaatgagacttggaattttttcagttcattgttttctgttagattcattatctttgggaattttggtcagtgtatatttatatttataatatacattgagtattatttagccatagctaatgtgagccctattaaattatattttaatatgcagaatttagcatagcttaagaaatatatttttgaaaataatgtttaagttgaaatcaaacattgaagacacattttcagattcacaagtagatttcataggaactgaaaatgtaatcaaattgtacttgtatctggacttttaaaaattcatatgatatacatatcataaacctcatttatttatattaccatatttatatttcaattgaatgtgtggaagcaatccagagtggtttcctatgagcacaaacaacttaaatgtttttttgtatccatctaacattgtcttagaaagcaaggatcatttgtttttatgtagtacacagggagaatgccaatgctactgattaaatacattgtttaaatgctaattgtactgttctctgtaactttcaacatctgataaactatgttcctcctaaaaaatgtcatgaggttttcactaatccccctttaaaatgataaaagaactatgaaaacatagagtgcttactttgtgccattatgtttaattgccaggtttaatttggctgaatcttataagttagttgctctgtctggcttaccaattaattccaagttcccattacagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaaggttggtatatagaaaataatgtgggcacatataagacataagtattgtgttcaaactcttacatatgttttgcactgacaatagaactttagataatatgtgtccattggaaaacaacaggtgaaatacttttggggtactaggggtagggaaagaggggctaggagacgatgtggttgcatatgtcacttcatttcaaataaaggaaataatattttctgtttctctagacttaaataatctaatcagaatgtggaaacattctttaattcactttctttatgcattaagcaattaaaaagagggcaagaaagtccctacaactgccctaggtcatgtaatattgatgttaatcattcattcttttagctaagcacccacttcttaccacttgatgtgtgactactgtgccttgaatatgtatgaccaatttggaaaatgactggttattgggattttacaagcactttaatatgtttagactcacagaattgctccttcttgccatgcagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtagatttatgttccccatgactttaaatataatttttgatagactgagtatggtagtgtgttttctcattgcccaagtatatttctttattcacagccaatcaatatttattaattatcttgtatgtgtacagcagcttttgagccagattaagtacataaaaatgtataaggcatacatctgtcctcagggaaccttgagggcttgttagaaatgaagtgaatgattctgataaaattcattaattcaacaagtatttgttgagtgctttctgtgtgtcacacactgttctaggtactgagaatatactgaggaactagatagacctcatctccgttcttacagagttttcattttattaagcagagctgagcaataaacaactaaaaataaattgatctgataacagtaagggctctgcttgtaaaattgggagacacaattgcgagtgctgttggtgaggatgtgatatttcagctgaaagatgcattaggagaaagaggttagaagggtgagcatttgggcagaaggaacaatagcttctgcagaggcataagctggcatgtttcaggcatggaggggttcatgtggtcggggcctggagttaaggggataacagcacaggatagaccagagggcccaatagatgttcgatcacatggaacctcctaagccaggttaaagatgtccattgctcaatgaaataaaagaggacacaaacaaatggaagaacattccatgctcatggataggaagaatcaatatagtgaaaatggccatactgcctaaggtaatttataaattaaatgccatccccatcaagctaccaatgactttcttcaaggaattggaaaaaactactttaaacttcatatggaaccaaaaaagagcccacattgtcaagacaatcctaagcaaaaataacaaagctggaggcatcatgctacctgacttcaaactgtactacaaggctacagtaaccaaaacagcgtggtactggtaccaaaacagatatatagaccaatggaacagaacagaggcctcaaaaataacaccacacatctacaacaaacctgacaaaaacaagcaatggggaaaggattccctatttaataaatggtgttgggaaaactggctagccatatgtagaaagccgaaactggatcccttccttacaccttagacaaaaattaattcaagatggattaaagacttaaatgttagacctaaaaccataaaaaccctaggagaaaacctaggcaataccattcaggacataggcgtgggcaaggacttcatgtctaaaacaccaaaagcaatggcaacaaaagccaaaattgacaaatgggatctaattaaactaaagagcttctgcaaggcaaaacagactaccatcagagtgaacaggcaacctacagaatgggagaaaatttttgcaatctatccatctgacaaagggctaatatccagaatctacaaagaactcaaacaaatttacaagagaaaaacaaccccatcaaaaagtggtcaaaggatatgagcagacatttctcaaaagaagacatttatgcagccaacagacacctgaaaaaatgccgtcatccctggtcatcagagaaatgcaaatcaaaaccacaatgagataccatctcactccagttagaatggcgatcattaaaaagtcaggaaacaacagatgctggagaggatgtggagaaataggaacgcttttacactgctggtaggagtgtaaatgagttcaaccattatggaagacagtgtggcgattcctcaaggatctagaactagaaataccatttgacccagccatcccattactgggtatatacccaaaggattataaatcatgctgctataaagacacatgcacacgtatttttattgcggcactgttgacagtagcaaaaacttggaaccaacccaaatgtccatcaatgatagactggattaggaaaatgtggcacatatacaccatggaatactatgcagccataaaaaggatgagttcatgtcctttgcagggacatggatgaagctggaaaccatcattctcagcaaactaacacaaggatggaaaaccaagcactgcattttctcacttataggtgggaattgaacaatgaaaacacttggacacagggcagggaacatcatacactggggcctattggggggtggggggctaggggagagataacattaggagaaatacctaatgtaaatgacgagttgatgggtgcagcaaaccaacatagtacatgtatacctatgtgtcaaacctgcacgttgtgcacatgtacccttgaacttaaagtataataataaataaaagatttcattctaagtgcaaataggatgccattagaaaatcgtaagccagagaacaatgtcaccagattgtcttttaaagcagctcatttaagtctagtgcaaggaaaatggattcaagaagctggtggggcagcataggagcaggaaggatggctaggaggctgtttatttccctctactctccatgtcaaagctgatggtggctcagacaaggtggtggaaataaagatggcgagaagtgggtatacattgatatttggaagaaaaattcattgggctagaagtagaggctgagggaaagacaggaatcaaggataactccttgaatttaagtttgagcagctggataatttgtagggttgtttactaagatgcagaagctcaaggagaaattaagagttctgttttgggcgtgttcttctgagatactactgacatcccaggggagggtggtcacataggcagggcagcatgcgactgtgtgttgtggggtggtcagggctgcagatgcaggtctggaagatgttgacacatggggaggtgtttgaacacgtggggcctaaggggcatatctggaaacaggaaggatatggtgctgagtcctgagcttccaccatttagagatcagaggaaggagaaccagcagagaagcttgagaagtaaaggaggaggaaaactaggaaagcaggtggcacatgagtatcacataagccaagacgacaggacatggtgtttcaagaaggaaatagtcagctggagggctgctgatgaaagattaagaagcaaaaacaagtgcccaatgttctttctttgtagattgtgtgagaggcataccatttcaaatcatagaaatgtagaaaactttgtttcttataacaatgtatgaagatttccgtgtcttttacactaggaatataagtagatttagcatttttgcatggtctacagcagagtttttccatggttttgttgtcttatttatataggttttgattggcacagcctgtgcacacagcaggacagtattgtacttatatatttttaaaatgtttatatttctctaatacgtattttaatatagatttttatatgtttttatcctatgtgatgacaaattattcatgaatactataggtatgtagtttatagttgcaaatatctttttgtctttctttctttcttttttttttttttttttgagatggagtttcgctctttgttgcctaggctggagtgcagtggcgtgatcttggctcactgcaacctccgcctcccaggttcaagcaattctcctgtttcagctccgagtagctggaattacaggcgcctgccaccacgcccggctaatttttgtaattttagtagagacggggtttcaccatgttggccaggttggtctcaaactcctgatctcaggtgatctgcccgcctcggcctcccaaagtgttgggatcacaggcgtgagccaccacacccagctgcaaatatcattatttttaacaaaaaaaaacaagtttatgaaacaggaatttgatggaattatcctagaataattttcctatatgtgtatatattttcttaatactagataccctgaaatagttttttgcttaaaattgatctctattaaagaaataccaaaaccaaaaacatcccgcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccgtatgtatggctttatttttctcacaaaatgtggatttcatggatttatcagaaaatacatttacatttgttgaaactctataagcttgtgataaattggaaattataaaaccaaataatatcataataattctgaagggtcaaactttttggttttcatgtcagctcattgcatagcctgattattggtaatattttttttaaaaacattttagtatatgatacttattttataagcttggagaaaatttggtgtttttggaatatttgacagttttagagcagaggtatttgttatagcataccaaacattggatatctttgtcttcagggaatgtaaaaattattaactagttatattccagatagtttgaaggaaaaaatggtacttgtttagttaaggcaaaaagtgctgggaccaagactactgaaaataatgcagagggatgacccatttttttgaagtttgtaaaatactcttatttgagatctatatcagtcagagttttcctgagaaacaaaaccagtaggacagacatgcacacagacacagacacacacacacacacacacacacacacactcacacacacagcagggtggagggagagagagagatttgaaggaacagactcacatgattgtgagggctggcaagtccaaaatccatgaaataggctggcaggaaggaaactcaggaaagagttgaagttgcagttttgtggagcagagcagttcagtaagctaaaaactcaagcaggattcctaagttacagtcttgaggcagaattcctttttctccaggaaacctcagtttttgctcttaaggccttcagttgtttagatgaggcccattcacattcttgagggtgatctcctttacgtacagtcagctgattgtaagtattcatcatatctccaaaataccttcacagtgacatctagatgagcgtttgaccaaacaactgggcactatagtcttggcaagctgatacacaaaattagtcctcacagggcctgtttgcttcactccatgtatatcatagctagtaggaagaatttagctaaaattaactgattaaatgtagtaaatatgagatgaataaagcgaaattcaggcatcaaattactattctcttgggattctacaaatgggagttttctggattcttattcccatcatctttggggaataagaacctacttgttttaggtaacagtcaatgtgataaagaagttttcaaaaattaggtagctaagtagagtatattcaagtgtcatttttatgtttctttcatttcctcagcttctctgtttgttaatatgttggatactataatttcatccctattgttttataaattattttctctgttgtttatattttttagatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtattacttttcatttgatttttcaaagtaccagtttgcctaacaaatgtggttaagagggacagggaaactgcatgttctagttaattaaagtttttgataaactaaagttacgtgagttttcagagaaacagaggctttatttaaacatctttgggctctctcatcagcatcaacctctagctatctctctaaattaaaattggttacagttagttcagaaagattttcctcacacttaatcataaagaaccaaatgattttacattttattgtttgctataatgtgaaggctttcctacttaagcctctcaatgatttgtgtaaattctccagggccttatttctcattagaatttttccatttagcaactgttttttaagaggttgtctttgcatgtatatttagatagaatgtttggggatgcccttgtaagttttcatgatatttgattaacagatcaaggtaatttgtttgcaggaaaaacatattttgtgaaatttctctatacactgacctctctttctgtattggatattaactggtgcttcttcagttgacacttcatagttttgaggccagcaattcttggaaaataatgattgattttttatatctcatagatagtccttttttattaaaaacaaacaaaaattctgatttgaattgtcaaattatctactttttaccttgaaatactgtgtgtggtgtactactaaagttatttgtggaactggaatttttaaggtagcttgcttctctgtgtcccttcaaattgtgctgttattttagaagcaggtaaaataatgagattttgtaatcttatcctgcaaatagcattcaacagcctgagtcaatataccttccaagctaacatatacttagagagtttggctttgaatatagtgatgcacaattatattttttttttgtatattatagagaaaaacataatttaagggaatttggtgcaatatactgaattatataactttgttgagtttttttcttttattttaggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtttgtggcatttcttcagtttcctgatcattccaataaaaccctttcaggagtgcccatgcttacctcataatcagtttgaaatcttattcaggtatttaaatggaaccacaaaaaaatgccctcgaaaatgtttagtaactactggataatacatttgcagattataataagtatattactatttggatggagataatagatttttgtgtagaaagtaacagacacttatttaatacttacaaagttctaggaaatgtttccagtggtgtgcatatacacctgcacacccatggacatgtgtatgcacacgcacacacactgatacttgtcaaaggggagaaatttataggcttctttgtgcttctagcaaagagtagtgcaatgaaatagattacatgaagaggatttgtgaatacagagactggtaactgcttctctttttgaaaagttgaaatgtaggaaattggctatgatattctctaatggtaatgaggagaaatcatagcaggctgctctgccaagatctggggtgggtgatcagaatgcatggatgtcctgtggctcaagcagacagcccagcagtctttctcagtctgaaccacagaaagtgattgagtgactttttttttaattcctcccaaggatggtacatgtcatatcatcctctgtgcatgcattatggcattcattgccactggatgcattatggcattgggattaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataagcaacaagcctattacactaatccatacttacagtgctaccttttgatgtgttgtgtactcgagccttttgtagttgcttaataaagaaaacaaatggggtcttcttagtgagacatgggtttcatagctattcctacattcctgtacaatatgtcctcagttaatgtccacaggttcttggaaactgcagctttaagtgaaatgatgtacaatgtaaccaattttaccgtaagctaattgatataaaaaacaatagttaagttcctacagcatatttctggtcacaaaaacagcgccagacttataataaagatcagctactttgaaattaaacattgaaataaatgtgagctatacctgcatttgagaaagagtaataaaaacaaaataattattcaccctatttttccatttcaaggttgtaggttgccagagccttccatggtagctcagggctcaaggcagggatcaaccctggacaggactccatcccatcgcagggcacagtcacactcacacccacactcactcagactggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaatacaatatgcctaaattgtgtaactcgaaacattttcccatgtattcatagcattacattctgaacatattcaatttataagctgctaaagaacactagggggcaatcctttaacttttccagaaatagctggtatcattttatagtaagttttcatttgacaataaggcaggccaaagagaagattagatattgtattgttttactaagcaacgtgtatagtacaaaattgctctcaggcataagaaacccaaaatatgtgatgtatattacatggactaacacccttgatctgcctagttgttagattgtttttcacggtacctggaacattttgaagcatgtggtagtgcacttttcatttcatttgaaagcttagcattgcatttcataaaaatacttagctttcctaatatgataaatgaattatcatttatgaatttcttaatattgtctttgaacccattttaattatttttatgatttctattttcataaagagtgacaaaagtttactagtttatgcatgcataaaaaccctcttttttggtcactttaatatctctttttaacctatttcaagttgcacagcttccttctctctggcacattccaggattgtggtgtaagactgcacatagatttttaggtgttggtgagttagtcttccaaggaactgtttggggaaaggtgtgacatgcacttaaaccaaagacaagatttttttcaacggtttctttcttccctctcacccggtatataacccattgctctttgaagattgggatattagttacaagagtttacatcctgtcctccctcttctaccttcttggataaaagttgagactttggacaggtaagccacagagaaggaccgcaagggccatgatgtatctaaccctctgtgctgtggcttctaacctgcaagtgggtcttttaacagggtaggtttccattaggctctaagaacaaaagagtcttgatgtaggtttaacaccagaaccttcgagtgtcaactgttagcacctggtaagttgttaacacctggttaacagctggcttttttttatgaggcacagactgacaataagaatcattgacctgctaaagaaacaagcctaggcttgaaatactttttcagaatgcaagaggaattttatatttgtggctgggtcatttattgagcacttattatgtgccaatcactgtgagaagctcagcagatacgaagatgactgagaaataattcctggtgccatgttgctccctgtctagtgtatgaacagccagttataagagcatgtggataaatagtgttggcatgtgcacagggtgttaaggtaccataaatcgtttctgtttgtgcccaatgccatcaagaacaataggcaggaattgctggcaagatggccgaataggacagctctggtctgcagctcccagtgagatcgacgcagaaggcaggtgatttctgcatttccaacttaggtacccggttcatctcactgggactggttggacagtgggtgcagtccatggagggcaagccgaagcagggtagggtgacgcctcacctgggaagcacaaggggttggggaatttttgcccctacccaagggaagccatgagggactgagcctgaagaaccatgcattctggcccagatactgtgctttccccatagtcatcacaacctacacagacaggagactccctctggtgcctacaccaccagggccctgggtttcaagcacaaaactgggcagctgtttgggcagacaccgatctagctgcagaagtttttttttttttttttttttttcccttacctcagtggtgcctggaatgccagcgagacagaaccgttcactcccctggagagggggctgaagccgggaagccaagtggtcttgctcagcaggtcccacccccaaggagcccagcaaactaagatctactggtttgaaattctcgctgccagcacagcagcagtctgagattgacctgggacgctccagcttggttgggggaggagcgtccaccatggctgaggcttgagtaggtggttttaccctcacagtgtaaacaaagccaacagaaagttcgaactgggctgagcccaccacagcgcagcaaggctgctggggtcagactgccagatttctcctctctgggcagggcatctctgaaaaaaaggcagcagccccagtcagggacttatagagaaaacccccatctccctggcacagagcacctgggggaaggggcggctgaaggagcagcttcagcagacttaaacttccctgcctgacggctctgaagagagcagtggatctcccagcacagcgttcaagctctactaagggtcagactgcctcctcaagtggatccctgacccccgtgtatcctgactgggagacacctcccagtacaggctgacagacaactcatacaggagagctctggctggcatctggcaggtgccccgctgggtcgaagcttccagaggaaagaacaggcagcaatctttgctgttctgcagcctctgctggtgatatccaggcaaacagggtctggagtggacctccagcaaactccagcagacctgcagcagagggacctgactgttagaaggaaaactaacagaaaggagcagcacatccactcagagacctcatccaaaggtcaccaacatcaaagaccaaaggtaggtaaatccacaaagagggggagaaaccagagcaaaaatgctgaaaattccaaaaaccagaacgctgcttctcctccaatggatcacaacttcttgctagcaagggaacaaaactggacagagaatgagtttgatgattgacagaagtaagcttcagaaggtggataataataaactcctccgagctaagggagcatattctaacccaatgcaaggaagctaggaaccttgaaaaaaggttagatgaattgctaactagaataaccagtttagagaagaacataaatgacctgatggagctgaaaaacacagcacaagaacttcgtgaagcatacacaaatatcaatagctgaatcagtcaagcagaagaaatgatatgatagattgaagatcagcttaatgaagtaaagcaagaagacgagattagagaaaaaaaaaataaaaaggaatgaacaaagcctccaagaaatatgggactatgtgaaaagactacgtttgattggtgtacctgaaagtgacagggagaatggaaccaagttggaaaacattcttcaggatattatccaggagagcttccccaacctagcaagactggccaacattcaaatccaggaaatacagagtacaccaaaaagataccccttgagaagagcaaccataagacacataattgtcagattcaccaaggttgagataaggaaaaaatgttaagggcagccagagagaaaggttgggttacccacaaagggaagcccatcagacaaacagccgatctctcagcacaaaccctacaagccagaagagagtgggggccaatattcaacattcttaaagaaaagaattttcaacccagaatttcatatccagccaaactaagcttcataagtgaaggagaaataaaatcctttacagacgagcaaatgctgagagattttgtcaccaccaggcctgccttataagagctcctgaaggaagcactaaacatggaaagtaaaaccggtaccagccactgcaaaaacataccaaattataaagaccatcgacactatgaagaagctgcaccaactaatgggcaaaataaccagctggcatcatgatgacatgatcaaattcacacataacaatattaacattaaatgtaaatgggctaaatgtcccaattaaaagacacagactgccaaattggataaagagtcaagacccatcttcaggagacccatctcatgtgcagagacacacataggctcaatataaagggatggaggaatatttaccaagcaaatgaaaagcaaaaaaaaaaaaaaaaaaaaaaaagcaggagttgcaatcctaatctctgatgaaacagactttaaaccaacaaagatcaaaagagacaaagaaggccagtacataatggtaaagggatcaatgcatcaagaagagctaactatcttaaatatatatgcactcaatacaggagcacccagattcaaaaagcaagttcttagagacctacaaagagacttagactcccacacaataataatgagagactttaacaccccactgtcaatattagacagatcaatgagacagaaaattaacaagggtattcaggacttgaactcagctctggaccaagtggacctaagagacatctacaggtatctccaccccaaatcaacggaatatatcttcttctcagcacctcgtcgcacttattctaaaattgaccacataattggaagtaaaacacacctcagcaaatgtgaaagaatggaaataataacagtctttcagagcacagtgcaatcaaattagaactcaggattgggaaactcactcaaaactgggtaaataacaaaatgaaggcagaaataaagatattctttgaaaccaatgagaacaaagacacaatgtaccagaatctctgggacacagctaacacagtgtttagagggaaatttatagcattaaatgcccacaagagaaagcaggaaagatctaaaatcgacaccctaacatcaaaattaaaagaactagagtagcaagagcaaattcaaaagctagcagaagacaagaaatagctaagatcagagcagaactgaaggagatagagatatgaaaaatgcttcaaaaaatcaatcaatccagtagctgattttttgaaaagatcaataaaatagattgactgctagccagactaatgaagaagaaaagagagaagaatcaaatagacacaataaaaaatgatataggggatatcaccactgatcccacagaaatacaaactaccatcagagaatactataaacacctctatgcaaataaactagaaaatctagaagaaatggataaattcatggacacatacaccctcccaagactacaccaggaagaagtcgaatccctgaatagaccaaataacaagttctggaattgaggtagtaattaatagcctaccaaccaaaaaaagtccaggccaagacggatacaccgccgaattctaccagaggtacaaagaggagctggtaccctaccttctgaaatgattccaaacaaaagaaaaagagggaatcctccttgactcatttcatgaggccagcataattctgataccaaaacctgacagagacacaacaaaaaaagaaaatttcaggccaatatctgtgatgaacatcgatgagaaaattgtcaataaaatactggcaaaccaaatccagcagcacatcaaaaagcttatctaccatgatcaactcggcttcatacctgggatgcaaggctggttcaacatatgcaaatcattaaaagtaatccatcacagaaacagaagcaatgacaaaaaccacatgattatctcaatagatgcagaaaaggcctttgacaaaattcagcagcccttcatgctaaaaactctcaataaactaggtattgatggaatgtatctcaaaataataagagctatttatgacaaacccacaaccaatatcatactgaatgggcaataactagaagcattccctttgaaaactggcacaagacaaggatgccctctgtcgccacccctatttaacatagtattggaagttctggccagggcaatcagacaaaagaaaggagtaaaggatattcaaatagaaaaggaggaagtcaaattatctctgtttgcagatgacatgattgtatatttagaaaaccccatcatctcagccccagatatccttaagctgataagcaacttcagcaaagtctcaggatacaaaatcaatgtacaaaaatcacaagtattcttatacaccaataacaaacaaacagagagccagatcacgagtgaactcccattcccaattgctactaagagaataaaatacctaggaatcaaatttacaagggatgtgaaggaccttttcaaggacaaccacaaaccactgctcaagggaataagagaggacacaaacaaatgggaaaacatttccatgctcatggataggaagaattaatatcgttaaaatggccatactgcccaaagtaatttatagattcagtgctatccccatcaagctaccattgactttcttcatagaattggaaaaaactaccttaaacttcatatggaaccaaaaaagagcccgcattgccaagacaatcctaagcagaaagaacaaagctggaggcatcacactacctgacttcaaactacactacaagcctacagtaatcaaaacagcatggtagtggtaccaaaacagatatatagaccaatggaacagaacagaggcctcagaaatacaccacacatctacaaccatctgatctttgacaaacctgacaaaaacaagcaatggggaaaggattccctatttaatcaatgctgttgggaaaactggctagccatatgcagaaaactgaaactggaccccttccttataccttatacaaaaattaactcaagatggattaaagacttaaaagtaagacccaaaaccataaaaatcctagaagaaaacctaggaaataccatttaggacataggtatgggcaaagacttcatgtctgaaacaccaaaagcaatggcaacggaagccaaaattgaccaatgggatctaattaaactaaagagcttctgcacagcaaaagaaactatcatcagagtgaacaggcaacctacagaatgggagaaaatttttgcaatctatccatctgacaaagggctaatatccagaatctacaaagaacttaaacaaatttacaagaaaaaaaacaagcccatcaagaaatgggcaaaggatatgaacagacacttctcagaagaacacatttatgcagccaacaaacatgaaaaaatgctcatcatcactggtcattagagaaatgcaaatcagaaccacaatgagatactatctcacaccagttagaatggcgatcattaaaaagtcagaaaacaacagatgctggagaggatgtggagaaataggaatgcttttacactgttggtgggagtgtacattagttcaaccattgtggaagacagtgtgacgattcctcaaggatctaggactagaaataccatttgacccagcaatcccattattgggcatataccgaaaggattataaatcattctactgtaaatacacatgcacacatatgtttattgtggaactattcacaatagcaaaggcttggcaccaacccaaatgtccatcagtgatagactagataaagaaaatgtgacacatacaccatggaatgctatacagccataaaaatggatgagttcatgtcctttgcagggtcatggatgaagctggaaactgtcattctcagcaaactaacacaagaacagaaaaccaggcaccacgtgttctcactcataagtggtagttgaacaatgagaactcatggacacagggaggggaacatcacacacttggggcctgtcggggtgggcactaggggaggggtagcattaggagaaatacctaatataggtgacgggttgatgggtgcagcaaaccaccatggcatatgtatacctatgtaacaaaactgcatattctgcacatgcaccctagaacttaaaatataataataataaaaataaagaacgaatgataggcagtatagaaaatggtattggtgatgcagtcttggattacggaaatggaagagcgtattgagaacatgatcaactcctaaaaactttcaaattcatttttaaattaatctaacctcttttcttctgtaggtgaaccagcttttcctcaaatctgctctaactcatgttccattttagcatttaattaccgctccctggggatctgccacatcatacaaatctgtgtgtaccggatgggcctgtgagcagaggagctaggcgggaaggcacaagtgacctggtgctttaagctgacacctggctattcactcttaggaaaataaagataaagaaaaatcattagctgcccagccagtgactttcatggggggaggggtacactcttacaggagaggtgcgatatacatgattaaaatttttctgtgatttatttgttttttttttttagcacttgacccatgattcatgttcagtgaatgtcattttgaatgaataaaacacctgttaccctcatgttgcccaatatttgaaaccatcatggtatatattttgcaaatttgaggatgtgttgtctaaattcattatatttaaaagaagaagagactttacagaaatggttgatttttacattcaatcaagatatgcaaagtttttgggaatattccaggttgtgagataacttgggggttattaccaagaccaacgtttctatgggaaaatgtgctgtaagtttcaaaaataactttttgcataacatcaatacataaattccagattccccctattttgttggattctaaaattttgaaaatatgtaacacataggattaatttttatttatccaacataaatcagtacactgaaattattcattttgagtaaatatgatgaattattagtattcaatgaggaggaggaaattattcaatgaggaggaggaaagtgagttttgccaagtttataggagctgacactttgccagagtgccccttccgttttcttgatacttgatcctatcatgaacactgcctgtgtggctactgtcattggtgaagccatttgggcacatgtgaaaaatttgaaaatttgtgttttttttgtttagttttgtttgttcttttttgggggagaaggggagacggagtcttgcactgttgccaggctggagtgcagtggcacaatctcagctcactgcaacctctgcctcctgggttcaaatgattctcctgcctcagcctcccaagtagctgggaccacaggtttgcaccaccaagcccagctaatttttatttttattttttattttttattagtagagacagggtttcaccatgttggccacgctggtcttgaactcttggcctcaagtgatccacccgcctgggcctcccaaagtgctgggattacaggtgtgggccactgtgcccagccaatttgtagttttttatactctacatcttccactccttatctcacaccctacatactggtggtttgttttgtgatggggaaaagtgcatgtattgatgaaactgtttgctactaaagcaacctcaggcattatgctaatggctcaagtcaaagaacagcatttttctctgaaaattatttctaaatcactgacactgtttgtttataggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtaattggccctgtgtgtggttctctcagcagaacactagagggcagcttttacaggaaggacggagactcttagagctagaatttctcatgagtaactattttcttaaatataaataactctgtgaatatcaaagtagatgtaacagatatattatataaaataattagtctattttcaacattcagtaggaaaaaaagagatatgtccatatctcttcttgatattttgtatctaatattgaggtattttatgttaaataattaaaattataatgaagcactaatattccacactttttcgcatactaacattgtgaatgtttatgtttaatattcagactttggtttacaggggcgagtttgtcttgatgtagataaatgctgatggtcagatcctgtgatatggttgcaactaagtatttgcatcttctgtctgaggtcgttgtaggaaagattatttcccaatcatttcataaatgcacatgagaacaaagaacaacttgagggctttcctttcctttcaggcggattctgtcaatatatgaaaaagacaaggctgttatctgtggctatggtaacgtgtgtatgtttgaagccattgtgtgatataattctatcctactccttcaggtgggagctgaagtgactcgggcaagcctggctcaagatgctgaggtggaatctgtacagatgaatgggcaggaatatgggcagatatagtctctggccactaagggatgctcttcagctactcccgcctgagcatcttctccaaggagaatgaatgtgctttttctcttaaaatagaatacactggctattaaaataactgagagtaaaaggttttttttttctttacctcctcttctttaagagtgaatgaggaaatagaattgattaatgctttgaattttgttgtcttctttttgttcatgtgttgttataaaaaaaaaagattcagcaaaaccattcatttggaggaaaacatttcctactccttatccatgcacattgtcacaatactgtatcaccccaaagggcaaggttagagtccatcatggtacattcacatctttggtgtaacctctatacttgtatcagtgtttggtgtgtgtgtgcacgcatgtgtgtgtgtatgtgtgatgtggctagggcatttcaaaatagccctctagtcatgtagcaagaatgatctcactcaaagcttttggcagttgctaagcagaagcctcactgggctgggcatggtggctcatgcttttaatcccagcaatttgggaggcccaggtgggtgaatcccctgaggtcaggagtttgagactagcctggccaacgtgataaaaccttgtgtctactaaaaatagaaaattagctgcatgtggtggcatatgcctgcagtcccagctattggggaaggtgaggcatgagaatcacttgaacctgggaggcagaggttggagtgaaccgagatcgtaccattgcactccagcctggatgacagagcgacgctctgtctcaagaaaaaaaaaagaagaaaaagagaagcctcactgtaacagagaatctaggctggggtcaaattaaagtagttgttgtttcttttcctctgtggctccagaagttatcctgcggaaccctctcatgtttttctgttattcttcattccaatttaagaaggggagaatgagttttaatatataactcttgattaaatggtatcccaaatttatagctattgagaccaaaagaggtaaactgaattgttcaaatcaaaatgtgaagccaggaatctgcttttattcttactcattgctcagaacttatttcatctataaatcacataccctgggaacgttgcacataaaacaaaatcttacttgatgcttgtgataaagatgggtattaaaaaaaaactttgaagttttctggtcttcaaaaaaagatataaaattaagtcagagctgaaaagaaccctaatagaaggtctagttcatggtgcttactttataaatgaaaaaatacactattatatcttagaagtcaaattttagttctacaaatgaggttctggaaagacccatgaacaagtcatattaaatgccatttaacatattttgctttcatttaaccataattatgcttatctttttttggatgttgttcattcaaaagataacgttttgattaaaaaaagaaaaagctatcaactataacctaaataataaagtaaaataaattttaaagtctgagatgttatttcttaagcacttctctttaattcagtatgagacaaggatatatattgtataaaccaagggaaagtttacgtttaacccattcctcagaaaacaggaaggtttagagagaaataaaatactctaagcatgattttccctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactgggtgagttgtagtttttctaagatgagtcctgtagaatattggaaggatatcactggccactaattgtcttgggttatccttattctggacactaaatgtagttttcgaatacaatgctcccatatttaagtgatcagagtagtgcaggctgcttggtgagaaaaggagagaagcttttttcagtcaaattaacaactccatgccttacctcaaaagactggggtcactaagcaaactactctgtccatacaataggagtttgttgaaagtagttctaagaatctaatttggcaaatacagtaataagaaaaataaaaatacatacagctcttgtatgcatttccatgttcacctgactatttctggcagtagggcagctgttactttagatactttattttttaaagtataccattaggtctttgagagctagtgagatgcaaatgttagatggtttgacctctaccgtgttatagcaagctcattgcaaatttagataatgagagtttataaagaaccctccagtgggctctgaatctgaggatctccctccttgattcacagggtcttgttggtcaccagccaaacgccatttacactcagtaagaaacctaatgaatcctgcagaggactgagatcctcagtctctcagaaaggagggaatgattttcattttcccaagatctcggcatcactgagagataagaaggaatgaaagctaaggtcctatagaagatgggggatgagggctaggccagtgaaaatgacaacattttcatgccagcttccatcctaacaggaatcccagaaaacagaaagagagaaattagctgcgtgattgagagacaccatagtgtgataactgccttggatactggggtttctttagccactgcataggtgcccctgatgtgatgtctcagacattgtctcctcttgttttccttttggcatgtcccctaagttaaagatatttaattattttttcctgtttattttctagccctttttttcctgcagaaactcttgtcttttacttccttacccctctgtcactttgggtgatatgcatagcttcatataatctagggtgtttgcaaaaattttttatgttagtaaccacttgctacatatgaaaagacttatgtgtagaaatattgcttattatgagtgtatatgcggctttgtgcttacatatcacattagtcttcaaacgcttttgtgagtttatgttaacttgattcagctaaaataacaggagttcccaaataatagatctgtatcttcaaacaggttcatttagttttttgagcctttgtaataaattttcaaacacaatggaaagtacagtgaacacccataaactcactgactagatttatttatttattttatttttaatttttttttttgagacagagtcttgctctgtcacccatgctggaatgcagtggcgccatctcaactcactgcaacctccacctcccgggctcaaggtattctcctgcctcagcctcctgagtagctgggattataggctcgcaccaccatgcctggctaatttttgtattttttgtacagatggggtttcaccatgttggccaggctggtctcaaactcctgacctcagaatccgccctcgtcggcctcccaaagtgttgggattacaggcgtgagccactgtgcctggccttgactagatttaatagttgttacagtctgctatatttgtgacattttttctgaagcattttaaagtaaaatacatagattatgatatttcaccccaatctacttcaatatgtatcctaaaaatatgctggggccagaatttaaaccaaagcctgacactaagtctatattaaagcttgcctaacaccagtatcttttcactactggattttgtcattgagccaggaaagaaaaagatataaaggagaaaagtaaacagggaccgaaagcaagatttgtgtggtctcctgtaagtttacctctcccccgacccctttttaaaaatgttttaccttttgtgaactataattgaattttggaaaagaaaatacactactacagttttaaaagtcaaatcccaatttaagaaaagaaataataccctactttgctttttcatgttttctttcagggagcctttcattttcccacggtgaacaaaggaaaggagttttcctgtggacgtttcctagccctggttggccagaggcctttgttcttcacctatcaggagtgcagagcagtgctcctggcggagctcaactccggtaagaccaacctcattctcacccaagaaattctctgaggaataatctggaattcatccatcaaaacagaaaaaggcacaagggttattctccttgaagcaaacacaaacatagttttagtgtagagcatcacgtggcgtgcatgctggagagggaggtggctcttaggagccccaccacccactgtttgctctaaagagagctcctcatgccccaccttgagaatggggtctggggtaccatctccactaagagccatgatggcagttctcctcttgttaaagacagctatcttctgagaagctgaaaatacctgattgccccaagtgattaagagtaagaataagattaagtaagaataagacatcacagtagggtgataatattacttatttggaccagtggccctttgactttaatttaattttattgaattttactatgtatctataatgactgtttctgcaaatacagtatatttgcagataaatacgtaccagccaaaagcaatttactttccttatttctgggatagactcgaccagagcagcagagggcagacctgctattcagacttagggatttagtcctggctctgccacttactcgctgtgtaactttgagaaaattacttgatctttctgttcttcagtttacttgtaaaataaagaaaattttggggtatgaaaactagagtgtattcaagtatgtttgtgtacatgtttatgtgtgggggatctccattggggaaataaaatatgactttagattatacatatgccatttttaaaatgttcatccagagaacatattttagggttacaaattcaaatgctttaacagcaacaatagttattaacagtattatagtgcttggccaggcgtggcggctcacgcctgtaatcccaacactttgggaggccacagcaggcagatcacctgaggttaggaactcaagacaagactggccaacatggcaaaaccccatctctacttagaatacaaaacatcagccaagtgtgatggtgcgtgcctgtagtcccagctacttgggaggctgaggcaggagaatcgcttgagcccaggaggcagaggttgcaatgaactgagatcgcgccacagtgctccagcctgggcaacagagtgagtgagactccgtatcaaaaacaacaagaagtagtattatagggcttaccctaggccaggcataaatgtttttttttttttgagatggagactcgctctttcgcccaggccggactgtagtggtgctagctcggctcactgcaagctccgcctcccgggttcacgccattctcctgcctcagcctcccgagtagctgggagtagttgggacgacaggcacctgccaccgtgccctactaattttttgtatttttagtagagatggggtttcactgtgttagccaggatggtctcgatctcctgacctcgtgatccgcccacctcggcctcccaaagtgctgggattacaggcgtgagccaccgcggccaggcataaatcttacagtgcttactctaggccgggcataaatacacacacacacacacacacacacacacacacacgctctgtctctctttactctccccagcaaccttacaaagtagattatattatttgtctcattttatagatgacgaaagtcatagatagattatgcgataaacccagaagcacacagttaatatatgttggggccatgatttcaacccaggctgaatggcctctgtgtgaggtattaaccactgttttatgtactgagtgctggctgcttgacaagagagagtaatgggacctgaagaatcctccctaaaggcatttaaatttatattaaaaccaaaaacttgttagcaaaagaaaataaacctgtagacagaattaggccgagagaccagcagttgtaacctctgatatagctattaactcacaacaaaaatctataggaaaaaaactaagaataaatgattctatcatgggtgtctgtcctcattcatacataaagttttagccacatttgcatgagaggttagttccattactggcagctgaagaaagcaaggattttactgctagtgccagtaactatttctatttggtagataacaaagctggcagaggtccagaacattgtagtaatattgttccccttgtactgatcctaagagagagcctgattttcacatccctcagacagctgctctgggatgatggagaaatagaccagagacctataagcttttcatttagctcagacttgttagttcctgtccctgcttttgcagctcctgttcttacatttcttttgcccttacatatcaataaatagggtttgatggaatttgaaatggcacgtcattgttaagttgctgccctcatgagcagcattttaaatatgtgaatgatgaatctctacagtcatattcctattttttaaaaaatcaatttcttcatgatttaatttttttcccagatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacaggtatatctttgaaatgatggagataaaaatatacttttatggtacataatttgtattaaggtgaatctagcttaaatttaatggaagaaggtgaagttcttaagttattcataggaatgcattaaagtgttgtttttctgtagcatggacccatgacatgaactcatgatgtgctgttctgagggccctataatttaatgtactataaatgtcactgagatcagagccagtaatacaatctataaatctatactctcacaatataaataacgtttaatttaatcatccaaacacatgattgcctatcctgttttgaaacttgattctaaatttaccagctactttcagtaatccatcctaaagtcaaagatctcattggcaggaaattcttttttttttttttctgttaccaaaaagatttaaactgttgccttttgttttgcttttgacccaatgtagttgatatagccatcatactattgtgtatatacgttacaatagcttaaaattttaataatttttttgtttctcatgtatcttatgcaatcttttcatgacagtttgcagtttacctctgaaatcatactgtatttttttttttttttttggagatggagtcttgctctgttgcccaggctgtagtgcagtggcatgatcacagctcactgcaacctctgcctcccgggttcaagcagttctctgactcagcttcccgagtagctgggattacaggcacctgccaccacgcccggctaattttttttatttttagtagagacagggtttcatcatgttggccagctggtcttgaactcctgacctcgtgatccacctgcctcagcctcccaaagtgctgggattacaggcgtgagccactgcacccggcctgaaatcatactgtatttctttaaatgaaatacatcagcatgtcaataccttataggaattagagaagtgacaggctatctcatgattcttttcttttttcattttcatgttttattgtaaagtgacaacttataattgtacatatttagagggtacaaggaatgatgttatgattataaatgcagtgtagaataatttaatcaagctagttaacatgtacattacctcaagtacttaactttttttatagtgagaatatttcaaatttactatcttagaaacttggaaatgtacagtactctatattaaccatattcaccattctgtgcaatagacctcaaaacatatttttgagatttgatgcttcctagagttcgtattttattttagccactcagttttaattcagtcataattttgcaatcttttaacttcctttcatatgctcagcattatctcatttatgttaacctacaaatttacatcaattagtatgatttattcctgtttctacagtttatgaagtgtgttgtaaattcttattctattctacaagttatttactgattttgattcaaattggcttaatgccatttatatatttctattaaaattaatttggtagctgggcacggtggctcacacctgtaatcccagcactttgggaggccgagtcgggcggatcacgaggtcaggagatcgagaccatcctgactaacacggtgaaaccccatctctactaaaaaaatacaaaaaatttgccaggcatggtggcaggcacctgtcgtcccagctactcgggaggctgaggcaggagaatggcgtgaacctgggagacggagcttgcagtgagcccagatcacgccactacactccagcctgggcgacagagtaagactccgtctcaaaaaaaaaaaaaaaaaaaaaaaaaaaaaaaatttatttggcagtcagcatcctccttctcattctaatagagacacagatattttattacaggtatttgaatataaccagggctgatagtaaaaatacttaacaattagtttggcactggccaggcccattaaaatggcttctggaggttctttgctgttccaagccatactccattaattactggatcatggggaggtcttgttgtcctggttagggaagtggcagaggactctttaggggctcaggatagaagttaggtaccaactggaatggaagtgcttccctgttttatcagacaatatagcctaccagtgcctaccccttcatcagctctgagcttagttttaactcaacaggcaaatggtaactcagctgagctctgtgagattctgtaatgtttaccttccctacataaggcacactcatcacacacctgttgcaaatgaccgataccctaccatagctaccactaatgtcgtatgatgtaattggcctgactacaccaccaggcacattcacgtggtcataataccttaagttcctttacctgcaaatgttgccctcatcttttccctacctgacatttttttcttaataatatttctcacttaaccggataattaattttgctgcatccacctacctttataatcttttcacatttagattttagaacaaactttctgagtaagtcagggaaaaaatagtttatttagttttgattttgatcattggcacattacaagtctggaatcattttactagaaatttgaaatcaaatttattattgtaaatgtgacaagggaagtgttttttcattagaatcatgctagttgctattgccttggaaaaggaaatgagggttctgctgtgatagtcttgtaatctacttgaagagcccaaatcctcacttaaggtgacaagaaaagaattgctgccaaagataaaaagtcaatgtcagattctgataccaggctacgaagtgattgcagtgattaattggtgaggatgagaattggcagtctgaaacaaaacacacatgagaccctaggacaaatgtagcccatcacttgcatgtccctaataaaggggctccacatttactttaagaccagggaaatggtccaggggctgatgactactagttcttccctatcaggacagttcagtggttttctgtttccttaacccaacctactccctaatttcagaagttctgtctccttagaatgccaggaatcaggtttcagggtgatgggtacacatgataatatggtttggctctgtgtccccactcaattttcatctccagttgtaatcccccaaatccccatgtgtcaagggtgggatctggtgggagattattggatcatgggggcagtttcccccatgctgttcttgtgatagtgagtgagttctcgtgagatctgatggtttaaaagtagcacttcctttgctgtctctctcctgccaccatatatgacgtgctttgcttccccttccaccgtgattgtaagtttgctgaggcctccccagacatgcaaaactgtgaatcaattaaacctcttttgtttataaattacctaatctcaggtagcatctttatagcagcataaaaatgaactaatacacatggttttcgaggccaattgctttaggatcattgcttctaggaccaatgcaaaacagggccatggagaatagaaagcagtcagaactatgcagtggtatttctctagtctgagaagctggcttagttgctgcctagggtttgaagtgatgatttctgtatagtatgaaccctagttttgttccagtttaaacatttttttttttagtataatggtacccgtaacctcaagtgttgcttaggaaagtttctgataccgagatgctcaggagttccttaatatttctgttttgttctggggcaaatagcttcatggatagcatagagggtcttttaatcaaacgtcttatgtgaaggtaaatccgttgaacagagttcatttatttgacaagtatttattcaacacttactatatgctcagttctgttctcggagctggggatacagtagcgaataaaagttgatgctctagtagggcttacattctgtgagggatatatagccttaaaacagataaatatctaaaatttcaaggactgtcaaatgtaaagtaggatcttaatagaaaaatgaatatgtgtgtgtcagggggaaagagtgggatttgatgttttatttcttcttttcttctattcccagttagacaccttgatgttatcacagtttagtttatttttaataaagatcttttaacaactgtagctctcctcaccacctgtgaatttctcacttttaaaccatctgagctggcaagattagtggagcatgggaggtcttttaaataattcttgaatatattatagccctccattctttttttcagggagtgaccttcacaatggcatcataggattcagtgaggagtcccagagtggactagaactcagggaaggagctgttatgagaagattgcaccttattgtcacaagacagccaaacaggtatgtgtatatatagtatatggaagacgtaacattctgtgtgtctgtacaaatgtaatttcaattcatacaatggtggagggcagggtaagatagaaggaggtagtgtcgaatttggcacgtcttcagatgctctagttcttaatttgtgattatggtacttcgtttatgatcataacttagggttaccttgagtgttttctacttcatgaagtaccatacaaatatcagactatgtaggtcatcacttcatcatattgcctattatctgctcactctacatacataccattttcctgtgatgaaaacttggagtaccaaaactttgtttgcaacttaaaactgtatagtagcatctttagatgctcatcacatacacgtgcttggtatgcacacatgcacatgtgtatatattacattttccattttgggcctaaataatctgtgagaatgttggtctccctttgccctattttacaatagcaaccattatgagtggaagtgttgtttctttagaaaaatcctttttaaaagagaaatgaggaacatttacttgcctttaggacctccctataattctcattttcacattttttggacataatagaaaaatatatttttttaattttctgtttttttttaaattttattattattataatttaagattttttaaattttattattattatactttaagttttagggtacatgtgcataatgtgcaggtttgttacgtatgtacacatgtgccatgttggtgtgctgcacccattaactcatcatttagcattaggtatatctcctaatgctatccttcccccctccccccaccccacaacagtccccagtgggtgatgttccccttcctgtgtccatgtgttctcattgttcagttcccacctatgaatgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatctatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacaccctttccagcacctgttgtttcctgacttattaatgattgccgttctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattgtctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctgtgtcctgaatggtaatgcctaggttttcttctagggtttttatggttttaggtctaatgtttaagtctttaatccatcttgaattgatttttgtgtaaggtgtaaggaagggatccagtttcagctttctacatatggctagccagttttcccagcaccatttgttaaatagggaatcctttccccattgcttgtttttctcaggtttgtcaaagatcagatagttgtagatatgcggcgttacttctgagggctctgttctgttccattaatctatatctctgttttggtaccagtaccatgctgttttggttactgtagccttgtagtatagtttgaaatcaggtagtgtgatgcctccagctttgttcttttggcttaggattgccttggcgatgcaggctcttttttggttccatacaaactttaaagtagttttttccaattctgtgaagaaagtcattggtagcttgatggggatggcattgaatctgtaaattaccttgggcactatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgatttttgtacattgattttgtatcctgagactttgctgaagttgcttaccagcttaaggagattttgggctgagacaatggggttttctagatatacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaaatcggctgtgaatccatctggtcctggactctttttggttggtaaactattgattattgctacaatttcagctcctgttattggtctattcagagattcaacttctttgtggtttagtcttgggagagtgtatgtgtcaaggaatttatccatttcttctagatattctagtttatttgcgtagaggtgtttgtagtattctctgatggtagtttgtatttctgtgggattggtggtgatatcccctttatcattttttattccgtctatttgattcttctctctttttttctttattagtcttgctagcggtctatctattttgttgatcctttcaaaaaaccagctcctggattcattaattttttgaagagttttttgtgtctctatttccttcagttctgctctgattttagttatttcttgccttctgctcgcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttccagtttgattgcactgtggtctgagagatagtttgttataatctctgttcttttacatttgctgaggagagctttacttccaagtacgtggtcatttttggaataggtgtggtgtggtgctgaaaaaaatgtatattctgttgatttggggtggagagttctgtagatgtctgttaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttttgaatctgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttaggggtgattttgctcattagttgatgcagtttcttcttagtctcgatggtctttacattttggcatgattttgcagcggctggtaccggttgttcctttccatgtttagtgcttgcttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctatgagggtaacccgacctttctctctggctgcccttaacattttttccttcatttcaactttggtgaatctgacagttatgtgtcttggagttgctcttctcgaggagtatctttgtggcgttctctgcatttcctgaatctgaatgttggcctgccttgctagattggggaagttctcctggataatatcctgcagagtgttttccaccttggttccattctccccatcactttcaggtacaccaatcagacgtagatttggtcttttcacatagtcgcatatttcttggaggctttgctcatttctttctattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttgtacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatgatgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgcttcggggtcaggggtcaggcacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcctggctgctttgtttaaataagcaagcctgggcaatggcgggcgcccctcccccagcctcgctgccgccttgcaggttgatctcagactgctgtgctagtaatcagcgagactctgtgggcgtaggaccctccgagccaggtgcgggatataatctcgtggtgtgccgttttttaagccggtccgaaaagcgcaatatttgggtgggagtgacccgattttccaggtgcgtccgtcacccctttctttgactcggaaaggaaactccctgaccccttgcgcttcccaagtgaggcaatgcctcgccctggttcggctcgcgcacggtgcacacacccactgacctgcgcccactgtctggcactccctagtgagatgaacctggtacctcagatggaaatgcagaaatcacccgtcttctgcgttgctcacgctgggagctgtagaccggagctgttcctattcggccatcttggctcctccttcatgtggcgttatttctgagggctctgttctgttccattgatctgtatctctgttttggtaccagtaccatgctgttttggttactgtagccttgtagtatagtttgaggtcaggtagcgtgatgcctccagctttgttcttttggcttaggactgactcggcgatgcgggctcttttttggttccatatgaactttaaagtagttttttccaattctgtgaagaaagtcattggtagcttgatggggttggcattgaatctataaattaccttaagcagtatggccattttcatgatattgattcttcctacccataagcatggaatgttcttccacttgtttgtatcctcttttatttcattgagcagtggtttatagttctccttgaagaggtccttcacatcccttgtaagttggattcctaggtattttattctctttgaagcaattgtgaatgggagttcactcatgatttggctctctgtttgtctgttattggtgtataagggtgcttgtgatttctgtacattgattttgtatcctgagactttgctgaagttgcttatcagcttaaggagattctgggctgagatgatggggttttctaaatatacaatcatgtcatctgcaaacagggacaatttgacttcctcttttcctaattggatgccctttatttccttctcgaaaaatattatttgtttttacattccttatacagagtattaggatacttattcattgttgaatggagtgtattcaaagaaaaccacataagccctgaggcttaatcctcttatctgtagtgaggaaaattggtcattttctgcatcatcagtggtaaagtaagtgctatactttggatgaagaggtaccatttggtatactttggatgaagaggtaccattatttgataataaactctattagacatggggatgacaccctctgttaaggcattggtgggtttcttgctcacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaagaaatgaagagacacactagtgtcaacttctaattatatttctttagaattaatcattttaaaaccactattgaaacttacacattgttgatagggagattctttgtgtttttcttagccataatgtctaaatctctttgccgacaacaggctttagacagacttgattacattatggtattttgtaaataaacttgtcatttttctatttttttgtttcttgccattctaaaataacaaccatgtaggtttaacttcttttatttgtattcttggtacaattctttccttttctagaaataaatgtcttattcacaattctttttgttagccccttcctacttacatacaaagaaaaaaatgtttatcattgcttaataaatgaacacatgcttaataaaagacatgtcgatatgctaactcttctacacattaaaattaataaaatattaagtatatgctgttagaatcacatttatcttgcatggtatctcttttttatattacaataacatttctttcagtatcactataaattcaaattcaaataatttttattacttactaagtgattttctttttggtattcaaatagtcatggcatggccactggtagtcttattaagctggtcttttgtcttttcaatattacttttaaaatatctggaagcatacttgctttatagcaataacaaatattctagagctgtcttgattttttccctgatgtaagacagccaattaactagtgtcaaaggacttgatttctttgatcagaaaggattttagagatctatatgtatgtactacagctatataggaaagttgatgcaggcaaatgtgttgctgttgtggccaccttggtggtggtagtgctggaaaatatattttccttaaagcctggaatccccactctttttcgtagtttagcatatcacatcattgttttttgcttttcttgagtggagttatcatcagctactaaaactttctgtcacactgacaatgaggaactgaaatttcaatactcaagacatttgatcatatagtatgtcctcacttcacgtcctcaataggctcttggaaactgcaactttacgtgaaacaatgtgctgtataatgaaaccaattttaccatagactaattgatgtttatatcagttaaacagttgacttcctactgcacacagtatgtcctttcatttaaagttgctgtttccaagaacctgtcatggttaagtgaagacttactgtattctacttgaatttaaactcttcttcatgcatttcttccaaatatttttatgcttccatcaaccctctcaaccccatatttcttttttttttcttttttgaggtggagtctcactctgttgtccaggctgcagtgcagtgctgtgatctcggctcactgcaacttccacctcctgagttcaagcgattctcatgcctcagcctcctgagtagctgggattataggtgcacaccaccatgcccaactaatttttgtatttttagtagagacggggtttcaccctgttggcctggctagtctggaacttatagcctcaagcgatccgcccaccttggcctcccaatgtgctgggattacaggcatgagtcagcatgcctagcccccatatttcttaactatagctttccgttaatcaaaataccactttctccatgatgcctcccatgaaacctctagttggagtcgttgattctctaaatttataaaacattatctgttcctttcctatggaaattatcagttatatgcagtgttacaacttatgcatagtttatatagactataagactgttagctgttcaaaaattagaatatggttttgcattcttcataaatatgttttgcatacatgattactaaatattatattgtgcattttatctcaaataggatttttggtgaattagaatactgatacgatctcactaggctttaaacatctgtctcgtacagtagatgttaaacttgtaattctaagaagagagaggagaagagccattaggagtgggcttgggcaagctgaataaagagaaataggaaagttaaagtataggtggggttagggtagactacttcctctgagcttgccctccttgcagaagaatatataattaaggggtaagaaaatgttgtatgcaatacatgggatgctaactgtatatatttgttttcctaactagagaaatgctactgagcccattatcaaaagtttcagttaggtaagagaaaaaaattagtcacacctcttctttctctttcacatatgatattcaaatcgtagagttttcttctgcattctgagaagcagctaattttcaagacattttttccctcattatcttttcacctgttaaaaggcaaggaacaagcaaggttaatatatattctagtttcattaagaggaaatttaaaaagagagaagatggaagatgattattttctcatgaaaatgaaaaagtgtttttcaaaaagtactatgaacttttgatatacattttaacattttacatgttattagtagaagggaatttattactcatccagttcaaattattattatgtcagataaactgagacctaatgatatacacaatacatgttctgtgacaatattcttctgtagtgggctttgagaaattatttggaggtcctagtagagccacccaattattgctagatttttgacctaagcaccatcttcttcattttttgtcaaaggaaagacatcagttacactgaacttattcttggagtcactggagtcagtttaagagttagggttctgataatggaagactttagttcaaatattaactcttctaccaattagctgggtgacattggacaggttgcttagccttcctgagcctcccaggtttaacggggttaataacagggctgtgaggcagataaagaaaataatgaatgagaagttcttagcacagctctcggcagagttggcccttcataagagatggtgagtattgagattattcagaatggatggagatggagcccgagggaatgcaatgacttgagtaataactacatcaacacaagtggtagaagagttacagatattgcagacacaacaaatgcatccacagaattacaccactcattaatggcagtgtccctcacctcaatccagtctattggcactcaaagttttttgactctgtcctatctcagattatcatctctacagtttttcaatactttcacttttgaattatgaagaatttaagtaactcgcccaattcaattactgggccaagattagaactcatctcttgaattccagtccatttccccttttcctgattatttatcttatgattctatattagtaaaatgtaaaaggtaacaacttaggaagcatgctcttaaccacaaaatctgtttgaatccagtgtttaaatatttgttgcaaatattttcaaaaatatttaagtaaggtattgtttcattgttactttggtttttctattgctgaatagttctggtccctggaaaaatcatcttatactagttagggcaaaagatcatcctgggatgcttctgacctaaccaggaaaagaacctgctgggaattacacatggaatgggctcttatgaggtctctgtcatttttaggagtctagggaggttcacatatgatctgcaagtcttgatttctcattagacttcagaaatattgtttcaatagagtgtttatttctaagacttgaagactctttatgttactagtctaatgatatgtaggcacccatctttacactgttcaatttcagatgattcttaacttagattataacatattattttgtttgtaggtggctataagtatgttctaatcatcgtcacaatgaaaaaggaatatttttctagaaaataaaagtctgttggaatgtaatataccgaaatccttagttaaaagaaactactttgaattcaagctcgcttggccatactaggtcttgaatatagttactatactttgatagtgctttagtttattgtatttgccaaatgtagtttctcaaaagtggacacagtacaattatttccatatttcaatatcaactgacagttaatcagcaacagtaaagaatgatatgtgccacagaaaaaactaagtatttcttcagaaaacaaaaggagattaagttgatttatgctataactaagatataacttacttataaacacttggataattctgaagggttggttgtatcatttcatgatgtaatagttatcattaaaatggtcacaaaacataatggtcattgctggtaggtaaaaatgatacattatatcaaattagacaatgtcactgcagttgtaaaggcatcagcttagctcctttgagttatgccagatgggtaacaatattgctaagatttgtggatgattttgttaagagtgaatcattagtaaaaacaggtgattgccaatatgttataaaattgaattcaggctttagaaaataaattatttgagactgttgagaaggaaccaaggtgaaacatgagcaaactgtaaccagcagactatatttagactatatactgaattttggaaaattttgaaaaatacataaaacttcagaattgactattataaatatttgattatatttatttaaaacactttaaaaataaaagaaataaaaatagaaccttacaaaattgaagatccatttttttccccctcctcagtaatattctccaactccactccctgccctgtccccacccaaaccctccacccaaggcaactgctgtcagggtgtggtagttaaaaaagaaaactttacataaatatgtatctattaataaaatatagtaagctttatgtagttttaactttacttttatggtatcattctatacatatcattatacagcttgatattttcacttactgtcatattttgagatgcatctgtgttaaaaaacattgaattagtttattccttttaactactttatagtgttttgtggtatgaatacatttaatttatttttttgctgatcgtagtaaacataggttgtttcctgacattgattttctagtaagaagctcgcccagagaaagtaaatgtatttttaaagaaagaccaaaaataaatgtcatgataatctaagaatttaattccgtaattatacagaatatatctctagatttatatatttatttctctaaaaatgtatatgaattatacaatatttaaatatcagaactatctacagatagaaatatattagtaatagttgtttttttttcctttttctcattgtcaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggtaagcatggaatatatatattcatacacgttatggttttcttctttaactacagcaagagtaatgacatagggaataattgatacattattttctgaggataacatcgtaattcactttttattcattacattaagctttatccttgaaacagctcagcttttcactcatcagtaacagatcatgttttaaaacgacagacttcttttttctctcttttgacaagattgattatacagtgcaaactatcttacataaatctgttttataaaatctctagggagttaaaatttcttcagaatgtaactgttgaaggccagaagcagaaagtgaggatcttgttatgttttgtttccaaaacagttgaaaattttctttttcagaacctccaacactagctgatctttacacttcttcaaatccatgtgttcacaaagcctcactgccacttttttcacatccatcctcttaggtgacatcagataaaagacagggaggctatctggggactcagaagatcaatgctgcataacactaagtcaccagaccgtgggcttggccccaacaataccatatacctttcagccttatttttttgcttttgttttagcagtgaaactctaatatagtaaagcaaaaatctgtccctactctgcttgaagtatgattgttaggatcatagctgacccaccttagtcctctctttgttccccttactttatataacttcaggaaacccactatttgaaaactgccattctggacagctcttctatttccaatgtttcaagattccaaaccagatgaatccttgggccttaagatttcacagtttcattaaaagttccctttagtacctgcctggttgtgtcaccattgggtggctcaaacaggacattctgtgcataaaacagaacatatgtgtggccagtatgttgtagcagttacatgagtcaagatgagagaataggcctcaagctgtggatattaagccgttctgaaagtttgccaggcagtaaaacttatctttacgacagagtccacagtgcagcaaacaaaaagaaaactccctattatatgagaccctagaaataaagtctattctaaatagcacaaagtgaagtatgttgatttacagtaggaagacttgagtatttttattggagtatttaagatagaagataaattatagaagtctgtttcattcttcctcttctcccataaaatgtatatcgttataacttactactttggagaatggaagaagggggactggaaatgaaaaaccagatgataaaagagatttgaggcacatcttaagcgagtttatgtgctcagtcagatgagaggggaattgaagttgccaaaagaagaatctgaaggccagcaactctatcatatttatttatatgttttctagattcttcataagtgattctttgcaaaatgcatgctgtcagtagtgtataactcataaagggcacttatttatggaacaatatatttttaggaatttccagttttccctactgaaatggttaattttatatgtcaacttgactggaccacagagtacccatatatctggtcaaacattattctaagtgtttctgtgagggttattttttggaatgagattggcgtgtaaatcagtagactgagtaaagcagattgccttcataatgtgggtgagcctcattcaatcagtcaaagtcctgaatagaccaaaaagcctggccctcctttaagtaagagagaatttttcctgtctgataggctttgacttggaataatggctttttccggtctctggactcaaaatggaacattggctattcctgggtcttaagcctgctggcttttgcacgggaactacaccattggttctcctagttctcaggccataaggcttgaactggaactaaaccattgacctcctttggtcttcagcctgtgaaatcatcctgcagatgatcttgagacttctcagcctccataactgcatgagctaatttcttaccttataataaatctctctctctctctctctatatatatatacacacacacacatacgtatatatacatatatatacacacacacacacacacaaaaacataagtacacgcacacacacaccctattctgaccctgaccaataaacatcctaccctgcgattataggcttagtagagaatgtttgtggcagtgcattaataccagtatttttattttttaatttttgtaggtacatagtagatgtatatattaatgggatacatgagatattttgatacaggcatacaatgcataataatcacatcaggataaatggggtatccaccacctcaagcatttatccttcctttttgttacagataattcaattatacttttttagttatttttaaatgtacaataaattattgttgactatagtcgtgctgttgtgctatcaaatactagattgtattcattctgactattttttgtactcattaaccattctaacttccctcaaccccctctgccccaccgccaccaccttctcaacctttggtaaccatcattctactccctatcttcatgagttcaattgtttcaatttgtagttcccacaaataagtgagaacatttaatgtttgtgtttctctgcgtggcctatttcacttaacataataacctccagttccatccatgttgttgcaaattacaggatctcattctttttaatggcttaatagtactgcattgtgtatatgtagcacattttcaatatccattcacctgttgatggacactttggttggttccaaatcttgactgtggtgaatagtgttgcaacaaacatgagagtgcaggtatctctttgatacactttcttttcttttgggtatatccctaggatttcctttcttttgggtatatacctgggagtggaattactggattatatggtagctttatttttagttttctgaggaatctccaaacttctccatagtggttgtactaatttacattcctaccaacagtgtatgagggttccattttctccaccttctcactagcattcattattgcctttcttttgcataaaagccatttaattgaggtgagattatatttcattgtagttttgatttgcatttctttcatgattagtgatgttgagcaccttttcttatccctatttaccatttgtatgtcttctttagagaaatgtctattcagatcttttgcccattttaaaattggattattacatttttactcatagagttctttgagctccttatatattctagttattaatcccttgtcagatgggtagtttgcagatattttctcccattctgtgggctgtctcttcactttgttgattgtttctttggttgtgcagaaactttttaatttgatatgattccatttgtccatttttactttggttgtggggtattactcaaaaaaatctgccagtccaatgtcctagagagtttcctccaacattttcttgtagtagtttcttagtttgagatcttaaatttaagtctttaatccatttttgttttgatttgactttctgtgtatggtgagagatagggatctagtttcattcctctgcatatggatacccagatttcccggaaccatttattgaagagactgccctttttccaatgtacgttcttgtcacctttgtggaaaatgagttcactgtagaagtacggatttgtttctgggttctattccattctgttccattggtctatatgtctgtttttatgccagtaccatgctgttttggttactgtcactctctagtataatttgaaatcaggtaatgtgattcctccagtttttttctttttgctcaggatagctttggctattctgagtcttttgtagttccatttaagattatttttcctatttctgtgaagaatgtcattggcattttgataaggattgtgttgaatctgtagattgctttgggtagtatgaacatgttaacaatactgattcttccaatccatgaacattaaatatctgcatttttgtgccttcttcaatttcttgcatcaatgtttttcatagatttgttttggttttttgagatagggtcttgatcttttgcccaggctggagtgctgtggtgtgatcatggcttactacagccttgacctcctaggctcaagcaatgctcccacctcagcctctcaagtagccgtgactacaagtgcacaccaccacacctggctaatttttgtagtttttgcagaaatgggattttaccatgatactcaggctggtctcaaactcctgggctcaagcaatccaccaacttcagctatccaaagtgctgggattacaggcatgagccaccatgcctagccagttttacagttttcattgcagagatctttcacttgtttggctaagttaattctcaggtattttattttacttgtggctattgtaaatgggatttttttaattttccatatggttcactgtcggcatatagaaatgctactgatttttgtatgttgattttaaatactgcaactttactaaatttgtttatcaattgtcattttttgttgttgaagtctagttttttccaaatacaagatcatatcatctgcaaacaaggataatttgacttcttcctttccaatttggatggactttatatcattctcttgtctgattgtcattaaaataattgccatttaaaataattgtcattattttaaaatgatgtcatcttattacagattgcataaacatacaagtgaactaacaaacaagcaaagaggaaacgaataaaaatttgacacctaaactttgtaccccactttttaactttttgttgtttctatttatatcttattatatactgtctatgtctagaaaagttgttgtagttattattttttatccgttcagtgtttagtctttctacacaagaaatgagtaggttacacaccaaaattacagtgttatagtattctgtaattttctgtgtccttgctattaaccatgagttttgtacattcagatgatttcttattgcttattaatatctttttcttttaggttgaagaacttccgttagcatttcttgtaggataggactggtgttgataaaatctctcagctttgtttgtctgggaaagtctttctccttcatgtttgaaggatattttcgcttgatatactactctgggataaaagtttcttcagcacttactaaacatgtcatgctacactctcctggcctgtaaggtttccactgaaaagtttgctaccagatgtatgggagctccactctatgttatttgttccactttacttgctgcttttaggattcttttttttttttaaatccttaacctttgggagtttgattattaaatgccttgaggtagccttctttgggttaaatctgcttggtattctgtaaccttcttgtacttgaatactgatatctttctctacgtttgggaagttctcattattaaccctttgaataaactttctccttctatctctctctttacatcccctttaaggccaatacctcttggagttggcctttggatgatatttatagatcttgtatgcatgtttcatttttattcttttttcttttgtttcctctgcctattttctttctttctctttctttcttttttctttctttctctttctttttctttctctttccttctttctttctttctttctttttctttctccttccttccttccttacttcctttctttccttctttctttcttattcttccaatccgtgaacatgaaatatctgcattttgtgtcttcttcaattgttttgcgatgtcatgttttcctggatggtcttgatgcttgcggatatttgtcaatatctggacattgaagacttaggtatttattgtagtcttcacaatctgggcttatttttacccatccttcttgggaagtttttccagatatttgaagaggcttgggtgctgtgatctaaatttttggttattgcagccatatctgcattagggggcatcccaagcccagtaatgctgttgctcttgcagactcctagaagtactgcattggtggtcttggataagatctgggaaaattccctggattatcaggcagagactcttgttttcttcccttactttctcctaaacaaaaggatcctctgtgtctgtgctgaacttcctggagctgccagagggttgattcaaggactcttgtggtcactgccactgggattgtgctagatcagacctgaagctagcacagcactgggggtctcacccaaggcccatggtgaccactgcataacatatatcatagtctaactaataaaaataaaggcaagaaaaatattgaaagaactgagaaagaaaagtaccttatctttagggcaaaagcaatcggaatgacaggagatttctcatggaaaaccatgggtcccaggtggaaatggcacgctatttttcaagtgccaaaagaaaagaccctccagccctaaattctatatccagtgaacatatctttcacaagtgaagaggaaattaagatattcccagatgaaggaaaaactaagaatttgttgcacacagacctaccctgaaagaatggctaaagaaagatctttaaacagaaagggaatgataaaaaggaaagaactttggaacatcaggaaggaagaaagaacacaataaacaaaagtagatttcaccagaaaggatgtacagatgaagaataagcatataaaatgatgttcaacaccattagctattagcaaaatgaaaccacagtgggatatcactagatgcctaccagaatggctaaaataaaatccatgacaataccaaatgctggtgagaattcacagagactggatcacttattcattgctgatgggatgcaaaatggtaagccactctggaaaacagtttagaagtttcttcaagaattaaacatgaactaccttatgactcaggagttgcagtcctggacatttattcctgataaatgaaaacttatgttcacacaaaaacttgcacatgaacatttatagtagcttattaataatagccccaaagtagaaacaattcaggtgtccttcaatgggtgaatagttaaactgtggtatatccatgtatggaacactcctcactaataataagaaacatactattgatacacataacaacctaatctccatataatcatactaagtaaaaaaaaaagctgataccaaaagattatgtactgtatgattccatttctataatattattgaaattacaaaattataggaatggaaaagaaattggtggttgccagagattaaggagggaatgggctggggtgacacgagtgtagctgtagaagttaacatgcagaattcttatggggatgaaaatgttctgtctcttgactgtatcaataacaaaatcctggttgtaatattatattacagtcatgcaaaatgttactaatgaaggagtttgggtaaagggtgtaggaaatctcctttattatttcttataactgcatgtaaatctgcaattatgtcagaataaaagtttaaacaattggaaatgacagtttcacctctctggtattattttattttcctgttgcttaattgcccttgtgttgttctctaagtgctaggcatattactagaagacagagacatacaattctcttttccagtagctggcatgaatgagaaaataattatggatcaagttgttattctgttatgatattgattttcattttactttaaatagattaatgcaattaaaacagtcattgtaacatagataccctttggtagaccagcattcccatgtacgtaagtactgtagccttagcatctgtggcttatatctaagtttgtgatataaagttaagaaggaatttctggtccttcctatttgagacaataaagacatctattattctagttatctttcagttaaatagacctatagctaaaaacaaatttgaaactgattccaaatactttcttttatatatgtgtgctagctgaaagcacacaagttcaagaaagaccatgtgttttccttattttcacgttgcctattccattcaaagactatttctatattgattttctttttttttttctttttttttttgagatggagtcttgccctgtcgccctggctggagtgcaatggtgcgatcttggctcactgcaacctctgcctcctgggttcaagctattctcccggctcagtctctcgagtaactgcgattacaggcacccaccatcatgaccggctagtttttgtatttttatagaggtgacatttcaccatgttggccaggctggtcttgagctcctgacctcaagtgatccacctgccttggcctccccattgtcacttttaaattgcataattcttctttgtgtttattatatgtattttataaacacaagaacattttgattgtttcatttcctttaaatatttgaactatgaaataaatcctgcgaaaaaacagtgggccaaatgtatacatacagtttttagtaatcaaatcactaccaccttgtttcagaaatttaactttatctgaattttagtataaaactttccattatgaacccctctgatgccatcttgctttttccttgactatccccaccttgcagataatttatatcttgaattttatgttaaattattcatattctttttaagtagttctattcttatatattatttgggtttacctgttttggaaattgtgcaaatgaaattaatccaattgtattgttctatggtccctgttttgttcaatcatatgtctgtgaactatccatgctgatgtgtgtacttgaaatcctttcattttaactgttatatagtatttcagggaatattttaatgtatccattctaaagccattagatttttgagttatttccttcagtaaggctttttattttatcgttacactgcagatgctcttaaaaagcattcattgattttttttttcattttttgacacaatcaatcacttcctccttcctgaagaatgctcttctttgggcttttgtaataacacaccttcctgctcttaatccttacctcacttggagctccttcctgttggctatgttggtcttcctagccagtaaatgttgggatccaccaagaatcaatctccaggctagactatatagaactgtttattaaatatcatctgtacactgaggacttccacatttttatcactaacctcatcacctctcctgatccagacccatgtatctgattgctcttacgtgatgtcgtcacttgaatgtctaagaggcatctcagacttactatgtataacagataactcttgatttgtcccttaacaatattttccccagttttccaccattcattatccatttacccattcatctaggcaagcagctaggagttaccttcacttctcctcttccttccacccaatatcaaattcatcagaaagttctattgactctaagctgagcgtagtggtgcaagcctgtagtcccagatacttaggagaatctcttaagcccaggagttggataccagccttgttgatatagcgagaccctcatctcgaaaaaaaacccaaaatgaaacaaacaaaaaagtcctattgactctacatttaaatatatttctagtctgagtgcttctactcatgtgtatttctagtctgagtatttctattcatgtgaccctatttattctaccactgtttcttgcatgaacgaatgcaaaaacctccatgctcattccctactatatcctaatatacacaatagccagaacactcatgaataatgataaataaaatgtgtcattctcttgcttgaatcctctagggtcttcctgccacattttgaataatgaacctacatgcctacatgatctgactcctatctacctctctgttttttgtttttgttttttgttttgttttttgttttgagatggagtctcactctattgcccaggctggagtgcagtggcataatctcagctcactgcaacgtctgcctcccggattcaagcgattctcctgccgcagcgtccccagtagttggaattacaggtgcttgccaccatgcccggctaattttttgtatttttagtagagatggggtttcaccgtgttagccaggatggtcttgatctcctgaccttgtgatccacccacctcagcctcccaaagtgctgggtttacaggtgtgagtcaccacacccagcctccacctctcttacagcagcatccagcactctccttctagtcacattggccttaggttcttccttgaacagactaagatggttcccatctccagtgcctttgtaattattctttctgcctagaatatttcccaagatccttatgtagcctattcatttatttccttgcagtctctgttcaaatatcacaagagcttctatgtccagttttatataaaatgctaccctttccatcaccgtgcattcccttacctacttttatttttcttcatagaacttgtcttcaggtaaaaatctatcattaattccacaacccttgtacaacctgtatcctctgctagaatagtaggttctatgagtgcaggtattctgctgttcaaatctatatccattgtatgtcacttggcttgtactaggagtttaatagttcttggctcagtagtaaataaatgcacattcctttgattcttccttgactaaagtgttcatgcttcacgttccaaaacactttttccaagaaaacttttcaataaccataatttgaagaagagcagaggtatatatgtccaggaccctactccttaggatatttccatatttgagtgtaaacatgaaaccaatttcttctacttctgctttcctcccctctgccttctctctactctccccagcctgccccccaaaatttctatgtgacagtgaaaatataaatattcctccttttcctgcatacttatattttaccacatgtgttatttgaagcacgattttcaatcacaattggagaaatggaggcaagagtgacatttctggtctaatttgcttccttggtccatttgaaggcatctctttcctaatctcatcactgtatgttatgtatttatctctctaatttatcttagcagattatgaaaagtataaaaccccatctttaggtagtactgtcatcatcattgcccttcagtttgtttaagagaaattgaatttgtttaagaaacaagaatttgtttaggacaagatcagaggtgtcatagattcacttaaatggtgttgtttaatttctaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaaggtaagtttttgtgaatattagtaatttgtttagtgaaattttgtaaatttaaaaacccaagtaaaaccaaaatcacattctcttttaacattggttattatgaaattatgataaatttagatttctgaacataggaatagaatgcatcatatctgacactgtcctcttccttggatatgactgatgcctctttggaaatctcagtcttaggcttggagaatgacctagtgcagtagtaaagacagcctagtgcatgaaaaaaaaggctccagaggttgggagctataggcagttggcgactctccagaaactggccaattaactttgtagtttgagcctcagtttttttagtccattaagaaaaaggacttgagctagattatctacatagtccttccagtttaaatgccatggaatagaaattatcaccctctgcttgttctttagtcctcacgggcactgaaaactttcacagaaaagaaaaattaagaaatgactagataatttcagacattccatttggtatatacttgtacaaaacagattttattttaaacctatttacttacaactctgcaaatgatggaattaaatggagatgtgagagcctaagaatataaattttgaaagatatctataaagttattacttaaaaaaaaagcctcctttggaggtttactttgggctttcttatcaagatatttcctatcaatatatttatatacaagaactgaatgttttgagtacatacccatgaatgtataattactacatctcttacataatgaccttaaaatactttagatgttaacaatggggttttagatagtcgtgcatactttccatccagtggtatctcttaaaatacaatgcttgaaagatagaaaagaaaattataaagtacagaggtaaaaagagcaggccatggcaaacatcttataaagcaaagggaagcgattgctatttcatgcagagaaaattctgcagtaaaaactcactccacaaaatattattacttgaattttctaatggcccaatggcgtaggacaatgccaagttgtttttggccagggaaagagaaagaatgtccagtaattacattttagggaaggaaacaggacctcacttcatatgatttagggaaaatatatggaaattctgctactttttgttctcaataagttatgtatgttaaccaagttattattggttaagaatcaacacttatttcagtagagttgtcagatagtacatcttgactgttactagtactatcgtgaataatacaatggaattataaaagtagctcctatgggaaaatgtaattaactttttttgagtaaccattagcaaacagtacaattttctcatatatgaagatacttaaataaataacctgggaatacttggagggataaaatatattttaaatgttataaaaatattgtaatattgtaaaatattgcctgtaatcccagcggaggcgggattgggaggcggaggcaggcagatcacttgaggtcaggagttcaagaccaccgtggccaacatgtgaaaccctgtctctactaaaaatacaaaaattagccgggcatggtggcacatgcctgtagtcccagctatttgggaggctgaggcaggagaatcgcttgaacccaggaggtggaggttgcagtgagccgagatggtgccactgctctccagcctgggcaacagagcaagactccatctcaaaaaaaaaaattgtaaaatcaagtagaaaacatcatttgaattcttaaaagaaaatgactagtattttatttcagccaaagccttctttgctctggttattttcaaatcaagttattgtcactacttttttaaaaatagtatgatataatgtactctcaaattccttttttatatgtacatcaatactgaaatctgttgatttaactgacttatttaataattatagaaatatatattacatatgtacatacagaaaatatataaagaaaacaaaaattctactaacatagacttcagtaaatggaaattcataccttgttctgcaataagaagattcaatatatggacacaacagttttctgtaaattaacctataaatgaatcgtaattcctatcaatatatcattaggttgttttggggttatttttacattgataaaatgatactaaagtttacctggaaatgtaaacatgtgaaaatgggcagaactttcctgaaaaagaagaaaaaaggagagggaccttgccctagcagatatgaaaacatatttgaaatatggtgttactgtgattaaaggggcaccggtgcagacataaacattcacatcaatggaatagaacaaaaagttcaaaaactgaagcatagatgaaaattttatatgtgataaagtgctatttaaaaatcaatgggtcgaaaatattattcagcaaatagtgttggatggctgatgtaaccatttgaaagcaaaatagagctgaaccttatcctaaattctacccccaataaattctagacagatcaaatatttcagtgaaaaactgaaaccatgaaagtagcagaaaacgtggatcagtcatttcatcgttttagtttagaatggggaagatctttccaaagcctcagacaaaacccagaagccacaaaggaaatgactgataacttgaccacatacagtttaaataaaatttctcttagcatacaccaaagcaaagtgaaaacacaactaatgagtgtggggaacatttttgcaaatacacgtgtgatgagaatgtttatttcagcattacttcttataacgataaaaactgggaaaaacgatagccattatgaggggcctgactaaatgaatgcatgaaatgtatttaaaagtgcaagaaatacatattttatattttaagcatagcaataataatgagaataataaaacaagaactgaaaatttggattatcacataaagataaggtggcaaaatttaccaaataaaaagaaggaatgctcagttaagtttgaatttcagataaaccacaaatacattttttagtataagcatattgcagatacttatttgggacatatttataccaaaaagttattgttgcctgtctaaaattcaaataaggtcatttgtactttacctggcaaaccatttatatatgccatatgaaattatatacactctaaaataacctcatattaaaaaggacagaatagaacttccaagtactggaaggtacttcattctgtaagatattatattttaagtgaaattgttttacatttttaaattttattttcccccacattctaagttctttgaaacaaaatctattatatacaatgtatttcttttaaaagatctcaataaatcttaagtaatattattacacatgctagaagtggcacaagtattatactaaaaaagagcatcagctttaaatgcctcactataaagactttctgtatgaaatccagctgtgggttcaggcaaatttttgctatgacagaatattctatcccctgattttcccaggcatagtgaaataaaaaatattttaaaagctcttagtcgtcttaatagcaagagcagtctaaaacccccctgaatctgatatgctaactttcaatttcgtcaggttttgattttgtcgttatcaaagcttggcaaagcccatcaggaggtgttgactctaattttttgttctgaaacacttgaaagagcacaggaataattagttctgtaaaagtttgatagactatcccctacctccaaaggcctccgtctttgtcttctatcctgacaacttcttaagttttttccatggttgattcaggtcttctacttgttcgtaaggcaattttaataatgttgggagttcttttgttgtttgtgtaaactggccttgtggagccagcctgtttcttttcatcatatactttttaataacagataccttatatttcaagaattagtttttacacttgatttattttgtaatcatactaacaaggattttgagttaactctgtattttactggctggttttgtatttcatgctcgaggtaattttgactgacttgtctgtgaactgagtcagtccaggtggttgctttggcacaagcaagtggggagtgttgccaggcagtgtagggcggctgtcaggagcacctcctaggcttcgtggtcaccaactgtgtgcgaacacaattgtgcgcaaacaaaaagaacaagttagtcatcctccttctgccttagtttccctaactggaaacaaagacaataggaccttcctcacaggttgttgtgaagagtagttgctagaaagtgctgaaaactacaaggtccctgtactaactgagtattatagaaatggcctttttgtttcagttttgtgtgctttactaaaagaaactttgtttttttttaatatgaatgaaagtgtgggtagccatagaatgcctggatcacagcctttaattcttacaattctgaacatattgcttggctggcttctgacatttcatttttagaaaagtcggaagttaaactaaatttttgtttttctgttggtaatttttttcctgtctggtttctggtatgattttttttttactcttgaaataatattttttaaaatcacccaaatatatctggtgttgtctctttttctaattttccctagtataaaagcaatctctacatttttagacatgaatattcttcagcattttaaggagctgtgttattttttgcctctgcctgctcttttatatatagaattatatcttagggatttgtcaagatttgtcctactagcctgttatcttttctctgagttctgggagattttcttgagcttgtttccatttatcatattcagtttgcttgtttcagtatccagtggttgtgctctgtctccatttgtaatttttgcattgctaaatttttattctgtgtcttttacatttccctgtgggttattctccactctgccttactatgtgggagatgactattcttataaatgccaatcttgagctctaccatgagcttggaactgtactagattacaaagtcataaaaaaatgaggaacatgatccactttcacgatgagcttgaaacagataaatcatttcaaggttgtcataagttcactgataaagttacatgtaagttacaaagagagtgataatgtaggttggtagatggggcatagtgtaagaatcatagagcttgaaacagataaatcatttcaaggttgtcataagttcactgataaagttacatgcaagttacaaagagagtgataatgtaggttggtagatggggcatagtgtaagaatcatagagaaagtgatgacttttagagtttgaggaagtaatagggacttatcagaaggtaatggagtaagtggcttcacaccaatgcttaaacgataaagatgtggtcctgtgtccggaattggtgggttcttggtctcactgacttcaagaatgaagccgtggaccctcgcagtgagtgttacagttcttaaaggcggcgtgtctggagtttgttccttctgaggttcggatgtgttcagagtttcttccttctggtgagtttgtggtcttgcgggctcaggagtgaagctgcagaccttcgcagtgagtgttacagctcgtaaaggcagtgtggacccaaagagtgagcagtagcaagatttattgcaaagagcggaagaataaagcttccatagtgtgcaaggggacccgagcaggttgccactgctggctcaggcagcctgcttttattctcttatctggccccacccacatcctgctgattggtccgttttacagagagccgattggtctgttttacagagcgctgattggtccattttgacagggtgctgactggtgcatttataatccctgagctagacacaaaagttctccatgtccccactagattagctagatacagagtgtcaattggtgtatttacaaaccctgagctagacacagagtgctgattggtgcacttacaaaccttgagctagatacagagtgctgattcatgccttcacaatcccttagctagacataaaggttctccaagcccccaccagattaactagatacagagtgccaattggtgcattcacaaaccctgagctagacacagggtgctgattggtgtgtttacaaaccttgagctagatacagagtgctgattggtgtatttacaatcccttagctagacataaagatctccaagtccccaccagattaactagatacagagtgcctattggtgcattcacaaaccctgagctagacacagggtgctgattggtgtgtttataaaccttgagctagatacagagtgccgattggtgtatttacaatcccttagctagacatattctccaagtccccaccagactcaggagcccagctggcttcacccagtggatcccgcaccagggctgcaggtggagctgcctgccagtcctgcgctgtgtgcccacactcctcagcccttgggcggttgatgggactgggtgccctggagcagggggaggtgcttgtcagggaggcttgggctgctcaggagcccacggtggtggggggaggctcaggcatggtgggctgcaggtcccgagccctgccccgcagggaggcagctaaggcccggcaagaagtcgagcacggcagctgctggccaaggtgctaagcccctcactgcccggggctggcagggctggctggccgctgaatgcggggcccactgagcccacgcccacccggaactcgcgctggccctggttcccgccctggttcccgcctctccctccacacctccctgcaagctgagggagccggttcccgcctcggccagcccagaaaggggctcccacagtgcagcggtgggctgaagggctcctcaagcgcggccagagtgggcaccaaggccgaggaggcaccgagagtgagcgagggctgtgagggctgccagcacgctgtcacctctcagtcccccgtcattttggatttttcctccttttttcccctgtctctcaaaaaaacaaataacccagtttttttttagtaggaagggtcatacttactgaaaaaggcaaaagctcttgactaatcttgaaaaggattttctcatttggtgctttaaatatttagtgattatggtagcttctgtttactggaaaaaaataattttgccactattataaacaaatattcttgaggtatttatttccttatttgttggtcaaaagaataagaatccctagggtagatgtaaaagtgagactaattttaactcatgatgttaattattgtagttaaaattaaataatctgtgcaggcatttaggactttatctaatgattaagtagaaaatattttggtgattatgccttttctttatagatgattacttatgccttttcaactgcaaatatatatatttgaaatataattttgataccaatttctcttaagttttcataggtttatccttactaatgttaataactattaataaggaacacacacacatatatgtatagcatataatttaagaaatttatttttatagatatatttttatacttagattctttttccagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaagtaagtatcttttaatatattagcagtaccttttatgcatttttttcactgtttacaaagcaatatgtaatgcaaaatgacatttagatgatgtaactaagaatgatacagtcaatgcattgtaccacttggaaagttgaagttaattatttgaaggaaacatagcaggtacatcaaaaaaataaatgtatactgtcaacaatatattccacttattttgaagtgttttttgaaaataacaaaagccttactgtttactcttatttatttaatgagtgaaagatacattctgaatagaaaaaaaaagagagattacagcctttaggagtgttttgatgtgttattaattgtgctttccccaatcacaaacaactgtgattgttctgtccatttggagacaactctcagactgttgttgaacttcagactagttgtcggaaagctagcaagaggaaaaggaaaaaataaaatgtggctcatgttcattattaactacataattaattttataactatatgttaacatacctctatgctataggtactatactaattacctctatattaactatatatatatttttttagatggagtttcgctcttgtcgcccaggctggagtgcaatggcggggtctcggctcacttcaacctccgcctcctaggcttgggtgattctctcacctcaacctccctaatagctgggaccagaggcgtgcaccaccacacctggcttatttttgtattttttgtagagatagaatttcaccatgttgctcaggctggtcttgaactcctgggctcaagcgatccacctgtcttggcttcccaaaatgctgggattacaagcgtgagccactgtgcccagcccaatgttagttcctaggtcacaagacatacgaagttcaaagagatagtcaatccagatagaaaaaagttataagaacaaggaataaaataataatgatacaaatgatattaattatacctctgctatagtcctgacattgatttaaattgaacaatatcgattgcctttgttaataggtaaaaacagtataatgaaatttccatgtggttcaacctaatccttgctaaaagttgtacatattgttttgtccttacagagatcattttaagtagctattcaggatttgagtgagggcttttaatacccctatttacagatgtagacactaaggctagaaatcttacacagcttgccaagggtcacacaattagttcatggagaggcctggactcaaccccagacttacttgagtctacagcccctgctggacacctgtggtcagaatagattgtaaccacctacttcatagcaaaatctgccccctccagcccatggctctgaagtgccctatactttcatcccagatcagtgctagggtgtgacttgaggtaaaggtacagaatcaacatatccctatactctacttttcctttaattttgatgagtgagtcctggaaattgaggttttttcttaatgtgcaaaatcagaaaagcctcacatggggcttttgaaaggattctccaatcctcaccactgctcctaaatgtccatctgagaccaatgattaacagttcagctccttagtgcctcttataaatgtctctaatgctgtcttcagaaacctctgaaatggatcatttatttgcttcaagtaagtttgcactaagtgaggccacagtatgcatttgtgtgtgtgtgtagtcaagaatacctgttattgttttcccctgttgaactatgttcaactattttgttcaatgaaatcaagcagttcatagctttgcaatccccacaatctcattcttcttttccattttccctatatctctataagatcaccagcatgttaaaatcacaaggttgtcttagatgtgaaccatctaccttgctgtgcatgttgagtcccatatctatgccttcaagggcccagtgaaaactcaagagcttataagatgcacagaaagagtggccttttctgttttgttttgttgaatgctgtattcactgggcctagaacaatgtctggtatgtggtggattttcaatggttacaataaaatgagggagtagaatgagtaaatgaatcaacatgttttctgccatacgcttccactaaatagacttacctttccttttgagttgtccaggaagaggaaacagcatgtacaatggcagtcaggcaagaattagcatggtatgtttggggagctcatcagttttttaaagattgaacatggagtaagctaggtagggtgtgtgtgtgtgtgtgtgtgtgtgtgtgtgtgagagagagagagagagagagagagagagagagaatgaatctgactttggattttagagacattatgttgagaagagtgttaaaggttagagaatagggcaaataaagaaataggaaaaccacataggggattactgttcaggtaaaagaaaatgaggactgaaattaaggcagggacatgggagggtggtaccttgaaaacaattaggtggtagaattaatatgaagatgacaaattgaacacagaaaataagagagagatcaagactagtttgtttactcaggaagccctaaagatgctgaacattctgatatgcattatttatacattgtcttgagcaatattaagggagtctgctgagagttaagcatttggggagtgagcaaggatattgaggagaatgacggaatctagaacaatcacttggaagccaagtaaaaataatgccaggtggcactgagggtccaactgaggttggtcactgtgaatttgcggtggtgccaatctacatgtcaatgtgggagttttccccctcatatcaacttaggtataaagcagactgtgggattgatcaaggtgaatgcatttgagggacataggtgtcataggataaggtatcagggaaattatggttatcagcaaatagaaggtgtcaggaatttgttatgcttgcatcaagcttaggaagagtcactgcatgtggtgatgttcttagtttgacaagataacagagtccctgactggactgagtctcagtagatgacaaagggtgggaggggaaaagggatgtggagtcatgtgtttgaggttcactggtctcttccacattgtatctggtcagggtgtctgcagtgacaccttttaggctgagagtcaccattgaagatgtggtgacttcagattaaaagatgagattttgacaagctatggtggaggtggaggtatgtgaggtccacacaaattgaggtgtttcaataggagacatggacaaaggacctagagccccaggtgaataagtggattcaattcaggtatttgaaggcaccaattcaaatagggtagctgaggttacagaggagattttttgtagagaggatgtaccactacaggaaaaagttggcccttactctttcttttcctgactcagtttaaaattctctgctccatttcctacgtctggggtcttgacaagatatcatgtaaatctacgacgtagttgtacatactctacatctattgtgacatatataacttttaacatttaatgcataaatcttatcccaacattctaatattctctcaacttttccaggcaggtttaagatctgatttatctgtgtgtctcctgattgtttgcaaacatgatgggtcagccaacaggatgcatctgattctctgggggactggttacaaatataaattcctagaacccctaatcccctccttcagtagggattctgatttagtaaatctgtgatgtaatctagaaatctgtactttaaagcaaacttccaagtaatttcaatgcacactgaggtttagaagcaatttcactgagcccaggctcttattatgcctagtagatcttcaaaacagacttgttaagtgaaaaaagatcactgttcagtgctgtttctcttatcagtcaaataagattatattaggcaggctctggtggattagaaaggcatgaggtaaactcttgttgaaaacatgggcctggatatataaggtttatgatgttcttaaataaagtgaagggctttagctcagtggggggacatgcttttctcaacctattccagcaatgctgatgtgactaacatagaaaagcacacttttaaagccacagatttcatctttatggccacagatttcatcttgatatccataaaacagttttcaaaaacccatgttttaggttactaggaggatcaagcaagaggatgcagaaaattctgtgcaaaaaatcatgacaattatccacaaaagaactgaaggcacattctatttactgcttctgggtttgttgtgttattgttatacatgaagaatagaatccaagtgtaatgcactttaacaaatataagtggatatatgtattcaaatacatgccatttttacagaccctttgcttttctgttgtagaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtaatctttcattcaaaacacttatgtggttggaatctgatttatttctttagcaggcacacttggaatgcatttgtttgatcacagttttggtaagtgctacacatggtgaactactatgaaatgtgttccatctttatgaactatttgtagaaagtttagtttctaaatgagttggaaatatatccttcatgttttgagtaaaatacatattatatatgtggggaaagtaaaaaatatatagctttaactaatatactattacgtacttaacttttaatgaagtcatccagttagagtcaaagtgagtgttgtcagctgaagactgctgaatggctaaggcggggtagaaagggcacaatggaaaaccaatcagatgtcctgcatgcataagtgagctaaatactaacagtgaaagaaaacaaatgactgtagctactagaaaaatgaagtcaagttcagggtaagagactcagtcattacaccaattgtaaaacatcattatatgttctgtttttaacattctaggtattatctttgagtgtgaaaggtcagagttcacaactcctgactaatgacaatgaggttctctacaggatttatgctgctgagcctagaattattcctcagacatctctgtgtctcctttggaatcaggctgctgcaaggtacttattaataaaataaaaaaatcagaatttggtccttccccatttcggtaccactgagcctaatgttttgtactgagcatagatggtggccccagatgacattagactggaaaataacctccacaataaataagaggaagcagcataggaaatggtctagtattgttctgatggcaaatgcagcccagcatttcaatatgtgtgtaacacattatttacttcttcatttttactactttcacgggatgtggcatgaattctgctcaattctgataaccttgaagttactagtaaatttattgggcaggaaagaaattccttcttttaccctttccatctgggcttgtggttctggaaactgatgccttgtgtttaagaagaatcagcaggaatttataattctagtccacatggcttgaagtacattttgagattaaatccatggacacaaatgggaaggaaagaatgattctttttttgaatctcctcggcctcaggcctcaaatttctgagcagttacagtcactaggagctcagtcaatgctgcaggatcaggcagtgctggcctagaagggtctagggttcctgtcagccacttgattttgtttattactgaatttcagccacacaaactaaaattctaaataggtttaatacaatagcttagtttggtaaccaactttcctcaaaaacactgaaatttctgctttctttctcttaaaaaaattccacttgaaatttcttcctaggtttaaaacaaatcttaaacctaataaatagaaatactctgaaatcttcaatatataattaataatgaatgtttcaagctgcatctggagtttgggtaaggaagttttaggtccttaaaaaagtaaagaaattaagaggcattttaagggaagaggctcaagtgatagtcactgaggaaggctcagaaggcttggcatcagatacaatgtttgctaaaattatgacatggtttttctgctaaattagccagaattcataaaggaaacacttttaagaaccttagaaaacatacacataagtcactccaaagtagaaaaaaattgaggaagaaatcttagataaccatacaagtaatttatatggttcaaaatacaaggacttgtggaagaaaaaaaacaaagaagagtaaacacatatcacagccatgttgttcttgtgtgagttttgaatggtagagaagagtgccttctattgagcatgtcgggtaggtttgctagattaggtaggaatttgtactgccctgttgagaggacaagctcctttggtaccaggaatgccttcaaagctttggttggtatttaggctgcttcttaagacatcctgtggaatctgtcatgtcatgtcctggacaagatgttcccttcactgtttcttcttgaaaatgtggtctacttaagtcttgagcaaagaacacttaatttcagtaagctatttttctttaaaagccatctcaacaccttcagtattgatgaaagaggaaaaatgactattgtgtttttgccctagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtcagtgacagtatttttgaatcaatggttataaatatttatgaaaatgaaagtctgttttcccataatccttttacgtatgcaagatgcaaacataccgtaattcatcagcactagaagaatacaaatttttcgttgtcttagtcattaattcattcaacaaatatttatggagggccatctctgtactgaggatacagtaaagaatgagacagtttcaccccataaagaatatgtaatacagtgtaggatagaagctagataataggtaaggaaaggctatagtttacagtaccatggtttagagggcaggtactgcagttacaatgtgaggactatgtgagatattaaataatacatacaaagaattttcaaaaaaatacatgcaaagaattttgtgcttttattgtttttaaagctacctcatgggtagattttgtattctacaacttaagagttgtgaatatgccaaccactgtgttaaaaaataaatcatctttcacattccacatctaggcctcatatttggcagtaagaagaaattaaattgtattaatgtctgtcaaactatttacccaacaacataacaatagaagtattattatttgctgtattaattatatggtcgggcatctgagaattccttaaactataattctataccccaccctcacccattctgtgccctgattctcttctttcagccccacaactttttctatgaacaaggtgctatacagtgaattaaattaagagctgggcatagggtaatggttaaaaaatgcaaactttggagccagactgcttgggttcaaatcctaattatgctgttagctagttgtgggacctggatcaaattacttagtttctctgtacttcatttttcccacccatgatatttgattataaattgtgtctatgtaacagggtgataaatatatgaagtcagacatttctaacattctgctttagtgatattttgtctgtaaatgtgattattattgaatgcatatctcttgtatttggtatgcaaacagtctctctaatagtcattatcttttaggaagtttatctggagatagaatcaagtaattaattactatttgttctggttgccagtctttccaatataactttattttatatagttataaattttctttaatgtattttaattctgaacctaacttcaattcaatagcaagataataacttcttattcttaatatctttcataaaggatgacatttcttatttaatagaatcttctaggtccacatagttccaaaatcagatggagacatcctattttacttttatgctaatgtatttaaagagcaaagaaattttatagaatgatgaaataaaatcaaaagatataatgttgaaatacaatctagatgtcattttacatgtttccatagaggcataggtttatgtgctgctatgacccacaaaatcccttgcttgttcccaaagactgaatataaaaaaaaaaaggagttttaaaaactaaagagagaatgttatcctgattttatagaaaactagtaggactgaatataatgagtttcctggagaatcattaataaatacctgtatatcttttctgcaacttactctagaaaaggctacatggatttgctcatgtatttgagaatcaacacctaaatgttagtatctgcttttatcacttttgacttggagtcatatttgaaattattttattctctctgtccatgtcatattgttatgtaattgcatgttctgtcgataaggagacacaaagtcttgtctttgtacctcagtttcagctcatccctcagggctggatgaattcccatccctctgatggatccccaggaaccagaaaagagaattttatatatcttacatacatattctttatatatcttatatacatattctataatttaggtcaagacacattgaatatcactctgaacttgatagaacttggctagtacttttcctgaaatacggcagtatacaattagacaggaatttaacctttttttaaaaaaacagagtagatcacaatgtatcggtaccaattctagtttgcagttctatttactatactagagcagaactacccaaatgatcaaagtgtgtcaaatagttgtagaggccaaaaagcttaccacttctcagcttagaaagatgaaagaaaagggcatatacctgtgacttaaaattgtaaactagtttgccaactatcagaaaattaaactaagatcattccttgaggttaaaatgaaaggacaaatcatccattgctgtgggcattagagtgcagcattatggaactcaacacaaagatggcttgggagaaatataacaaaataattacataataaagccataattttgtagtataattattaagaaacttcagcatggtttgagatacacattgctattttgaggatgtcaaggaagcctactctgccttcccataactcttttgatattgtactatcaaagataaggctattggttatgctactgcattgagtttgactctgaatacaagtcttatagtcttgtaatcttttttttttgagacagagcaccaccacacttggcaaatttttgtattttttatagagatagggttttgccatgctgcccaggctggtctcaaactcctggactcaagcgatctttccacctcaccctcccaaagtgctgggattacaaatgtgaaccaccatgcctggccaatatggacatattatttgggatgaatttggctacaagtaacagatgatgactcaaagatatcttaaacaaatatatttagttcccagattaactaattcagtgccttaatggtgttgtcagcagcccaggctcttctctttttatcctcaaggatttttttccctcagctttgtttgtacatggtcttaagttggctctagcaactctaagcatcacactagcaatgtccaggcttgccagggggaaagctcttgagtccagttttaacagcagtgagaactttctaaaaagccacccaaaatgttttcccttgtgtctttttgatcagaattatattctgtgtgctttcataactagtctgtgtcttggagaagatccagatagaaatacagagagacaagcactgaaagagcagcaaggatttatctttccgaacattgcccagcagtccctgacatatactagttcattggttgttttgtagagatggtgggagtgaggcaagtgggcgcaggagttcctactatattgctcaggctggtctctaaaacttctggcctcaagcgatcctcctgcctgaatctcctaaagtgcttgagttacagctgtgagtcaccacaccagcctgacatacagtaggttttaatagatattggttaagtaaataaatacacagtattgatctgatgatatcctccaataatgagatgtatttttgctatgtgtcaagttcatactttcaagtgccataccatatttttctagccatttttaataaaaattattttatttatttattttgagatggtgtctctctctgtcgcccaggctggagtgcagtggtgtgatctcggctcattgcaacttccgccttctgggctcaagcgagtctcctgcctcagcctcctgggtagctgggattacaggcaccgtgccgggataatttaaaaaattattttaaaatgtggcatattctttcttgccttcacttaggatagtttaacacaacactctccaatagagttttccaggttgatggggatattttacactgtctagtgtggtagccactagtcaccagtggtgactgagcccttgaaatatggcttatacaagtgcaaagatgaatttttaagtctatttcattttaattaatgaaaatttaaatttaaggctgggtgctgtgactcatgcctttaatctcagcactttgggaggccaggagttcgagaccagcctgggcaacatagcgagaccctgtctgtacaaaaagtaaaaaaaaaaaaaaaaaaattagccaaacatgatggcacatgctgtagacccagctactcaggtggctgagacaggaggattgcttgagctcaggagttcaaggctgcagtgagctatgaccatgccattgcactccagcctgggagactgagcaagaccctgtctcttaaaaaataataataataataatgaaaatttaaacttaaatacccacatgtgactagtggctattatattgaacagcgttaagttcaaccaccctgtttatctggaggctagtctcctggcaacctcaccactctagaataactcctttcccctaatacacagaacttttatactgtaaaatgcttcgtactgacttttgttcatactagaaatctttttttttttgagacggagtttcgctcttgttgcccaggctggagtgcaatggcacgatctcagttcattgtaacctccacctccagggttcaagcacttctcctgcctcagcctctcgagtagctgggattacaggtgcccgccaccatgcccggctaatattgtatttttggtagagacggggttttgtgcctttagcttattagtagcagtaaccaaaaggcattatgctgagaagagagttgcagaaacatgggaatcaatagtgataagcaacaaaaagtacaaaaagtgacaagcacagcagttaggttggtgcaaaagtaattgcagtttttgaaattaaaattaattaaaattgttgccaaaaccatcattatttttgcaccaatctaatacattaggtggtataataaaaaaaaaaaagcctaagctaaaaagctaatagtggatttaataatgaaataatgataatttggttttatttggatttatctgtagagaaggcagacagataaacaaataatttgtaaatattttaaggaaaatttcatgagaaaacgtactaatacttgtcttgtgaaagagtaaacttaagttatttggaaagtatctctcattcttaagtgatgccaaataatgaagatgtttataaacatatgtaatgtatatatgtaatttatgtacaaacatttcatatgtttatatgtatacaaactttcaaatattgtagagatagataagagaatctgtagtccagtatgataataaaagactttagctgttctttaccaattagatgttcttttagaaccgaatctctaatccacatagtggtaggaaaaaaaagaaaaggcaaattactcaattagctgcttgttttatctacatcattgccaagaaatctgttttttaaaaaaactgttcagagtatacctttaagtaatacctggaattgtgatactttattttttaaaatttttatttatttatctattttttttttgtttttgtttttggaggcagagtcttgctctgtcacccaggctggattgcagtggtgtgatcttggctcactgcaacctccgcctccaggattcaagcgattctcctgcctcagcctcccgggtagctgggactacaggtgcgtgccaccatgcccggctgattttttgtatttttagtagagacagggtttcaccgtgttagccaggatggtctcgatctcctgacctcgtgatctgcccaccttggcctcccaaagtgctgggattacaggcctgagccaccatgcccggctatactttattttttaaaaaatcattctatttatagttataacactttatgctttgtaatttgcatatttatattaaggaatttcaaccaaaaagtttctgcaattaaaaaaagatttctaagtttaaatagatgttaaatatagctatttaatttcagatgaaaaaataaaagataagtatttagtatatagtgtcttagaaacctgataattgaaataattgtttctttaaattttaggtattcaatatcctcacccaagccagatgagtttccctagactaggacccagcctgtttgaggttttatcaatattattctcccctacgtaaaaaacgcatctagataactatgatgcgttatagttataggctggtagaatctcacctatcttcctgccactggctttgaatcctgaactgccaccaggtgtcatgctagcattttaactgaagcctaatatacttaattaaatatttctaagctggtcaaatttagtatactaaatgtatatcatgaaacaggagtataatagagcattactaagttaaaggaaaaggctataagtaagctcttcttgtgcactagaaaaaagttgacttgtgtatgtctccttgctgagcactaattccttgcctcacattgtcatcctctaccacagtcaacttacagcagagcacatatttgtgatcatgtgccttaaaatgaaaaaaaccttgcaaggcttgctttaaagtcagtatattactcacacacacacacacacacacagacatacacatgcacacatacatgcacaggcatgcacattcacacactcaacttaagacttgaatttaagctggcttttatcatcctagggaattcaaagtatgcattacttgagttctgagcatcaactccagtagtatatagactacctaagtcaagatgcacaatatctagcatgactctgcagttcctgaagatacactctgtacttgtgtgggtgaattttgaagccagacccaggacctacacacctgttccagaacaccccatggaagccttcccaaaaaacggattgctctagatttcttggccaaatttctaggccaaaagccttgactaacgcaaagcttcccttgttgtggagagccttgtctaccttgttaaaatttaaaaatataactcaaatggtttctcaaaaagaagttatgagaaaatgagtaacaagaccccatgtggaccttttgcagatgcccagtccacttatgccaacatgcagtgtattctgaaagtttgttccacagcttcaaaagaaaacaaaatgttaaatgagtgcagtgcctcctgtttattaacgaggcattgatataactaaacgggtaaaaatgcaaagcacatggcaaagcagtatacatatgtcaattgctgttatgtttcagtaatccttagacaaaataaccctactgagaataagagtggggtaaaagcttaagtgaaaaagcaaataggttatcatatgcagcacatttaagtcttaaaaggcagaaaatatttttaaaacacatgtataccctgcctttaaaaatctaacattaaaagaaatttatatgaattgcaagataaaagatttgttggattagtgctaaggttctaactatccctttgaagtagtgtaaacaggtgaattcaaacaaactcaaagataataagaataattttcttcatacaacttagaaatgtagaagtttaagttaaaagtcattgtggagaaaatagcacactttcttcctggtttgggcatccagtattgcaaagttgcctttaaaattcataactaacactattgtaattacagaactatttctagtagataaaaaaggggtaattaccaaacctgagttttggtaggaccagtcaaaattttatgactgaaaaatcctattcacatgcctgaatattgggcttaactggtaagtgtaaagatcttacttgtcatggaaaatggagtagattacaattgccatgtcatcttttccagaggtactgggcagaggcaggtggcagacctgacatgcctagctgcccccaaagattcttgctatgatgctgttagaatcttcatggattattaaaccatatgtggacttttttgttcctacaggtctttgcttggctgttctttcccatatcttctgtgccaggtactccatgtttgcagctaaacttctgactcacatgatggcagccagcttaggtacacaggtaggagagcgctggcatttttgatttatcgtgagatgtttgtgtttcttcttctttggttcttgaactgagtgtaaaagtaaagtttaatctcaacttagttgaaataaacttgtttagttttgcagtggaagagaatggggacaggagagtcatataaggagaatcaggcctaaaatgcttctttctacagagaagcaccttaatatcatcgcttacaaaaaaaaaaacttcttatcacaaagcatcttattgtcagctaatatatgctgaatgtatttgtaatttatatatacattaaaattaacattttattaatctgtttgaaatatgctgtgttataaattctttatgtttagggcattaagatgatataaacttttaaagcatctggacactatgtattgtttcttataatagtttgatagaacattttcttttgaaaaatcagttttctatggtagaagaaactgtgtgaaaaacaatgacttattagcacacaatttaaagtatctagtttaaagcactgtgtaaagcacagaaaccagaacaaaagatgaaattagatgctttttctatccatacggtgttcatagtctagaaaagtagatgtacatataaataactaattcagtgtgatgtgtgaacatagaccatttgcaaactactctgtgaaaatagatgaaggcttaattcatttttttcatttttctctgaaggtcaagaaagtcttcatagaggagatgatattgagctgggactcaaatgagtgaaaattcagtttgttgttaaggactaaaaagggcctagacatttatataggcaaaggaaaaaaagcataatcacttctactttaaggctgaaattatagatccaggcagaaagaatattctatataatgctcttatggagataatttttaatattgttttataaaattaaaaaatcccacttttctggatggggagacacttctgcaatgcagacaatactctattgattgggtgctggtcatatgtgtgtattgaatttgtgtgtatttattgtgctgtagacatgatttgcacagttttttagaatgctaaagtgcatttattgaactctggatagaacttgaaaaaaatagcgtttgtggtggagctgaaatataaaatggaaaattatcttaaacattgggattctgtcacccttttttgttctaggagtgaaaatgactgtaaattccataactctgtttttcagggaataattaagtgctggattctaagcagaggtctctgattggttttttaaaggccctatgagctatgagaagtagcagtggttaccaaaggggcttgctttgaatttcacaaggctatttatattgcctttgtaacctgccttagctgtctgatctcgcctttgcttcttgaatctaagatcttagaaaacccgccttccataattagagtttacttggctttattcaccacccactctggtgattttttggcagcagaatttgtacaagacttaattatagcactatagaattacagacagctcttcagtgtcctagcagacaaatttgctcgtgtctagggatgtgaaagacaaaaccaggatttctatgttggagcactgacttttgattcatattgtacttaacattaattttggacaaaacggttagtcatatccatgtttttcagtatatttttagaatacatgaaacaatgtggcatgaaaaatcatgtagtgtatgacttgtgacatgaaataactaaaaaagtattttcatagctcttttttggcaggaagaattggtatgttattgatagaaaatagtttatttcaaaatgctttatctacttagatttaacaataccctctgagttaagaatagttatctcccttaaaaccttttagctaaggctttaaaaaattcttagaccccccaaaacaagaagctgactacagtaagttgggctcccaccctatctaaattttaaagtcatgtttatagctccagttatagaatcttgccaacaggagttattacagttccagccttggatctttcatttgggatcctctgtcaatgttatattgtcatttttggaggttaaatcaactctagagaagtcttaaaaaaatgcaggcttggcctgtggttctttagctaagagggaaaattctatagctgacctagagtgtttgagttgtgaatactttgcagacaagtctgccaagaccattcattttcaaatctttattaatgaactaggactaagtagaacggcttttgtggagaaggaaagaatggaaatgtggtagtcctggacttccttttggagcagtgtggtataatgggtccgtgaatcagaaagtcaggaaaatatgctcgtccagctctactttctacttctagaaatatgtagactattataactataatttattgtgtatgtgtatatgtgtgtgtgtgtgtgtgtgtgtgtgtgtattttcttgattggaggaatatagatacaaatccaaagattattcctgctttaaaaatcaagattctgcttgaatctggagtttgtcattatagcacccttgagaatcattgactataaaatatcagtaggtggcagtagaagatttatttttctcccttaaatttatcgatctctctttagccatgatggcgttcagtaaaaaacttgagagatgctttcatagtacttctttaactgggcaagagggtatttgcagcatagcaaatacacatttgtggtgtcctacctttctctttttatcctctttattcagaatttaattaaatgcaaatgtaccataagaaagattgtactccactggctttgaatatatctttctactgcttatatatgtttaaattcagggacataaaattagcttcatcattatatttatgagcattaagtgtgttattgatacagaaaaatgtttttattatgtcatagaagctttgagataaaggtctctattttcagtttatcaaaaaatgtacatatttcttcaataccaagttattttttctcacttatataaatgaaaatgattaaatgacaagaaattgtggggctcttcaagtatgatgtgaagaaacagcaaacaaattttcatggtattgggtgatatttctgagaaaaacatctaattatatctttgggatttttatctttgaatcacattgccaacccatgtgtgccctgataaggctggtaaacaactagtgacaaagagcaagtttgcagttcagggttctcagttctggaggttctgtcaggaaaagcaatcctccaaatctaaaaaaagaacagaagtttcctcatagaaaacatgatgaaaagatagaactgtatttactctgattaataatacttaacaagggaaaatatttgtttttcttctctatggtttgttatttgtacagcataaacacattttctgaaactaaatagcaaattcatctagaaatgtgtataagtccgtacattaaccgcaagactatagcttaggggtctattctctggaatttaaaaaagttggactgttactgtcttttgatcactttctcattctgcaacattttgggatgtcattttgcaatgtcctgtttcccagggaggatcctactcagacacccttgcgaaaagattctgctttaatctggaattatgtcattctcgctttgagtacctagcatctttgggaatctttgtgcatgactaaaggcagaagtcctgtgtgacttcccaaatgctggctccttctggatactatgaatcctggtttctgttccagcagcttgcgctgctttgttgagattgccaactcaagaaagtcattgtgtgagtaaggcttgaagacacatatgtaacaagcatattttaatcaactgaagcagagtaagatagagatggtaaaatgttcatcagtcagaaaagaattttccttagttggaagtttttgttaatcacttattaaccagaatatcctttgttatttctacttttttgctgaataaaaaagtatgtaagcgtttaagtacaaggatcaaaattaaatcttgctttgaagattaggaaattgagaagcagagggtcatttttcagtagaacatttatgattatatgttagtggagatataaatggatcaagaaagtagcaaggaaagtgtttcctaaacttcaatgcaggcatcttgttaaaattcaggtagtgcatcagtgagtctatggcgggtttccggatcctacttgttaagtaaggtattagattagctatattatgaccccaaaacatctctggttgttgttgttgttgctgccactgttgctgttattattattactaaatccatataatcaagctatttttcttagtatgaaattttatttaagaaatcccattaattaatttttttagtttcatttcaaatattattgcctttaaaacgactgcacacttgtatctttccctcattaatgaaaggctgctgctgtgtccttctgattttttttatttcttttttctaagaaagggaaaggtccttaggcaagtggactaagagataatttagagtatgaacaaggcctttattctggtcattctcatagcatttgacaatttgtaaaacttctcagtgttgttttggacataaaataaactactagaaagaagatataactagttcccctgccccaagttcattcttttctaccaagatcctgtaggtgccctccccccgctagaataatattgagtatgtaagcctttttttttttttttgtacaattaactgtatttaaatgtgtctttatgtagagattggggtatttaactgtatcttttcttcatgtagagattagttgggtgaatatgaataaagacattctgcacacagatatgaatatacatttaagttgaatttattaaactatttgactcaatttaggtatgctcaatggcatggtgaaaatattattacattcatgactgagtgaccattcaacattcaattgtgaaattaaaccaaaaaactgagccagacccgcatctcaggtcaagaccattattcatccagcagttcgaccacttccatctcatctatcatatgtacaatattaagattgcgcaatgagaaataccaagcaagatgcatacatgcacacaaagcgtgtaaataataacctaaagcactaacctcatagtaagaaccaagtatatacagagaaaaaaatctcttcctctgtagtactgcataggctgagaataagggaccccagtttgcaaagtctctgtggaggaaatggaatctgacctggttgttgaagaatgtataagatttgaagacttggaatgtgacacattctaggcaaggaaaagaacaagaacaaagacatctaagttatagtgatcctggctgctttcacttgagtaaggcttgcagatcccacagagaaataggtaagttttgactgcaggtgaggcagcttcccattgtctgagaaccatgaggagttacagagtcaccaatggagttagtccaaaaagtcacaatatgaaaggagtatttttaaggattgatctggcaatgaaggattaaaggaaaaatggactaaagaaggtaagagactctaattagggagagtagagaggttgggtggactgcttttaccatcatccgattaggatgggttctgagcttagacagtggtaatggcaatgagaattcaaaggaaggaataaggactaataaaaatatcttattttgccttattaaatttctgcacttttcttgtctgtctttaaatcaataaaaaagccacattgcaaattttatttactaaacattaatgtaatatttattacatattacaggaggtagagattatgaggtaggtactaatattattctcattttacagattaggaaattgtgacataaagagtttaattacttgccataggtcacatagtggtaagtaacagaactagtatttgaacacagcagccagcctccagtcatttttaaaactgctatactaagttgcttcataaatgaggaattaatgaaatttactctgtcaccaaatgagagagaagatttttaaggtgactgtgaaactagtggtttcatttgacttaaatatgaaagtggaaaggtttaataattggagaacgatatgtgcaattttgagcatgaggggtttaaggtttccatagcatggagatttagatgttatctacataaatgtacagcttcttgacactttaaaataggttctctgagacaggttgggtagagaacctgtgtatatagaatacatataactaatgtcattaagggctgggctttgtggcactgaatttagtgatttacacatattgcattatttactcttataacaaccagatgagatgggtactgttatcatccctaaagagactaagagatattcagttacctaccctaacttacataggtagaacattgaaggaagaagaatttgaagccagatgtgtctggctccaaaactcacgtatttagagaccacgctatgtggaatgagaaggatcactacaagaggattggaaaatgttaaagtttttgaagccaaagaaggaaaaaggtttcaaatggaaagatttgagcatcatgaggagattagtcctcaaatttggcaagaacaaggtccctggaaacttggagagaaatgatgaaaattagaaaaggttaaagagtaaatggataggaagaaaatggatgaggctaccagaccacacctgtgaagtttgtcaatgaaagaagaaggcaatcaaagcacaggaagtggggaacaattctggtggctctgatcataggtttgctgcagggaatctgggccctggggctgccacacaaggggcaggtctcccccatctcctccactaatattttctttccttgaaagagaacttcctgttgaagtttgttgaaagggtaataggaattagtaagtttctctttgatccatgtgtttatttatatgttgtgattaatttgaattttttaggtctaggcaagtgactccctgctaatgcacctaacttaatcaccttatatctaggagaaaattagagctgtagtttgagctttctttttgcatttcttgaatccaaatttctgtgatggccttatatttttggtattgttactattgaactttatgtaaacttgcaatcaatcatgaaacaaatttataattagcaattatcaaataattatataagtcattctacaaccaaaaatattaatattatgctattcacaagtgtgtgctttggaggattacaatgattttggtactcaaaatagagtgaaatttgcatattaaggtattgaattccccaaaaaaatattattttatttttgctttctttttatttaaggctacattttcctttatgtatcaaatttgtctttcttaaagtctcttaataataaaatcgaattccttttcctcaacaagctttcaaaattcagctcaaatagactgttctcactacattgaaaataagtggacactaaagatacaaaaatagtatcatggtcacaatactgggaaattcagactttcccaagtgctgaagtagcaaagcaacagaaagagtgagtaatattctgaatgaggctacagtgacattatcatgtttgcaacatagctttcgttactaggaaaatttgtgaggcaaatccagactttaccaaaaaataccagtttggaaccttttattacagcttcagtaacataaactatccttgacctttaaaagccttccttccttgatgtccctgactaggcaaaagcaacatatgaaaaaagttgtttttatgaatatttaatgagagctctaaagaactgtaacagatatggagcgtagggggaagtgtctcagttttggaattagagagactgatggggtaacatctgtcaactacagtggaaaaaaaatcactaggaaaataataagaatgcctgatttgcagcattgttgagaagatacatagtggatcatgttcaaatgcccaagacacaagatccgaggaaggagatttcagaagaggagggcaaggaggattcctgctacctcacgacatgcagaggcccttcaggttctgccctgagttgaacactgaatccttccagagaacctgagcccctgagcctgcttttctgtgcttcaggctttcttaaatcagctgcaagggaggggagaatttggggccccaccctttttcaataattggctctgtcaagcctgtaactgtgcctttccttgtactataggtaatgtagaccatgaaatttgtttccgttggtctgcattatctgtaatggacatcatcagtaattttgtttatagtttttaagagttttttttccctgatctgagtattttctaagtgtttgtgtcctcattgcttgtgttgaattgttataaccttaaaaattggatatatataatatgcttgcctatctagaaaattatacatatggtatgagcttgtgtgtgtgtgtgtgtgtgtgtgtgtgtgtgtgtgtgtgtgtacatttgaaatttgaaatagacttatattttgaaatacagagatacttggctccatagctgaagggctagagcactggtcttgtgaaaatacagagacacttatttaatgaaacagtactgctaaggacgatgataaacacttgataagttaattccagcactctatggcatagtcagtatatgtattattgcctctgcattgtgtgtaagaaatctgagacactaaacaattctgtgacttgccccaggtctcagatcaagtaagtctatctccaaagggtgtttccataaccccttctccacccctttacagaggagccctcagagaccccggtagtgcttcttccctccacttccttggagcctaatagcatggtcttcttgcagacagttttaacatttactctgttactatagtaagcatgctagaactaaagacttctctttagtttcctttgtaactctgtgaaatcttgcttccttctgtgaaactttttaatgagtggtccttacaaaattggtttttagatttacattgacctaaaccccaggaagttgtgtctcctgagctttatctgcttgctgtacagcagagtgccttttatgtagttgcctacctgcctggctgaactttaagctcccaagggaagaaactgttctttttcatatatcacatccaatgccaaaaggtaaaagaccaaaataacatcagtcacaaagacagggcagcctttcctataggctagttgtgtgcagtctagaactgcctttctggcagagccctattcagataccatctttcgggaacatacactctgtgttctgccaggatgggggaggagcttggtttcaggcactatgttttggttgtaagggcgaatgttattgccaaactgaaacatgtcaaatatcaacaaccaagtgggttttgtggtcacatttcatctgtagatgatggcatgtgcaagtgattttatggggtttgatgtggaaactatgagaaattccacaactccagagtgcacctctaagccccaaccccccgtttattctcgctcttctgcaagacagagatcaaggttgaatgaaaatcttgagtacaaattctcaatttttgcatttttaaaaacttttaaagtatagatttctttacaaaaaatgctcagagaaaaaaattaaaaagccaggcatggtggtgcacgctgtagtcccagctgctctggaggttgagaaaggagaattgcttgagcccaggagttggaggctgcagtgagctgtgatcacgccactgcactccagcctgggcaataaagaccttgtctcttaaaaaaagaaaggaaaaaaaaaaaccttagttaaccatatttgggaattaaatgcttttctactgtctgttttttgggtttatcccatttgtgatcccttctgtcaattgtcaccattatcttgctcacctaagccacctttcttcttttatggactccaaactcttccctgtggtcttaacctgacccctttctccatagtctgttctctcagcagcaggagtggtccttttaaagactaaattgactctaatcattttccctaaaactttttggtgtcttcctattgcacataacagagggactctgacctccatctccctcaggatcagtctctgcccattctctgatctcatcttctaccacctccccgttcacccagcacagccacagtgggcacagttctttaaatatgcccagcttcttcttgtcctacatcctgtgttctagttaatacctaagcctggaaagttctgccccagtgttttgctcatccgtatttccatttatacagcattgactcactcaactcttacgttaccacctcagagtggcctccgcaagaagacccacccctacggggtctcatcactgttatgtttattcatatcatatatccatatctaaattttcttgttcatgtattgtattctgtctccttttcccctttctaatggaatgtcaactccattagatcaggaattgcctgtcttgttcattgctgtttctagcactcataaaaagctttttggctcatactagattttcaatttaaaaaactggttaaggccgcgtgcggtggctcacacctgtaatcccagcactttgggaggctgagatgggcggatcacgaggtcaggagatcgagaccatcctggctaacatggtgaaaccccgtctctactaaaaatacaaattagctgggcgtggtggcatgcacctgtagtctcagcttctcgggaggctgaggcaggcgaatggcgtgaacccaggaggcggagcttgcagtgagtggagatcgcaccactgcactccagcccgggcgacagcaagactctgtctcaaaaaaaaacaaaaaacaaaaaacaacctggttaaataagaaaaacaatgaagttaaaagaaatcttaggctttcttataaagagcattcttggcaatctaaaactaacctatcaccattttctcatgaaaataagcacttcctatattctcaattccttaaagcaaaacaaaaccagaactgggtatggggcacatgcctgtaaccccagctactgggaaggctgaggctagaggatcccttgagtccaggagtttgagcctgcagtgagctatgattgtgaattatgatttcaccactgcactctagcctgggaaacagagcaagaccctgaatttaaagccagaattttaaagaagaaattattcatattcttaaatgtaatctgtagtgatctacatcttttataaacaaattgtattataattcttggtttataatttagatgtgttcaatgcagaattaattttcccagaaaagaaatgcttataaagagaagtcaagatctcaagccagccaccaaagcttatttgactcttaatctgtctgactgttctggatcctaattgaatttgtaacttctcttcgtgttaaaacattctgatttctaactgggaacttcaagaaagcccatactgctcccacagcctctgttatatggctcttcttccttcaaaagtccatagaagcagactacaaggaaaccaggtggtggtggggtcaggaaaggtgagatggaggggaagagggagacttctggaaactagcttcctgggtcaggtaggtgctctgcaaataagttggatagcaaatggtaagttttctgaaacttgtggtcacagagtgtgcaaagagaattggctcttcaagcagctttagtaacttattaagaagcaggtttggagatgagagaacaattattggagtacagaaaaagttttcctaagtaatgtctgtgttccaaaggaatgaaattttgtgttaaaatttagatactccaagatagataataactaattgtaaaagctaattttaatagtgttaactagtaaatgtctgtagtgccaaaataattaaaatgggccattaaaatatggctataaatatcaaggttattacattgttagtatgttgaaattgagaaatgaaataccccaacatactgcaggatgtctagacataatgagcaatcctgtcatgtttaggtcatgtttataattgtgattaatctactcttagtttctgagtttattgtatctgataccacactccaaaagccttttaacctatgagtagttgaaagcagtcattacaatgcctggtattttgtaaataaatggattaataagatataacaatcacaaatcctaatcctcctctcagaaatatttaaaaaaactaaaatctttgcatttaaggagcatggttttgtaccttggaaatctttaaattaaattgttggtttaacttttggaacacttttaaagtgttcaattaaatatttattttagaagggcaatataagcatttacaattatataaaaatatccatgtaggcactgctaacacagtttcttcacttcacaggaggacaaaggctgcaggcatctaagagattaaccccaggaagccagagtagctgaattgccagtgttttaccatttattgttaactcactagatactcgtgaaactccattaaaaaatgcccttgtattatacaaacaatccacacttgagcaacctttcactctaagattaggaattgctctttgacaacctttgtcagggttaattattgaagacttttgtgtgaattataggaaagtcagatgaggtcaagcaagtctgtctaccacctcctgtttgagtcttaaagtagcagaaaaatctattctccaggtaatgaaaagaagaccttttctgaaaattttgttgaagcacaatttaaatttatctcatgtttgcagttattcattcattgctcccgttctccaactatttagtgtcatatgtactatgacgcagtaatgtcatgttatgtaaaatatagtaatgacatagtgaaagacatagtttagaccctccagtaattttctgtctaccaggagggtaataaagaagtaaatagatgaatacagtagaatggtgtaagcatataatagcagtctgtacagcatatagtgggaaccaaaaaagagttattaattctatccaggttgaggagtggagtcaggaaaatcttatagcaataaaaatgcttagctgtcttgaaagatgagatgtcttcaccaggaagaatctacatataattaaaagacagacattagtaaaggcagaggaatgggcagtatctggcaggattagtgacgcaaaaaggattgctctaccttggattatgttctgtttagtttgcaaggaatctgggttggttcaactggttaagagctgatggtgaggaaaggagagctactcctgggcagacctgttggaaaagtagaatagtcgccagacctgagcagaactgatgtatggaggagcaacagaaaatgagaattttttggaaagaatttgggttccacagatacattttagtgtctcacaagcatttttttggaaatgtgttaacttgtctaatctgaaaaggctgaagtatctagttctgtactactgcgtatggagaaatggaaagtttctgtctgttaggcatcagtagggtttcagtgtgtggtttttttttttttcatttaatgtctcttacaaatttcatattttaaagaataattcctcataacatcctccagtgaaccctttgtgattagtttaagtgaagagataggaaaaaatagttaggtgtaaggtatattttttcaatgctttttcttttttttaatgttatttcaaacacaatttactgctatcacatattaaagactcacaagacataaatcaatacaactttaccttttgaaatatttaaatttatataaaaatattaacattacctcttacatgccctttcgtgaaattcagaaaaaaaaatgaaactattaaaactgcagctgcatgactatggaaaataaatcgtgtgtatagtttctgtgatattaccctttgtgaatttgctattgaattcatattcttgaggtaaagatagagttcagaccttagaaaaatacagtgataatgccacaggaaaatatttgtggtgttgtttaagattcagcgtgtgtaactcttttctaggttattaataggcttgggaaaaacaatataagcaatttctcctaaatagaagcaagtttgagagaatagacttccgtcagaattggctactgttagggagaaaggaagctgaattcaaacagttttgtgagaaactggaaaagaggaagcaattgagcttcacaatcggtcactgatatttgatttactttctttggagtttacaagtggctgccaagttatgtctaacgcacactgcctaatccttggaggcctctcttccagctgatgtctgcgtcagtggtggccatgagagaggaagcaacttgaagaaaagattgtttaccacttaaatttaacatggaattcgaaggctaacgttaagtggtttagaacaccactagaatgctgttttgtatgtttgtgattcccgaaacagtcacccagcatctagtcctaaatatgaattaagatctcattccgaagaacaccttcttatcacttctttgaaggtaattatgaaaagtcaaagatgtacttctaaaaaatgcctctatgttcacagtcatttatgagattaaacagataaccagctgactaacaaactccaacatagtcatgatggtgtccttaagcagattataatctcaggagtgctggggagatttatacagatatgaaaggagggcaaatcaaggaggtatgaagtcagctacatggtgtagtgtaggtgtcacacattatttgttgttgcactttacactttccccacttacaggttacaatttgcttgaagattaaaaactcgaaccatatttggttgttaattctccttctgtggacagactggaacaaatggcaagagaaacgattgcccagctacatgtgagtcattctttcctgggataaggctacttcagctttaagtggagagtggcttggggaagctgttgtggaagtaaggtcacagggtttgagacatgtttgaagcaaggcttttgttccagttcttccagtctgcatgcaaaaggaaggaaggagaacatctactagcaaaagctgaatgaggacttcaacctcacctccatggttccccacacaggagcagagcccagccaaggttcccacctaacaccatctttccagaaattgttttgagatacataggagagaaaggcccttatattcacaagaaaacccagcaatcatattcatttgaaaagcaatccatatgcacattttggaaacaaaagaagtatcagtacacagggtgaaataaacttgaaaggagatttgtaaagaaaagaacaagcagtattcattcaaaaaaacagaaggtaggatgttatggaagtaaaacagttattttgtttaggtttaaatttttttaacttttaaaatttgtgatataattttgattatgggaatcatagattcctgttatcaaaggaagaatgaccttttcccatttccttttgagtttcttaaaatttcaattttctccttaattatactattttatgctttttttttctccaaatggtaaggcgtatgtttaatttaaaattttaatttaaattattttggccaggcacaatggcttgtgcctgtaatcccgacactttgggaggtcaaggcaggcaaatcgcttgaggtcaggaatttgtgaccagcctggccaacatggtgaaacccctgtgtctactgaaaatacaaaattagctgggtatggtggtgcacgcctgtaatcccagctacttgggaggctgaggcaggagaatcaatcgcttgaacctaggaggcagaggttgctgtgagctgagattgtgccactgcactccagtctgggtgacagagcgaaactctgtctcaaaataacaataataataataattaataattattttaagaagcaatttttagatttctatttttttccttttatttacttaattccagagaagtaatggtattattaataatattcttcttgagctcctgttatattccagagacttcaggtatgctactttattttattctcacaatagtgctatcagtagacattgccatcctcattttatactaaataaacttaaatctgctcatgatcccatagctatgaagcagggctaagatttgaacctatgtgtgtctgattctcttttaaccactaaattacaaacacaggtgtataaaaaatgtgtgtataaatatgtatatcatacatacatgaatgtatgtcatgtacagtatctgctgtttccttttcctgaaaattgctaaaggctttaatcagatagatggaatttgaacaatcagaggtggagcttgcctctcagtggggagaaagcattttgagcaaagaaaacatcagtgacacacattgggtttaagaaagtacaggacatgttttaaaatacaccaaagtaggacattgactgacatgtactatatctttgaatgagagtgttgtgggttagcttgaaaagcagattcagatcagcctatgggaggtcatgaaagcttagtttagtagttgggactttactttccagtttttgatgatttttatcaagaaatgatataagaagatttatcctggagccacctctcagctcagcttctctgaacattgtggaattattatactaacgtgcacaaacttgtaacaatagcagcaaccattccaatatgtcagctttctggagaatattgtccgtatgtcaggatatgtaaataatttcaaatttctcacccttagtagtctcccacccatataaataagcttacagtgaatagtggccagattttagcagtgagttttcctatgtagtccattcctaatcaaagactgcattacaggattcatggttctgtctggtatacttagtattgtaacatcctctgctttcactctttggggaagcttaacctctgtctgctcaatgatgtattcttttcttcatacctggataatgttttggagtacattttaataaaaccagatcatgagggtaaacaccaatgtgagaagcttcattgtgcatctcatctttagttgataattgatggaatattttgtatttcatggatcctacctcagtacatggccaagaaactgctggactccacctgtgcaatttttgaaaagaaattgaatgatgcgttccaggaagggtttgcatttgctcattatttctggcttaatcaaattaaaggagaagaatgaaaaacagctaactccagagcacctgtaaccagtgttgccggaaattatgaccctgttagcttgacattgtgtggtgaaggggtctaattattggactgttaataatattatttaagccctcattaaatgtgctaccatttaataggattttctgatcacaaatcttcattagagtcttagaaagtttttttttaatcttgtatttttccataaattcatcccattgaataactcaagggaggtgaactttggccagtgggtcacagcaaaggataaagattgggtgatgtatatcagggatgggcggaatttgtaatagtttccagctgtctcagcagtattaatgaaagtattagaaaataaatatggaaaaatgattagagattcgaaagaagagacatcaagtatgcaatgtgggactttaaaaaaaaaatacaagatcttgctctattggtcaggctggagtgcagtggtatgatcatagattattgcagcctcaaattcctgggcagtcaagcgatcctcctgcctcagcttcctgagtagttgggactataggctcaacttttttctttttttgtggagatatgtcttgctttgttgctcaagctggtctccacctcctggattcaagcaaactgccggcttcagcctcccaaagtgttggggattacaggtgtaagccactgcacccagcctgcttttcaacttttgaaaacaaaccaacatttataccaaggactgagccagaagaaaaacttctaaatttcatatatggtagaaaattgcagatttcctcacagatgtaaagagattacctttcatattaatatactcaccttcaaacagaaagttatctatagattttagattgaagttgatattttgctatactataattattttaaaagacagactttttgcctttctgaaagtagttttcacaaaccttttcagtacttctttttgtatctttctcattaattttgaaagagaagaaaggaaatattgaatattctgttgagaaaggaaatattgaatatcgtcttaagacccatgtcttttacctttttaattcctatttcctgatgtggagagaaacttgctcacagtctcctgtactgatggagctgtaaatctaacatacatccagatcatttcaaagcctattttttctcactacacagatgcctatatatttcttcattacagccttttaaatacttttctctgtgataattcccactttaaaatttcgagaaagctattgttctggatggggaaactccctttgtgccctgcagggcctttgggtacactcacccccttcctgcttaaccagaataaagtgctgagtttgcatttcaaatctagaaaataaataccttttctttttctaaaggaactagggcatatggattaaggtaaaggaagatgagaaacaacatccaaaaatacacattttttaaaaaatagtcaactaataagttcatgttttataaaaatataagtaataaattatttttaacatgaacgtaattgtgatttcaaaatttcaaaattatagcaatgtccttaaaatagtgttgaatttaaaatcttcactttacaaaatgtctgtgaccatattatctattatgctgttagtaactagagatttttaagtaaagatagcttttttgggtagtaatattttcatcaaaattgcagtgcagtaagaaaaaaaattcagtctctaccttgaaagtttagggttggaacataatcttagtgagtatatctataaaactgttagcctcaattatctctgaattgattttgtttgttcaaagacacaactgtgaagaatcattattctttctactgtgttttcagatgaaccctgacagatctttcatgacagataatactaaaaattacatgttcatctgtgggaaccagaaggaaggtcatatcttgcttctacctcctagaatagctccatggtatttcaggccatcgaagaggatttttatgctggagaggcagcaaatatgtattgatccttaaataacaatctaatttcttctttcttcctattactttagtaggtataaaatccagtagtgaggtatgccgaaaatggggtggtctttagactcctggttagtactttgaacattttcattttaaataatgattctcttgcaaactggtcattcctgtgatacatatttccctttcacagcttctgaatataacttggagtgatactggtacaatgctgcctttctctcccaccttccaaatgtatttgcatatgtgcagactattcctccttctaactgctacttctctgttttttgcttcttcggcctttcaccttctcacacccccatttcctaactccccaaggccatcattctcaccctgcattttgtagctagcagatatgtccatgtgcatatcatcctttcacttacgggactgtggcatggagaagtgagttgcagtaactagacctctgcattcctgagtggaatgttacagggcctctgcaggagttgatgggagtgggccccagtgagctggaaggttgtagtttgacagtcgagttctcttctcctccttgcatgtagcccttagtttgtgcatcatccatagcattccttattcctcattacttccctccttgtctctctctattgccctgtgtcaagttaggaatcacattcatagaactaaattactatcatgcacattaacattactggcattaaccaaatggtttttataaaggatttatggccttagactaggatttctcaactcagacactgttgacatttgggaccagataatttgttgtggggcactgtcctgtgtattgtaggatgtttagcggcatccctgctctctaccattcaaatgccagtagcacacttcccctaaaacattttgcaaaaactaaaaatgtctctagacattaccaaacgtcccctggaagccacaatcacctccaaatgagtaccactactctaaacaaccaatctattcttttcatcatttttttctgcacattttatgaaatgtatcttgtttttaaattacagaaccgttacctcctttgactttaggatgctggttttaacacaactgggtcattaaattgcttctgacttgtttcatattatggtctcttcaagagctgctacatttttacagtattgtttttgtgtgagatattgaaaagacaatgttagtggtatgtatcaggtgcctatgacaattaattgcctgatcactctaactattctttggagactgtcttggtgattactctgccctcttccttatgtgctttgtgactcgaaccaaactactagtttcaactttttgtaaaaactagaccccacattgttgttatgttttgtttctccagcccaaagcatagcacaataatcgtcttgatttaaggtgaccagttatctccacctgcctaggactgtcctgggtttagcactgaaagttctacatctcagtaaatccttcagtcccaagcaatccaggacagttgaataccctaactgataatttccttttatttctttggcaatcaaagtaatgaatcctactctcattcctgtacaatggcctggggagtttagtacaggggcactgaggtcctgtgggttgagtttggcccacaatcgtggtatgtatgttcttacagtatgcttcccatggaccatgcagccccacattgttttatatctagctcctctacacatgtatgttaatagttttgtgcctgataacctttgctttgcaacccttcatttaaggaccacttccagttttatttggtgaagaaaatctttagctctctgtagatttttcacaagacagactcatagatgtacttgttgttcaagatgtttttctgctaccacataacaagaaatcagctttctgaagcaattaataatctcttggcagtctttctaaaggttttcttgttcccaggtgattaactcaaagacttcttaaagtctcaggactttatagatgaaacagatagcaatctgttggatgatgactaaggattgttaaattatcttctccatacttacatcttctccataatgatatggaaatattccaactttagcttaactccttcaaattaaagtttgtctctacaaaacctccagttaaagtgaaaatctgtgggaaataacaaacccatcagcatatagtaagtttatggatcaaatggttattacacaaccctaggtgaaatgtgataagctttgagaggagatggaaggaagcattctgaagcttaatttgtctggcacaaggtgaggactgaaaggtgacagttctaagcagttaaaatactgtggagataaggagtgccaggagaggggttggaaacaggatattggttagaggaagagatagaaatgaatctgccccataatttgtctggcccttttattcttagcctattgttttaaggagttgcttaatactcgggtcttgaggctactgcatgtaacatgaagaagaaagggaaggagggagagagggagggaggaagaaaggaagggagggaaggagggtggtgatgttgctcattacccactcccagtatatggaagtggctggatcaagatctcattaactttaaaatatcgaatactaatcccgtgatgtcctcccctgattttagtgtagcaggattaatagttgtacttagaaggcaccaatgatcctgttgctgacataatccatattttttgagcagcatcaagagcttgcagcaacctatcgttctggaggctggctattggcactattttataggaaattgctcaaaggaactctgatcatattctcactagtattacctaatagtcgggaacctttattttccttctgaagatggttcaaaaaattatatagatcacccactcctggttggtctttggcttcagcttctcagactcttcctctcctggccaactaccaactgctagaggttgtcagctcactagtgggctcacttattttctgtctctatagcagtatttaacaaagtactgggatgagacatgcctggagagtttaataaaaatgcagattcaaagcctccaccccaaacatactgaatcagaatctcctcaggaattgtatactaaaattatagaaatattactccatactctctcgataaatgatctcatcattagccatagcgttaagctttaaccatttttgtatacttcgtgactcacaaacttttatctccaccgtaaaccactcttttaagctctggtcttatatactctgttgctccttgatagctcttcttggatgtctcacaggtatctcaaatttaacatgtccagatgacaagtttaacatccgcttgaaaaccattcttcccagtttcccatatcttaataattggggccatcattcacagagtttctcaagcattattctttccttgctataagtgtattcagcttaccagcaagacttttgtgtgccagcaaattcttttaattctacctttaaatgatgccatgagttcatctccttttttccgaatccatctactaccttttgccaaatgtaccacgtcttatgtgacaactgaaatagtcttttaactgatctgcctgcttcacctcttctctcaaccagtttgctctctagttaggagccagtgtcatcttttaaagatgtcatgcgtgtcctctattgatacccttttacagctttccactgctcttcaagatcaattccacatcataatatggctgttaagactgtatcaccagctccggtccatatcaccaatctaccacccacaccacacggaccttgccttcattccctgaagctgtcgtgccttggaacctttgtgggtgccgtggtctctgcctggcatgctcttttcactgatccttggctgtttgtatcagaggttccttctctcacttcaaggatcaggttaaatgtcgccttttatggagggcttcatcactctatttcactctatttaatcctcccatctctccaacagactgtattctctcagttcattttcctgttctctatagtactcagcatgttgtggttcttgacttattcatctctgttttctcatggatgatacactccatgagggcaaaaaccatggctgttttcatcactgctgtgcactcattttctgctgcagtgcctgatgaatgataagcactgaatgcatatttgttattacttattaaagttttatttgtttgtctttaatacaaggccaagaatgtcttcagtgtagggccaagaagtgtttatatgggaaacaatttgggtgagattttataataaaaaataacaaatttgatagcgaaagtgtaaacctaaaaactaaaacctaacatggagttgtaatagttcaactctaccttgtccctcctctctcatgctgttatgcagattatatgtcaatctttgataacatttactagccaatgcttcctttagctgtataattcacaatagcatttttgtaccacagtttttttaagtcaggattctagacacagtaactaattttttttcttttatgtggaaaaagaacacagggttgatctcagatacacagataaagtaggcatttccctacagagtctaactctagggagattataaaagcaaataaaatgaaaagtattctttaattcctgtttttgttgtgtgtcccaaatttcaccattttgaatattgtcctgttctgttaaaatcatatatgcttgaaaatgtcattacagtatcaaactacaatgtgtatgagatctgtcatgtcacatttatgttgactagtggaacagagtagcattaaataatgttttccctctagaaggaagagtgagctaaagtgaaaactgactaccatataactctgtgatagcataatttcatttttaagcagaaatatttatgtagatttctgcctcattactgcactgtgagttcttaaagagaaaaagtttttttttgtttttgcatttgcatcattaggacataaaatcataggtgttcataaaattgtattaaaaattggtaactaaaatataaaatagcaatatcttctggctggcaaaagtgcttaaaaacaaaataatacattcttggcaaaagttggaatgatacattcaaacatataaatgtgcttgtggactttgcaggaaaaaatgactaatgggccttcatactttacaaatggataatgtatttgatgttggatatcatatatcatttggtgtttttatcattgtactgcagatttgcttagtcaactttatattagttgcctttgttttctcctttcttatctagccattttcaccttctatgcttggcttattcaggttcagtggtacaaatattgagtaacaactgttgatgttggcatacttttcacaacccctctgtggcctttctcctcattaccttatctgacactcctttcactgtatttttactattcctgcaaaacagactctagtgaaatataggagccatagtgtaatcctctgtctactatttttctcatagtagaaactgtggctacatctgggatatcattagcaagctaaatgctgactatcaaatcttggattgtggccttctatgagtcatttgtctgttgaataaggtgtgtacaatgttggaaagaaatcatagcaaggtctacactggagtgccaacaagtttttcaaaaagagttaccacacccaaacaagcattttttcaagagctaacattaagagtaattaacatttaatatacccccacttgtttgtccattaagtattcttgaaaactaacattttagccatgtgcgtcagtgctcagtttagccccttgatcttttaagtgtttgtctttattaggtttgtcttctctgaaaagagacctttttaaatattaattgcttttcatacaaagtgaacctactctgtggaggttgatggtttagttgaattaacatcagcattgtggtctcttaacaggcctctcctcattatagagaagacttattcagggaatgaggaagagctcagggctcttccttgtacagaccattgttttcactactagaatatccccttaagtatatattcttaaacagggtattaatacatttttgttgatagtctgttacagtaagagggaaacttctggtgaatctttcatctacaacaatataaaaactatgcaattttattttttcctcattttttcaccttttttggtcagataaaaatagccagatttttaaattattatataattttccatgaaatttttttgtgcataatttgttatcaatactcttccatgtacttgagaataccatatttaatgtatatcaagttaaatgatgttgtgataccatttgttaatgtttcatatgaggataattgtcctaagtcaaacagataagccctatcaaaagtgtgtactgacacatttgataggaagcctgtggagaaagagagggctgatggagactgagtttctttcttgcacataaatagttattctcttacttgagagactttgcacacttgttctatacagctgcaaaacctttgcccattccagctgctcactcctaaacccagtctggttgatcagtcttgcagctcattatattgatacactattttaggtgtgatcaatccttaaccccaaggagggaaaaaaggaatccctttctttgtttgattccatatttttaaatatagtctaagattgctttagctattttagctattgaaaataaatcataagggtgactttagttattacacagtgtgaatctttttgcaactcaccttttcataccatgttaggtttctgaaatgtacactagctgtgtgtaggtctgttttatgcatttgaaaggctattctgccctgtataaaggtcctattgtgtgttcattccttcctgtctggatgaactctgaatggtttccacccttttgctcttacacatggtgtttcagtgagcaatacagcacagcggttaacaacattgactccagagctggattgcttgggtttgtagttctaccactgctagttacaggaccttgacaagtcataaaacccagtgctcagttcacccacctgttaaatgaagcatatttcctatgaggtaggcatattatgaagatagcagagtaaaaacacatgaaagacttaaacagtacctgtcacataagaaacactatacaagtgttccatttattaacatgacccttttacacgcctccttacatataaatgtgacacattttcatgtgtaaatgtctagaagggtaatttctgggccacagcataaggatatattcagtttggcccccaaattgttaaattgttctctaaagacattgtaacaacttatatttctatcagtgccatgtaaattactgtttatcctcatcttcttcaacacttcgtgtcatcagatttttttactattttttatctgctgattttaattagcattccctgataaagagtaaagttgaaaatctttttaaattggcatttcttggagttttcaattaatatactttgtacaaaacaaaatgtatgacagtggatatgagcatatgaaattaaaaggaaattcactttttacctctaggaagaaggagcaggaatggaatgggagagcgggtttatatgcatctgtaacattttttttctttaaacaaaaaagtttgaaaaaatatggaaaatttttattgttttaatttggatgatgagtagctgtttatattttatattataatatatattatttatatatattatataaaagccagcatttagacttccttttgattagacatacttttgtatttctcactctttgtgtgtgtgttggagttagcaatagatgtgtgtattggggtaatgatgttataggggtgttagacaacacaaactgaaaggtaatatcgaaatagcttttaagaaaatatcaccttcctatagatgactgataagtgatagctatattctaaatataattaagaaaattagtatgtgcagggaagcaaattacttacggtaaaactttaattataaaagtataaatgggaaaatgaaaataatatctaacatgaaaaatatatttggagcataataggagcaaaaaggagaaactttttcaggtactgataatcatctcatcaattatggtgtgatgataaaacaataaaatatcctatagaatatcatatttaaaatgttttactacaaaattaattagatcaataaaattttacttggctatagcataaaaagttcctttcttttcacttttagaagaatttctgttttagataatatcattaaaataggtgaaatgttattgacaatgaagggaagcaaatgtcataaacccgcctgctatcattgcttatccatgtaaatatgtaatatttaatttggggaagcagtaatatatttgtaattattaatgtagttaatatggaaactttggttctaacatggacaaattatatatggtataacctcatctaggtaatttttctttagtctctattgaaaagttatgagttcagagtagaaaatgcactttaagtttcatcctttagaatgtaaagactaaaggatggattcttttgaaaaaattgactagaactcttgattctagtttcaaggggaagtgtcatagaatctttcatggaactaaaaaatcattagtgtagatttatccacttcttttgctttgaagtgctcacctctctcaatgttgcaaaatttcatgtgaatgtgaggtcacctttccatcatatttcttaacatgtttcatataataaacttttattatcttgagaaattttcaaatttgttctgttctagtactttctgattcaaattgtccaacacagtgttataataatttatgagactgtttcattgatatgaagatagaataatatgtgataaaagtatggttttcttaatttcccagatcccaaagaacaaagtcttatgtcattcaggcctggcaatttgaaaatcataaccatttgaaaattaggtcagttatggatccattaatcaaatacatttaaaaaaactttagtgaagtaaattggaaaaacaaagatactcatttaaagtgtacaatttgataagttttgacatatatgtatatatacataccattaaaaatcatcagcacaatcaaggtaatgaggataccccaaaagttttctcttaccccttttaatccttcacccccactcttctatctccagttagccagtggtctgttttctgttacaaaatatgagtttgtatattcttgaattatatatttttgttaatgaagcatattcattataccgcaaaagagaattccaatccagtttgtaatagagtgatatactaattctaaatgatttttctatattcattcatgtccttgggaagtgtccaaaacacagcttatttctatccataatctttaatcaaaacttacccaattgactttggctctggccaagatggagtaacaggggtagatgagttgcaagcagatttgtctattagttatctattgctgtatgacaaattataccaaaacttggcagcttaaacaacaatcatttattatgtcacaaaatttctgacggttgggtatctaagagtggctttgctagggagttttggcttctgctgttcatgaggttgctctcactatcagtgaggaatgaagttaaatgcttgactgagggtagatagtctgtttccaagatgactgactagtgtgacgattggctagaggctccagttccttgctttaggaaggctttggattctcaccttttgggctttttataagactgttaatgatagtatcagcttcccccaaattgaatactatgaaagagagaatgagcatgaccaaggtaaaagccacattttatttgacagtctactcttagaagtcatgtgccatctcttctcccatattttactggtcgcacacaactaccctagtctactgtgggaggggactacgcaagagtatatcaggaggtggggatcactggggccgttgtgaaggctggctgccgtgatatgtttggctatataaagtcaaactattcgacaagttttaagactcttgtgtaatcagcccataaaatctattttagcagtatccatttgcttataatttatgagctgactacacaatagttttacagttttatcgaataataacttttaaagcatgtatgtatttaataattttggaacaaaagagaaccatctttataggttaaaccttcagtgtgttgtaaaagaatctgaatcttatttactcataaggattacttgtaaggactaataataaacattaaagattagctaattcaatatttattttttccatgccctgcagtgacaaaaggttgttcattttggagattattaatatgttgttcacactgttcaatgtatttccaatattttaggtgtaaatgtatcttaacaattaatgttgctttaaaaactggtattgggaaacataaagaggatatcattaaatctcacattagcatactttcagaaggtcatctaaagctgaattatagcttgtggctaaaccctaataaagactcaaaatattaatggatgttctcatatattaatggtaagagagtatgtgactcaaaataagcccccaaatgcaaacaataaaaactaaattgaacacagcatcaaaaaatctgtcagtaaaatcattgtgccccaccctatggcacatgctattcccaaggcagagcagcaagctccaaagcttaagttttggcaaaggttttcatcattctcaaacctttttccagctccaagatctgtgttcattttcattattatttttatgcccatatcccactgcctcattctctgctgttacttatcactttatgacattaggattacctgcagaattggatgtaattttaactgcacccaaaaccagagcagcatataaaatgagtaggtgaaatagcttgcctttgcttagtgagttgtggggatggccggctgtggggtgggaaggactgtgtatgtctgctagctgacaaaactgagcagattaacaaattttgactattctgctcccatgacaacactttatttagcgatatttcagtaccttgttaaaaccacagcagtcaccgactctgcaaggcagcacagtgacttcccagactccagtgagttccctgagtttgacagacacagattcactcaagcacgaacacaagaaatcgcagagtgcaagacaatgggtatctatttctaagaatgaatatggaacctgtttcatttttcaccttcaacttcttcaaggtgatttttgattaaatgaggaatgtccatattaagaagcaatgtcttgtttcctaagtctggtccttaagtcaaagtgctctaattagatcaattttagccattcattacattaatcagtatttattaagtttctcttttctttcttttttgtttttttcagacagggtcttgctctgtcacctaggccagagtgcagtggcatgatcacggctcattgtagcctcgactttctgagctcaagcagtcctcccacctcagcctactgagcagctgtgaccacaagcatgcaccaccatgtctggctaattttttttattttttatttttgtagagatgaggtcttgctgtaatgcccaggttggtcttctgggctcaagtgatcctcatgccttactgagtttctaatatgggccaggtaaccatgttcacagtggtaaacaaaaaaggacacagtctctgctctctgaaagtaaataccttggcatttgagacagaatgaaggggtacataaacacactttagctagtggtaagtgtaacagtgaaaatcagagagtaattgaagggatgtggggtcagaaaaagcatcactgtggggctgacatgtgaattgagaagaaaggaaaatatctaagacaataacagtcttgacagagaaaacaacaggtgcaaaggcccagaggcctgaaaaagcttggcatgcttgagcaacaaagtggacattgtagctggaattttaacaagatggggagtcttagaaaatggtgtcaagaggtgggtagggtcttcacatagcacatctttaaaacttcacctttcttttctctttttctcagttaaataactacatagaatatctgtcgccttttcagcaaatttcaagatagaacactgaggagaatgccattattttggctacttaagagttgaaatagcttctaatttgctggtaatagttttaacttgctgtcctccagtttgggagatacagtgtaacagggagcatacagccaaaatctgagacatctgtaagcaagcagtcaggagtagcttgactatacatccaaaagtatagtcttcataactttgctttgtgaactgcttctgttaattttttatgaacagttggcctgaaagttgtttatttataaatgtgtcatttattagaataagatgtgctctattctgtttaggagggccaatgggggtgcagataagtgcttgaattccattctcggaggtcattgactatcaaaatgatcaagctaactggatttcactgtagttgaaaatataaattgttggattgtgtcattgttaaactgtgataaattaatttaaatgcaatagatctgaagtttcttcctcagaaatttcagtttaaggaaatttatctctttatgtttgttggtcttacaaatttattctgaaataatcagattttaaaataaataaatctgatattacggtgaccagtggtttttttttttttttttttttgagacagagtcttgctctgtctctggggctggagtgcagtggcgtgattgcagcttactgtggcctcaacctcccggctcgagagactcctcccacctcagcctcccaagtaggtgggactacaggcattttccaccatgcccagctaatttatttttgtattatttgtagagatagggttttgccatgttgcccaggctggtctcgaaatcctgggctcaagggattgacccccctcagcctcccaaagtgctggaactataggtgtgagccactgcacctggctgatttgttatgtattatgtaagaattgaagttatttcttgagaaataaatagataacaatttgcactttaataggtaatgtatcaggcaagttgacacccattcatctggtttggcccctgacagctatgctttattatatggtttaaatagatttgcattagaagtgaaactactgtaagaaaataaatatctcatgtaaatgaaaaagtaaatactatgatctctcatgaaaaagactataaaaatgtagccttatcatgaactccttgtgcctgcaccagcacaagacagcattaattgggcaagaaggggcctatcaggctggatgacattccccttatggcaggttcttgttggggggctgacccacagagtgtagaccatgaagtcccacaaagcaatgacctgtatggacaggttaggaaatttgaatccttgctttagggagtgaagtgattctttcacatgtatttgcttctgaaatagctatttcttattggctccttattgtttgttgtttgcacacattttaaagaggaaaatgtctcaccttagagaaacagaattgaatacaaaacatcactgagctagcacaaagtttagcacattgaatatatacttacatataaatataaatattatgtaaagttttagttttatagatttagttcaaataaaaataaactgttgacagaaaggcaggataatgattcatagttaatatttaaatgattcaacattgaattcaacaggtctagattttttacccttacctgctgcttgttaattttgtccttgtttcaccagctataaaatttgaataatatagtgttaattatttagaagagtaatgtgtggatgtagatatatgtgtgtaatacacatatattgtagaattaaatttattatataaggggtccttgaagtactgcaagcattagcacagtgcttagcactcaacaaatacgaatatcattgataatcatattttctcctttttgtgcccccaaggtactctttggacaaagtactcttggacattttgtattctactattgtaatatcattcaggactaaatcaactctaaaataagtttttacatctatttggaaacctagatcttcctttttgagggctatcgttttgcctaggaggccttctttggcttgggttagctatgattaagagggcaagaaaatgtttcccttctgccgtgcctttagagtatgtgtgggtgggaacaatgtgctcatgtaacctaacagcataggagagggaattgcagatttggtgaacttgccaaaccccataacagtagcagatggatgaggtttagagggtgttgtgccctgtcaccagaccctgctgactttagcctggcttttccaaatttcagagtctttgcctttatccagttccctccaggcccaggaggatcttaaaagtaagatagaggttttctaatgaacaagattgcttgatgtgtcccctaagaagcactcttcttttggctaggcatgtgtagtattactttggaaagtgtttgtttcattcccatggcacatttatatgtattaatccctgaaggcactatgaagtgtaatatgaattgcaagttcattttcttctgtcatgtttgactatttggtgctgatgatcttttgcaaagagaaaataatggataacactttctgttcagaaccagaacatgagtctcgaatgaccttaatttttatgcttgggccaaaaagtagaggatcctggcaatttcagtcaccattgtttggtcttcagtgctcataccatttccttaggtggttatcatattttagtttagctcctacattttaaatagatagtagagattcatttttaatgcttgataagcagccaagtttcaggcttaattcacttagtcagtcttgagtcattgctctatcctcactttcatagcaaatatcatcattgggattacaccacaatgttttccttctgaatgaacagtttcacagcttaatataggttagtattttcaacatgcttgattttcaagcatgcttgaataagtttacatgctagaaactggctgggtgcggggactcacacctgtaatcccagcaatttgggaggccaaggagggaggatcacttgatgccagcagtttgagaccaagcctatgaaacatagtgagaccctgtctctacaaaagatttaaaaaattagccaggtgtggtggtgcacacctgtaatcccatctattcaggaggctgaagccggaggatctcgtgtgttcaggggctcgaggctgcagtgagccatgatcacaccactacactccagcctgggaaatagagtgagaccctgtctctaaaaaaataaaataaaataaaataaatgctagaaactggttgaaagtaactgaacaggaggaactgaggatgtggcactcattcttggaaatcagttctggttaaagattaaaacagactctgctgctgtctttcttatgtaaatataaagtccaagggccacacatgacatagaaaaaatatcacttagcttctgtaaaactttttaaaaattccttctttaaatgtttcatgattatacattgtttgcaaagtaaatgaaacaggttaacttcctggatgcttacttttagcagaaatatatcagatagcaaacttgctgacagatgaatcacagctttgcccacctgtaatgaggatacactgctggatcccaggttggtcccagactttcagggtggtatttctggcctccagtccacttagggaactgatcattctgcatacctctctgggattatgttctccacctcatctggcccttgataggtaaacatcccctacctggccaaaagtaacaaagctgaaaaaacttggccaaatctgggaacttgttagtctgcctcttcctgtaccagaaccgcgttccagattgtttcccagggtctgacttcaggccactgttctttgctggccttgacctcagtacttgtcttataaatgactttatgcttttctccctctgcctcatcccaccctcgttctttgtatcctacctctaatttttatccttcagacactttttatttttctcccttgtttgaatatatttttagttttctctaggccttgcttaccaacctatcataccttccagactctcatgctccattccttccactctttccacctcaatctgttctacctcacctgaagactctgataacgagagcaaggtcttccacctgagcctgatggggttttggccagctgacattcctccatcacctaatggtcttagctgccttgtgtcctgtccacctgagatgacaccccttgcatccagttctttgagagaaataattcttattatagatttgtcttaaccgatccgtcaggtttcctttctctgactcatttagtcattactttttctcagcgaatttcatgttggatatacaaactaacaaagcagaacatacttatttcatttacaattttggtaaagttttattatgacacctcattttaggtgtcactcccattatcttgtttaatctgttaacatgcaataaagacaataataaatagaagggaataaattttatgagcagaaagtagtatttgagaattttctgtccatccatttagatagagatttaatagttctcttaaaggcattatttgtatgcccaaacttctgcttatagaccattgccattctttttttttttttttttaaatctagatctgtgcttctggtgtgtaaccatgaatataggtttgtatatcaaaacaaataaatatctacttgtacttgtatgagcaaaatcacccttgaaaatcctttacactttgcttgatacctcagagtttgttttgttttgctttttcatttgcttaggtttttaaaatttaaataaattgccacaatttaaaaatcagaaagtttcaacaaaaacagatttcaagtgcaaaaaaaaatttcgagatctctcaacaatgctacctgcatttctttgccgcaactatatgcttgtgctaaggagcatctgcctcttgacatgggaatgtgcttgctgctttgacacaattcatcactcacctacattacttgcctgggctttatagacatatgagtttgtgcttcttgtcttaaaggagaagcatagttggaatcaaagaggtaaaggcatagacttccacccagcaatgcttttcttttaaaagaaaataaaatatgtcccctaccccaaaatacaaagaataaaataacagtctttcatagtaccactacctagaataaatcattattaatattttggcatatttgttttcagattttttcccctgactaatcccatttttgtcctgtagaattttatttctatatgcaggggtgaatttcttctcaagaagtctccctcattcttaaaaatttactacctttttcctcaagagatataataatcttggttttgtaaagtccattagttttgtgcctaaggcattagactttcctcagatcagagactctcatggttcctagtcagaccattaggcccaagtcaaaaacatggttatcagttaatttcatagggatttaaataggataaagacacagctctaaattctttagtaggttagtttgtaagtgttcataaatgtggagcatttcaagccagattcatcttagtcctgaccttacttggttagagagttgtcaggccaacttcaagccaatggaagtgagatatgagtataatcaagtaagcatccagaccaaagttgagaaattcagctgcccttcatgtgtggtatcatatccacagtcccaagtcacctctattgcccctaaacctttgtacccaagagctctcccattaagaatgaatgtgaatccatttgacttttgctccagctacttacataatgatcaacctctgatttgtaattcctgtgcatgttagcaattctatctcaggtgtttaggatgcaaataattttttaaaaattagtacttggcctcctttgcttgctcccaaaggagaatttaatacatagtatgactgtgacatatgtatttattaaagtataaaatattttttcagttaggtgaaatatagaactcaacagtttggtatatagttggtgttcaactgacgtcaacttcttcctttttaaaaatatgtactattctagcaatatcatggattaaatgggattctgatagcttcagtttgtgttttattctaagtgttctaagtgtgataggtcattgtaaagttttggttcctgggtagagggtagactgtagtgtgaatagtggcctcttgggatagtggaagcagagaggacagtttagaggcctttgcagaagtccaggtgaaagatggtgctgattttaactaggagattagtagtggggagacgaggtttcaaggttgccctgtattttgaaggtaaagctaacaggacttactgctagattggatgttatgtgtaaggaaaagaaaggagtcaaggaagatccctgggttgaatcattcaagctttattgatttctttcccttaagacaccaattatccacgttatttctacctttaagaaatcacctttgaaccattttctgttattaagtggcttctcattcctccttttctgtcaccacctacctgtggaaggttacagattatacctgttttgtgaactttctaacagattttgaaatccctgttctttcatcaaactctcctgattaaggaaccaaagaccagactatttccacatagtttgttcagttggaaggaagggtttccattagctattccgttctcaaccaagttacatatgttgcctccttgctgtggtgcacttatcttttatttggacaatacctgtttccattcatatatttgctctgcaagtcttaattccgtgtttcaatatatgcgcatcaatataagtgcccatctttgattgttagcacctagagggcaattgttgtcttacttgtgcaattaggttctaaataaatcatttttaagcgatgataacattttgattccaacgtagtggctgtatttgataagaactttaatcacattttctccagtaattaggctctttttggctgacatttaaagtgatggaatggtatctttagaacatctggatttttcagaaggcagcttctgcttttagttttcaagtgttggcctctttaccacgctgagttcacaagttctccatttatgacggcatcatgcctttgccattctgccacatgcatcacataattcttgttactggaaagccacttttgtgtttgaaactatttcgaaagggatggaaaaatcccttattttaagaaaaattgacatcttatggtagtaatctaaaattttcattgagttggcttcaatactatgtttttatgaaccatgtgtagcaaaaggaattaattttctttgagtatcaccacacagacttttaggaaccaagaatgatttatttacttagtgtctaagatttaccaacttaagaatggaaaaatcctattggatcataagagactgttcccttccctactgcaggattatgtgctacagtgtatttcctaatctttgttctttttaataacattcttccggtattcatttgaaagtcattactccaaaatatttccatgaaattataatatcatgcctggttttagatggagataaatttctgatgtttgttttataatatccaccaaagtttattttttaaaaatattaagcaatatttatctctttaaaatgggacaattatactagtcccctaccagtttaaataatagcaatattttcttttactttactaactttattatttttggattagtgatattttgcttggaacatactatggactgcagattatttctcagatatactttagaaagaaattagcatggacctcaagccaacaggcaagcagatcagggtttgttttcttttaaaattttttttatttttaatttttgtgggtacctagtaggtgtatgtatttacacagtacgtgacatgttttcatacaggcatgcaatgtataataatcacatcatggaaaatggggtattcattccctcaagcgtttatccttcatgttacaaataatgcaattatatttttttagttattttaaagtatacaattaaattattattgactatagtcaccctgttgtgctgtcaaatactaggtcttattcattctatttttttgtacccattaaccatcctttcctttctgtccaacccccaactacccttctcagcctctggtaaccatccttctactctctatgtccatgagttcaattgttttgatttttagatcccacaaatagggagaacatgtgatctttgtctttctgtacctggcttatttcacttaacatagtgatctccagttctattttgttgcagatgataggatctcattctttttatagctgaatagtactccattgtgtatgtgtaccacattttctttatccattcatctattgatgtacacttaggttacttccaaatcttggctattgtgagtagtgctgcaacaaccatgggaatgcagatatctcttcagtatcctgatttcctttcttttgggtatatacccagcagggggattgctggatcatttggtagctctatttttagttttttgaggaacctccaaactgttctctgtagtggttgtactaatttacattcccagcaacaatgtctgagggtttccttttctccacatcatcatcagcatttgttattgcttgtctttcggatataagccagtttaactggggtgagctgatatctcactgtagttttgatttgcatttctctggtgatcagtgatattgagcaccttttcatatgcctgttcaccattcgtttgtcttctttgagatatgcctattcagattttttgccaatatttttttttctagagagttgtgtgagctccttatatgttctggttattaatcccttgtcagatgggcaattttcttccattctgtaggatctctcttcactttgttgattgtttcccttgctgtgcagaagctttttaatttgatgtgatcctgtttgtccgtttttgctttggttgaatatgcttgtagggtattactctagaaaattttgcctagaccaatgtcctggagagtttccccaatgttatcttgtcagaacttcatagtttgaggtcttaggtttaagtctttaatccattttgatttgattttttttatatggtaggagataggagtctagtttcactctttggcatatggatatccagttttctcagcaccatttattaaaaagactgcattttttctcagtgtatgttcttggcccctttgttgaaaacaagctcactgtaggtgtgtggatttgtttctggcctctctattctgttccattggtctatgtgtctcagtttacactgtaccatactgttttgattactacaactgtgtggtataatttcaaatcaggtaatgtaattcccctagttttgttctttttgcttaagacagctttgactaatctgggtcttttctggctccatataaagtttaggatttttttccatttctgtgaagaatgtcattggtattttcgtaggaattgcattcagtttttagattgctttgggtagtatggacattttagtaatgttgattcttccaatccatgaacatggaatatctctcatttttggtacccccttccattttttcatcactattttatagtttttattataaagttctctcacttctttggttaaattaattcctaagtatttaattttatttgtggctactgtaaatgggattacttttgtgtttctttttcaaacttgtaactgttggcataaacaaatgctactgatttttgtatgatgattttgtacccttcaacttcactgaatttgtttatcagttctaagattttattatggagtctctaggtttttccaaatataagatcacataatttgcaaacaaggataatttgacttctttttttccagtttggatgccctttatatctttcccttgtctgattgctctagctgggactttgagtactatgttgaataatggtagtgaaagtaggcttttttgttgtgttccagatctcagaggaaaggcttttggtttttccccattcaatatggtgctagctgtgggcctgctatatgtggctttattgcattgagatgttttaattctacatccagttttttgagagtttttattatgaaggaatgttgatttttatcaagtgatttttcagcatcgattaaaatgatcatttggttttagtcctccattcttctcttgatatatcacattgattgatttacctatattgaaccattcttgcatccccaagataaatcccacttgaccatgatgaataatgtttttaatgtattgttgcattcagtttgctagtatcttattgagggttttttcattaatatttgttgaagatattggcctgcatatatgttttttgacatgtttttgtctggttttggtatcagggtaatattggcctgatagaatgagtttggaagtattccctcttcctctgttttttcagaacaatttgggtaggattggtattagttcttctttaaatggttggtagaattcagtgaagccatcaggtcctgggctgttttttactgggagaaattttattacagctttgatctcattacttgttattggtcagttcaggttttggacttcttcttggttcagtcttggtaggttgtatgtgtctaggaatttgtccatttcttctagattttccaatttattggcatatagtttctcatagtagtctctaaagatcctttgcatttcagtggtatcagttatcagttgtaatgtctccattttcaactctgattttatatatttggatcttctctcttttttcttagttagtctggctgaaggtctgtcaattatgtttaacttttcgaataccaactctttgtttcactgatgttttgtattattttcttcatttcaattgtatttattgctgctctcttctttattatttcttctactaattttggatttggtttgctctgcttttctagttctttaaggtgcatcattaggttgtttatttgaatttttttgctttccattgttttaatgtaggaaaaggcagaattgctagactcatgatccggacatgaataacttgagtaataatatacataattaatattctgaagcaatttggagatgcacatctaaacctgctaagcctctctgtaggtggcttccgtttacggtccatgatttccagaggatagtacaccagcacttaattgcccatcttttccaagttaagatacatatatgaaatataactcaggaatagtttaaattaatccacatatttgttattatgggcattatgaatacattacatggtggcattgttgacatttctctttttaacctcatggtgtacatattttatattcccaaatatagtttggaaatcaaatgacttataaaaaacaaaatagttaactttggaaacaaaagaatgagccctaatgttatgtatcactttggttggattcacatattgtcctgaagcagtctataattaaataatcatttaaattaataaatattattttttgtccagcaaaccagataaaaatctgctaatttgctacttaaaaattggcagtggctcttcagtgcctcgaaaacaaagtctaacctccctaacatagtgtatgctttagtaccaggccacattttagtcctaccttccatccttccctttctcacaccttcttcctgccccacccctcatatgttagtttgtctcatatctttttccttgtggattccgcaatccaaattttgcccttctgccaactgtgatttctcccatctttacctggtgaattgctattcatccttcatacccaacctcaaatggctgggcatttgaagactttctggacttgattaggtggacctgaaatattttatattctctagggttttctaaggcagagatgaaactttcttcatctctgtattcctttcttcatctagtacctaccacagtatctgctaggtgttcgatggtaggcatattgtaggagcttatggaatttgccaaattattttttgtttttgaaatagagtcttactgtgtcacccaggctggagtgcagtggtgcagtctcggcttactgcaacctccatctcccgggttcaagtaattatcctgcctcagcctcctgagtagctgggactacagaggtgcactgccatgccaggttaagttttctatttttagtagagacgggctttcaccacgtctctctggctggtctcgaactcccgacctcaggtgatctgcccacctccgcctcccaaagtgctgagattaaaggcgtgagccaccgtttcaggccggaatttgccagtaaattaatgttacgataatccatacatggatagattatacttttttatattatttaatttaattttaatttttaatttttgtgggtgcatagtaggtatatatatttatgggttacatgaactatttgacataggcatgcaatgcataataatcacatcggggtaaatggggtatccatcacctcaagcatttatcctttgtgtttcagacaattcaattgtacgcttagttaattttaaatgtataattttttatgatagcctgttatgctagcaaatactagtatatacacattctttctatttctatacccatagattatgatttaatgaccacttgccaatatttcctattctgattcttcatatttcacatatgtgaagaaatctgtgcctattgtattttgatacagactttttgcttgcctttactttgaattcagtggtagaattttattataataacctaagataaattacctaatcttatgtaagtatatactaaatattgtgtatatgaccttctgcgcatttgcctgagtgaagagtgatatattattaaagggactctcggaagcatttaagaagcattgcctattaaaaaacaaagtgtaacatgaatccatagctctccaggtgtttggaatctctttggaggaaactcatacatgaaacaaacaaacaaaaatgtaaacacagttgagttaaaatgctcagaggaataatcactataggaattcagagaacggtgtgttgagattgttaaagagtaagggaggaagtaggattttagagtgattttaaggatgagtaggagaggagtatattgcgggagattgggagcattagagcagaggaacaacctctgaagagagtaagaaatctttcctttccttggtcccttcttatgccatcttttctctggacagtgttctttgcctgctgcgttgttgctcagggtcacattagcttagttctgggaaagcatccagtaggaaacgtgtaagaaacttcctggccatagcagaaaattgctgtagtatcaaattgctttgttgcttgggcctcacatctgtttccttgccctttcaccaacccctgtgctactaaagtggatctcctgattcctgagtccttgatcttttgaccattccaaaatgttgctattatgccttggtgctctctgcctgtttgatttctcctctacctttcttgtctgccctcctgtgacctatatgttgtaacgtttgcctggctgaagtctgaagactcagactcttggctggttagtatagctggcttactgtccagctgacccactccataggtgatattcccaaccagacaaattggagtcctggtctcttgcccagcttcttgttctgtcataacaaccaacttgcttggtatgaagggttcatttgtgggaatactaaaaactttgtgagaatacgcaaaaagaaaaaaaagagagagagagacagagagagagataaagctaggctgtggaaagatttgcaagaaaggttgaagtttatatttcgttctctaggccagtgaccttcaaagctcaagtttgcacctcaaaagtaggcaagatgatccatggggtatggacagaaattattatattataatgactggctcagtgtgtttctatctttaaaaagtttttttctaagaaatacagttatttaaaatacagaagaaacaaaaaaaccaaacatttaaaatataaaataaattaaaaatacaaatgtttaaattgtggattgacccaagtcaccccatgtgtcagttggtcacatatcaactttggtaacaggcttctggaggaaagagtatgaactccgcgtcctggaggcgctgacagcaggaccttactcatttattcactttcagcttgtttgaggtattgctgtttatgcgtgcctagatttgcagattgtgtttttagccttaagcaaaataacatttgtaaagtggtcaagtgcctttaaaagattcctgccaagagcctgcaggttgaagctactacttgtgacgcagtcacatggaggagctgatacttgtgctcctaatactagctttagccacacttagagcaaaaatcagtggtattttaatcagatataaccgaacttctaccaccaaaagttgataatttccaagaagactattagaaaagtgaatgtatccaaatgcctttgacaaagaacctcaccctaagtgtatattccactttgagataatgcacattgtgaatatagtattatgattagccagtcatttaaaaatcgtgtttatttcatttttatactcaacctttaaaatgcccacttttaatggacacttttagtgtctatgtttagttttatatatatatattatctatctatctatctatctatctatctatctatctatctatctatctatacacccgcacacacctgtatgtatttaattttgagaataaacatatatattatagataaatatttatattttgggcacatgatcaaaaagttttcaggggattattctgtggtcatctgattggaaatttttagagaatacaggtactcccagtgaggggtggtttctttaataacaagaaactgaaaactgactgaaaatctaatcttttatgaaaattacttcttagatgctttcagaaatgttgcttcttaccaatgtgatacataaaactaatctcgtttgacagtggtgatgacaagttttttaaatcagttttcctatgtattcctgttacagttttggttgtttatttgaaccttgaaacaccagagcaaaaggaggatgatgttaacctagtatgatatggttattgtattagctaagtagtagctatgtcttatttaatattaaaaaacagcgagtaattcgtgtgttttctgtccgttctacaaataaacctggtaatggagttttttcagagaaccataacatctgaaacacattcgatgggtttaccaaagaaagtaattatggctgtaaaatctgtgtgactatttttaagtgaagttcttcaggaaaagggggtagacagcataatgagaattctatttttaacttaggtcacttttttcatggactgacaatgctgtgactttttcagacagacaatgagccatctagcttttgaactctttcgtattctgtaaacattaggaagcaccagtgtgtctcctaatgtaaacacactgatccagacctcatgaggtatattcatgatcatttactttgtttattcaaaggtcattaaaagatgtgatttagatttgttttcttaatatttctgtggaaactaaaaagctaatctacaatgttgttttacatacaggtttacctgaaaggaaaataaagtttattttagcttttggcaatttttattgatataaaacatataaagtgagtcacacaaaagttgaccttgaaacttctcatttttcatgttagtggttttaatactattgcatttgaaatttttaacttttaataaaattgggttaaattgtatccctccttttctttatatatttattccgcctctgttatcttatctttctgcatctttagaagattataagcttttggaatcagaaacaatgtcatagacttttcttttttttgtcttcccaggaagttgattaaagtagaaactgtcatggtcccacagtttcctccagtagctcaggttgaggacagattatacataggacataaggaaacagctgctaagtctcctgttgagcagcagcataaaagcagcatgtcaggtctgcagtactgggttcaaatcttggctctgctaattctaagctttatggagtgggaaattgactccatgagtcaatctcatggagttgttatgaaacatgtaagtttcctaacaaggtgcttggtaagcggtaagtacttcatgaatatgagctgtttttattatcagtatgattacgtggaaaagagaaccttgttagcaggggtatttaaggagaaagtaacttctcaaaaagaccagtggtgaaagcagaaaggctattgcagtgtggatgccaatgccccttctaaggaagcaagcaggagggaaagggaaaggagaagcagctggacagaagcacctgtgtcagcttaaatgacagtaccaaacatttctcctgaccttctgccagcatcatctttcttaaaaaataatttcaacttttattttagattcagtggttgcatatgcagatttgttagttacagggtatattgcatgatgctgaggtttgggatacaaatgatcttgtcacccaggtagtaagcatagcaccgagtagttagcttttcaacactttctcccctccctccttccacattctagtagtccccactgtctattgttgccatctttatgtccatgagtacctaatgtttagcactcccttacaatgtggtataagtgatattggttctccataccatggagaacgggggttatttggttttctgttcatgtgttaatttgcttaggataatagcctccagcagcatccgtgttcctggaaaggacatgactttgttctttcttatggctgcaaagtatcccatggtgtagaagtaccacattttctctatccagtggactgttgacaggcacgtaggttgattccttgtctttgctattgtaaatagtccagcatcatcttttgctcaaagttaattaagtccacttctcaatcctatattttccacatttatttctctgtagtagaaatttgggactttgatgttggggttcgaaacatatttttattttccttcatgaaatactgcatgagaaacaagactaggcaaacattttaacttgtaagtagtaagtttctcattattaaaatattcaatgtataaatcatgtgccacacttagccaggggttcatttttccactggctaatttggggccccaggaaaactgagcattatagactgtggaaatatagccagggccttctcagtgattagatattactgagggcagggtggaatcagtgctctgcatttatcccattacagctttggagtgaaagtgtcacctcttcccatagcagcaattacactagcaattagagaatcaacacttttatgaatttcacatctggcccaaagtacaagcctgaatttctagactttttactataattatcctgttatatcaatatttatcattttcttagtgggaagtcttatttttataatttggtagaagttatctaaccaattagttctaataaaagtttaacattaaaaagtggtagcataaaaatagttttagatttaatgattcatatacacatcacattataaaatgtcttttgcagtaaagttaaataataaaatgttttaaatgtctgagttttattttttttcttcgttgcaggaaatttacatttgatgaggaaactaaatatcttccatttaaagtcataggcctagtttatcataactcatgcttctcttcccattttagagtggttttctaaatataatcacaaagtatgaagtttctttcataaaaccttattctgaaatgagttccatgtgagtgtttacagggaaaaccaagccaaccaaaaggcactttcaagattcatgtgtttgctttatttaaaaatatctataattagttgctcatagataaatgatacttttgtcctgcctcaacatcataaatctttgcgggtgaatattgtgctataatgttttttcaccatgatatgaattttaaagacttaataagcccctcttagcatggttactttaacagggaaaattgaacccttggtttaacatatgaagtagtgagtggggctttagtaatggatccagatttagctgaataatacagtttgaatatcccttatccaaaatgcttgggaccagaaatattttggatgtggggtttttgcacattttggaatacttgcattgtacttatcagttgaacatccctaatccaggagcccaaaatgctccaatgaacatgtcctttgagcatcatgtaggtgctcaaaaagttttagattattgagcagttcagatttcagattttcaggttagggatactcaacctgtaacactaaccttaattgaagctttaccttattccagacgctgtgctaaatctttcatagagactcgtctcatttaaacctcacaacaaatctttgaatgagatactcttcttgtccctatttttaaaatgatgaaactgagtttaaataaaactgtgaatgtatttaactcttctaagatcacacaactattaagtggagataaaccttaaggctagatgaagagttttaattttatgttgagtaaaacatacctttacagcaaatgtactattaatatgtaagtcaaagttttgtaaatgtgattattttatctaatctttaattaataaaagagatgatttccccatttctgattgatttttacttgccagcagctgctagatcctttccattaagtttataggtcaagttgttaataatctttaaacagcagtttaaacctaccagctaagtttatttattaacaacaacagaaacaaaaacaacctgtttttcaacattccttttctaataagcagttgttataggaccacaatggaatatatgttaattgccttcaagatctcttaaaagacaaattctctaagtaaccactggagcatttatgagcaaagagattttattgtccctgcctacatgctcccctaaaaactggatgagttgtgatgtaactttttttcttctaagaaatttaacagttacagaaaattcaaagaatataccaaatatctccataataaaatattactactgttatattttccttcaattattttgttaagaaatattgcaaacataaacttttaaaaaatgttcagtattattaatttgtgggaattatttattacctagaaaatgctcacttatccagacagcgttctaaaagtaatcatagaaaaggtattccaatgtactttaggataatatattcttaattatcgtttgtatagggcattatttattattttaaaacagcaagtaaagaatttaaaatgatcagtaatctggtttaaaggactctgatgctaaaataattattttgagatttgttgtgtagaatgactggattttgacttaagaattcagtggctgtttaatccccctgactttagtattacttattaatctctgtgtcctttggtcaggaatttggggaagagccacatgaactgagcatgactaggtccacaagcttgtttatttgtttttccgttgtgactgaaggctaaactcttttagaaaggcaaaaggagtctgcaaaaattaacgctgattgtgagattggtggaaagagggtgggaacaaagtaaaaaatacacatcaagttctaaaattagccactgtgatcaatgcatgctaccaagggggtgctgctggctgacctatgatgggaagaccctcccccagcccccgtgggtgctgatcatgctaagttggcacgcttcatcattaaacaaagtactaagattaattacttcaaaggggtagattagttgattttaactgtaaaaatgcacatatttaacagtttagcatttcatgatttatgtgtataaacactgagactctaatggtaaggcgtttggccatacctaacataatttatttgttcatactttcaagcccttgaaagtttttgatccccttatatttaaggtggcaggttttggtttagaagggtatgggcagagaatgttggcctttctgtagcatttctaagaggtttttgagtgtgaactagcaccagggcttagggaattggagagataggaaggaggggatatttggatgcaagatgtcattggcctctcactgagtattcagtctaggggcaacctagccttaattatgtttttatggatttttttttttcaagaatcccatcccagtgagttgtttagaagcaggattatatttaataaggcaatggcaattttttaaaacatggatttaatataataatttttcatttcattttaaatgacaatttaataactgacttaacatttaaatatatgaagatattttttaattggtaacatcattacaatgttttataaatctaaaagaaatttaaattttcaacaaattcaccactaatactgggggacaattctagatcaattgattaggcctcctttttgatgaggcccaggcattgaatttttaggagctctgctggtgatttcatgtgcaccccaggtaaagaagcaatgttttatatagtttcatccacagtgtacatattattcgatattcaatttacatattctatttcacttaattttatagggaatattttccttgtttcttcagcgttcacaaatttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgccctgccacaaatttttaattagaatgtatatttgtgtatctcaatttattaaattattcatataatattgaatatttcattgtaagttagtagaaaacaatggtgcagtatcatttgatttctctgttgaatcatttccagaccatatcgaaaagaatgaacaaaccttgctgtttgtagttgccacattgctttcataagggatgtagcaatcacaatactatcagcaatgagtgcttgtttcaccacaactttcctggaattgggaattatcgattactaaactcattttaaatcttcattgttttcaggactccaaaaatgaaaagaaggggaaaatgccacaaatagctatgtttataaatggagccattggtagttccctggaagtagagagatgtatacagtgatgtgcctacaactagatccaagtaggttattctaatttaagtgactttttaagtcattaccaataaaaactttaaagatataaattacctacaaccatcaagaatggataaaaattaactactacagcttgtgccaaccatgtgctagcagtgggaatactcaaaataagcaaacaaaacttcagtgaatcaaaacaaaatcaacaggtgtaacctgcttcacattcttcaagcttatatcaagctctgaatctgccaaactcctgaggaagtcagtttcctgtataattgagagataagctctattattgagagaaccaacttctttccttaaaagaataaaccagctagagtctcattttgtattgtttattatcccttgactacagaaagcgtgctaccaagcagaaagcaggctttgtcacaaataccaagaaatccagatgcttagagaatctgagtttttattgttctctttctcctcttcctctccctcttcctctgtcatttgtaccatcatcatcttcatcatcatcaccactatcattttttttaaagaagcatttgtaaagtgctcattatgctgggtactttatctgtcttattttatttagtctttattggtagtagctcttaggcagatatatttcactatttcatttttcaaatgagaatgagctgcaaaaggatgaatacctaattcaaggttacacaactagcaagagcagaaactggaatttgactgaggcatattagatcctacgatctgaatagacttgctaaggctgtttggctttcacagttcagatcagtttagagtgctggatcagtccaatctggtggctgtggcaggtgctaaatcttgtaggaagtagtcccaatgtttgggaccagctctggttttagtgaccccacagaaagcctaatttgactttcaggaagcctgcaatggttttatgacggaccacatctactagactaagtgaaagcccagatccggagagaaatgatccaaacatctatttcccagtggccagatctgttttattaagaatcacattattaggtttcaatgttcgggctattttcagcgattttatctcttgcatcttctacatccatgagtcaccaagttcggtgtgagaggtagatagcaaagattagtggaacaattatagaatttgaatgtacatatatctgagcttgaattccagccccattagttagtatttttataactttggatactaagtttcttaatgtctgtgtgcctcagctttcttgtctttacactgtaaataataataagtttccagggttgttatggagattaaatgagatatctatatataaacatgttatgcaatgtcttgcatatgataggctttcttcctcccatgtatatttactccacaatgattatttaaaccattattttatatttccacttcttatgttactacaaccaaggcctccctctctttacctcttagtggaagaaatttacaccagccataggggtctttctcaattcctcctttaattgtgtctgtccttggtttaggaattcacagtgtgcataacccagagacctaatcaatctggccatagaacataaccctgccctaccctgcctgatgcatctcatacattttgagttacatttctctaaaagctttgttttaatttgcctgctaaagatcatcctctggttttctggcaatacataaaacatttcaaattacatgcatcctcagatatcaaatccaaacttctttttctagtttttaatattttccagctgctattagcttccttcctgtcacccagatcaagaaccacagaatcgtaaaggagcatagaactcatgtaattatttccttttagcccaaatctactgttcctatctcatatatacttctcagcagcatctatatattcccaaacaatggatgaaagagaaagccttgcccgatcataaaagcaatgttttctgattactagacagatggtatttagataggattggagacttcaaaatgatgttgataagagaaagtaatattgggaggtgtagttgatacatataaaattctgtttttacaccttctaatttgttcactttatttttctgggtcttatagtgattatgactataactgagataaaaaataacaactggactttgagaaattaaagttgttcctcaaagtgatctcttttcttgctaaaatgtactataattattaaatgtatttgtgattcaggtaagttttagtttaagctttgagtgtcgtttcattaatggaaatacagataattgcttgagaactcattaaatgtatgtactactagaatagaaaggaaaaatattttgggctgggcgtggtggctcacacctgtaatcccagcactttgggaggccgaggtgggcggatcacctgaggtcaggagttcgagaccagcctgaccagtatggagaaaccccatctctactaaaaatgcaaaattagctgggcatggtggcacatggctgtaatcccagctactcgggaggctgaggcaggagaatcgcttggacccaggaggtggaggttgtgatgagccaagatcgtgccattgcactccaacctgggcaacaagagtgaaactccatctcaaaaaaaaaaaaaaaaaaaaagaaaaatattttggaagagtaatatttacataactgtcttagcctgttcaggctgctataacaaattaccatgggctgtgtggcttataaacaaccaacatttatttctcacagctctggagactgggaagttctaaatcaaagtgccaacaggttcagtgtctggtgagggcccacttcctggtttataaacgttttttcactgtgtccttatgtggctgaaagggccagcgagctctcttgggccatttttataagggcaggaatcctattcatgcaagaggaaccctcatgacctaataacttcccaaaggctcctaatgccatcgccttacgggttagagtttcaacatatgaattcggggagacgcaaatattagaacataacaaatactcttttgaaaatggtttactggcttcctaaatttaaaaaaaaatttctcttcagagtctttttacttttcattattttacattcaggtgcccactagaatttatgtacctttaacagatttaagagttatttctaatatactagtgagaaatgattaatattttatagctgattcctataataaactaacccaatcaaaaatattttattagatgaattagagcagttatcatctcattagtatcttttcctctaattactacagaatgtaaaatttatttatttctcctcattataaggcaatttcctagagtgaatagcacaacaaaaatagtgtaatgtttagaatgtaaatgtggaattttacacattccattttttaaaaatctaactcagttcccctgtacttactaaaattcctcttctaaatgtcattaattaactactggctgtcaaattcaattgtcattttctatttctcatcttcctttgttattgttaactgcatcctactttgtaaaactctctttcttttctgcattttaggtttaaattttgttatcaaatcatgtgaactatgtaaaaagtgagcacttctgtacctgcttccattttaataaataaaacactatcaacaaatttcaagttccctatgtgttcctcccagattgtatgttccttcatgcccaaatgaaagtgtaaccattatccaaacttgcatgtttacaatcacatgcattttaaatattcttttgctacatagtatgtacctgtacataatgtgtcatgtcatattttggtatattttaacttttctttaaataatatcacactgtgtgaatgggtgtgttttttagcacctattttttgttttttgtttcatcattcaacattgtttttatgacagtcttccttatttatttatttattgcttttggtttctgggggtcttgtaattgactgccttctcttctagctgcacaacctctccctatgtattccctgccgcatctggcttctataaacctttcatatttttctcagatccaggactgtctaaaaacctactgaatatctccaacaggatatcccacaagtaacataaacttcatccttcaaaatgtgagtttattatcatctccccagagctgcaatttcttttgctttttctttaactcaaataatggcacactatcaaccctgccatctgtgctgttaaatttagtcattgtgaaatccctggtgttctttacccttcatggctacttaaatcactaaatcctctagaggctaaaagtaaaaactaagctgctggaacaagatatattaatgtagtaatgcatatatgtataataagtaagaccaaacccaataaagttgtgtcttgttttttttttttttttttttctacaagagtctgagatgtctgagccccaggtcaatgcagcactacaacatgtcttccatcttcagcatgtgacttccgaggtcatccttccagcctgtgggagagaggacagtgcaagtccggggtcaaaaactgactcataagcagggcctaagttgttcaatcacttctattcacactctactggttgcaaggggtctaagaaaaacagcacctaagtgggtagccaccccctcgccctaactctatcagtattggaggatagactttggtggacagtcccgtatctgtgccacacataggttcataaatgtcttccagggcctttccttctttacctcgtttcactgccacactgtatggtgtcaacatcgcttgcttaaactattccaaatagtcttttgactgattatattttcttcttccaatccatctcctatgttaatgtcagttatctttctaaaatattggtgttttgttgttgcccttcaggaaaattttaagaagtccagtatctctctgtggcctctgaaatttttatgggataaactatatgacatgtgacaggtatatagaatacttacaacgtggccttaggttgtttctctggcttttcactcattccctatattctatactttgaacacatttgccggctcactgtcacttactatgtcgtgtattttcatagctttatgtctttattttcggagtctcctgtgtctggaaagctatttttcccttcttcctctacagtggtcacctcctatcagtagctttcctagataaccttacaactaaccaaagcagagctcattgctgctttcccggtgttatcatctatataaaccttgctactcagaatgtggtctgcagaccagtggcaccagcctcacttggaagtttgttagaaatgcagaatgctggacccaacctgacctactgaattagcatctgcatttgtaactagttcccatacgatctggtacggctggtcctcaggctttagaaatagcattcatcatattaatgacagttggttcttgatgcatggtctcctgtaggccttaagtttctcatgcagaaactgtatcttgttcaatgtggagccctcaaaaccttccacagagtatctgctacatagtggctcctgctaaatttatactgagggacttgatttgtattttgtcttatctaatggtcctataagaagttatgcttagaatttgggtgttttcagcactaaacccaccaaattatttatttctatgagaaatagaagcatttttgcaccttctaaaccatatcctttgaaacttgtgagcattacatgaatgtgcatgcatcacataatttggataggatttattgcagtttatgattataatttttcattatgctgctaaaggaaccattagctaaaaggatattttcataaacaaatattatagtaagggctagcctaatgtatataaaggataatatatatttttaaagttagaaattgcctctaatttttaatatgtactataaaatccacacaatttagaaattttctttgaaatcaatttaaaagaaattgttttttaaaaagtatgtaagtgtttaaatatataaaatttaaatatatactaaaatataactctgaaatttaaatatttactaggatatatacataaaacagcttgctgcattgacctggggctcacacacctcagactcttgtagaagaaaaaaatcaaacaaaacaatacagtcagtgttgcaagctgcaatatagaacagtcccaatcttgccttaggttatttgttctttttttttattattatactttaagttttagggtacatgtgcacatcgtgcaggttagttacatatgtatacatgtgccatgctggtgcgctgcacccactaaatcgtcatctagcattagttatatctcccagtgctatccctccccctgccccccaccccaccacagtccccagagtgtgatattccccttcctgtgtccatgtgatctcattgttcagttcccagctatgagtgagaatatgcagtgtttggttttttgttcttgcgatagtttactaagaatgatgatttccaatttcatccatgtccctacaaaggacatgaactcctcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtgttttggctgcataaatgtcttcttttgagaagtgtctgttcatgtccttcgcccactttttgagggggttgtttttttttttcttgtaaatttgttttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggtaatgcctaggttttcttctagggtttttatggttttaggtctaacgtttaagtctttaatccgtcttgaattgatttttgtataaggtgtaaggaagggatccagtttcagctttctacatatggctagccagttttcccagcaccatttattaaatagggaatcctttccccattgcttgtttttctcaggtttgtcaaggatagatagttgtagatatgtggcgttatttctgagggctctgttctgttccattgatctatatctctgttttggtaccagtaccatgctgttttggttactgtagccttgtggtatagtttgaagtcaggtagtgtgatgcctccagctttttcttttggcttaggattgccttggcgatgcgggctcttttttggttccatactaactttaaagtagttttttccaattctgtgaagaaagtcattggtagcttgatggggatggcattgaatctgtaagttaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctattattggtgtataagagtgcttgtgatttttgtacattgattttgtatcctgagagtttgctgaagttgcttatcagcttaaggagattttgggctgagacagtggggttttctagatatacagtcatgtcgtctgcaaacagggacaatttgacttcctcttttcctaactgaataccctttatttccttctcctgcctaattgccctggccagaacttccaacactatgttgaataggagtggtgagagagggcatccctgtcttacgccagttttcaaagggaatgcttccagtttttgcccattcagtatgatattggctgtgggtttgtcatagatagctcttattattttgaaatacgtcccgtcaatacctaatttattgagagtttttagcatgaagggttgttgaattttgtcaaaggctttttctgcatctattgagataatcatgtggtttttgtcttgggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttgtattgattggaatagtttcagaaggaatggtaccacttcctccttgtacctctggtagaattcgtctgtgaatccatctggtcctggactctttttggttggtaaactattgattattgccacaatttcagctcctgttattggtctattcagagattcaacttcttcctagtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttttctttattagtcttgctagcggtctatcaattttgttgatcctttcaaaaaaccagctcctggattcattaattttttgaagggttttttgtgtctctgtttccttcagttctgctctgattttagttatttctagccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttcttccttcatttcgttatgtacccagtagtcattcaggagcaggttgttcagtttccatgtagttgagcggttgtgagtgagattcctaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtttaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggcattctttgtctcttttgatctttgttggtttaaagtctgttttatcagagactagtattgcaacccctgcctttttttgttgtccatttgcttagtagatcttcctccatccttttattttgagcctatatgtgtctctgcacgtgagatgcgtttcctgaatacagcacactgatgggtcctgactctatccaatttgccagtctgtgccttttaattggagcatttagtccatttacatttaaagttaatgttgttatgtgtgaatttgatcctgtcattatgatgttaggggtgattttgctcgttagttgatgcagtttcttcctagtcttgatggtctttacattttggcttgattttgcagtggctggtactggttgttcctttccatgtttagcgcttccttcaggagctcttttagggcaggcctggtggtgataaaatctctcagcatttgcttttctgtaaagtattttatttctccttcacttatgaagcgtagtttggctggatatgaaattctgggttgaaaattcttttctttaagaatgttgaatattggcccccactctctcctggcttgtagggtttctgccaggagatctgctgttagtctgatgggcttccctttgagggtaacccgacctttctctctggctgcccttaacattttttccttcatttcaactttggtgaatctgataattatgtgtcttgaagttgctcttctcgaggagtatctttgtggcattctctgtatttcctgaatctgaacgttggcctgccttgctagattggggaagttctcctggataatatcctgcagagtgttttccaccttggttccattctccccatcactttcaggtacaccaatcagacgtagatttggtcttttcacatagtctcatatttcttggaggctttgctcgtttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcagttccctgtattgcttattctagttatacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgctttttagagtttcccgtttttctgttctgttttttccccatctttgtgtttttatctacttttggtctttgataatagtgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttccaggctgctttgtttacctcagcaagcctgggcaatggcgggcgcccctcccccagcctcgctgccgccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccaggtgcgtccgtcacccctttctttgacttggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctggcttctgcgtcactcaggctgggagctgtagaccggagctgttcctattcggccatattggctcctccccccaggttatttgttctaagtgctgacaacatctcagattaaaagttgttttcagtgctattctttttatgttactattaatgattaggcacattttctttaaatagcttttgatcatattagttggtacagtatggattatactgcattgactacctttaagttgttgactaatatgtagatatgtttctttttttctgtacaacgttaaggaaagtaaatgactgtatcctacagaaacattaagaaatcatttttaagaaaagtttccatttctgcttgtattttagtttagttttttatccatattctgttttatagcagatgaattttaaaaggccagtctatatttaaaataggcattaattttagccatgggtgttggctttccattttaatggcctgaccactaaacatcttctttttgttgtttctttttaaaaaatatatgatttgtctagcaaatctttggtaaaaaaaatacatttcttaacagtactattttaaggacagattatgctgtgattttgctgcaacagcctcctgagtgatagagtcagatgttctactttcttattagaaacatcgatgccaatatttactttcagtcctggtctaacaaaatgaatacgttgccagaggcatatcatgagtccttccggcaaactccaaataagaaacaaacagaaatagtgaatgagaatgccaacttaaaaaaaatacgtatttttattatagacttaattggccaagaacattcctacataatctaaaattcataacgaccaaatggtaatacttttattgcctgggtggttttgtacatggacttttataacttggtattcaatgtatgaattcttgtcaatgaaacagtatcattttgtgtctgagtatttatgtgtcttttttaaccaaagaaaaaaggaccaaatattagtgttagccaaaattttaatttttaaatactagagagttatttctaaatttacgtgagtccaaattttcaagcagaaactataatcctcctttgcttacctgataatttttactgccctaatcaacttggtcttgcactactgtaaataacttacatgaggaaatattgtggtttcatgttcggtaacaataattttacctaggttttaatgaaatatctctcacaatatgagagcctgcataatatagaatatccaattcattaaacacttgcagagggtcccctctgggccatctgggattactactgcctaactttgaaggagaaacctaaccagaatattttagtatgttgcatcagtgataagaaaacttctgaacttgtgccatgagacctcagagaaggggccactttgttcatcccaaggtgactcggaatagatgacaccaaagctgaaagatttgtagatttttttataggtgaagagagagaggagggagaaggaggtacttgctggaagtgtgtcctggcaaagcaagcagcactggtaaaagcaggcagatccgacagaatgtcgtgtatggatggagaaagagaatgaaacagcagtttaagatgactggtgggtaatgcaaatttgagaagtcatgggggatgaggctggactggtaaacaagagctaagtcatcaagggccagatatcaaacaagtttatacagtgaagatttagggcaaaggggtgatgtggaagggatgagttttccaaaaagttagtcacttatccaagaatgtatccagctcacttaatgaagctagctcacttatggagctagatacattcaaatagtttctataaatcaaattccttttcttagttcagttctcctagtgatgcccaaattgacaaatttcactaggtaaaatgtttgcttttcttgaagtaatataattctacctggaagtcagcatatttttaaaaatcacaaattgtaagaaaaaaatcattttgcttatgtgccaaattttatatgtgattatgttgaagtatggaaaacagcataattcaacaaacattttattaaaattgacaacacaatttcttaaaagaaatattttaataatggttaattcctacttgttagtctataattacgcatgtttcctaattgatgaaaagaaatgaaatcactctttctggacaggcatatacttgaaaatcctttaccgtatattggcttagagaaaaattgatgttccttgctgcttaaataaatttaagcccctaaaatctgaaaacttaattgaatatttagtggacataaaatgaatggtccataagagcagaggcacaaagttgaaacagcaaagataagcatgagggactctagctttagatttttactttactcactttgttttattttccttctccacataaattgttataaattttccacttgctagaagggatttctcaagcattgcagggcagcttagtttattttcttcgtgggtaaatctgtatgtaatcattttagcaggtgagagaattcaaggaagtggtaacttgccaggaaatgagttctcagggctgtgaatgttttttcattagtggtatgatttcccaaatatcccatttcattttcgtgtaaaaggtacttttccatctcatcacgtctacattgagttagtttgcccactaggaggcactctttccaagctctgtttcccagggtgtcccgctgactttccccaataaaaacctgtgggtatttactcatcttttgtgtttttgttactaagctaagttttgtaccttgcttctgtttgctagtggaaatggccttttttgttgttgtttaaaacaaaccaacaaaaacaacttccaaatgttttggttggtacttgtttttcaaggtactagtttgtggagagatgcttaacttactagaaaaacacaatgtgtttgatatcaagtgttcactaaaagttctactattacctttaaaatagtaatattctccctgatatttattttcaaatgtaaaaacatatagatctctaagtatagctcagttgtgaacaattgaaaacattaagtcaccatagaatgcatcgctgcaaaagacaaacagtgatttgtgtcagaaaaagctttcagattaaaaaaaatcagagaatataggcttgtcgtgagttgtgtgtgtgtgtgtgtatacatacacatagtatacacacatacatatatgtatacatgtaaaaacacacagcaacaagactgtataaaaaggacacttgctcagtggcatgtgaaagtcactctcatcacacattgtgctggtcacatattgatatgcaggccccacgtatataattatacgtataaaattagagttattagtgatcccggaataatcactctctgaagacttttaatgaacttcaaattgaaagtggttggtttacttaaaaagcatgatttctcaaattttttaatctcagagcttgagacctggtcccatcaattcattcacttattgagtgtctgctctgtgtcgggccttgttctatattttgtttacggcaatgaacatacaaacaaaatttactcatggtgtttatgtttggtggtagtggtggcaaggcaggggtgcacaccagagtaggattaattgcaatgacaaagggtaatgttgtaaaaggattaagagtgttagaagcagaactattttatatagggatgccaaggaaaatgtatctgagaagatactatttgagcagagatctgagggaaatgaggaagaaagctatgcatgtagctgggggatacattccagataaaagggcaaagcaaatatagtcctgaggtttattttaagggcagtaagtgagtctggttctggaatgtgagggggagtggtgggagatgaagttagtgagatgtgccaggacctagtagaatttttctccaaatgagatagaaagtcactggcagggtttgtgcagaagagttggttgatgagactaacttttcagagaatctctctaacttttgagttgatttggtattcaaaaaccctcactattaggcctctacttggttctcccgggaagttctctgccctccaatccttctgttttttgtttaggttccttctgcctggaatgcccattttcttgtagcaggtgtgaatctcagtccacacacagagatatgtgaggaatataactatttgttcacagctgaattgagccctattctgctaggtggtatgaacaatctgtcaattctggtctcctttggccttattctgtggctgcacgtaggcctttggggactcttgtaacattgagccatctagggaggtaggcaaggggcctgtcgcaggcacagctgcctagacacagactgtagcctttctactccagaaactatttcagaaaagtagccatgggttcttactgacctcagatccctaaacctctgcaggggttttgtctgttcttcttgctggaagttggcatagtctcacctcattttttcactctctttgcttcctcttcatctctccccttccgaccctacaggtctctagatctgttctggcctagcatgggaagtcttgcccttgctcagtattcttccaggcctttgatctcttccttatcttcattctgcttataattgatgtcttccctgggcggtgaatgctgctcaatcttgctattgcttgaaggggtggagactacaacagatgaaaaggaaaaccagagggaaaaaaaccttggttatttcggaacattattctgccacttacccttctaagtctaataaaatcctgcttttcaggcccatcttgtttatcagctccttttagcaacctgcccacagctactgatctctctcatggtaggagataagcacttcctctcgtgtgttccctgggcgttttgtttgtgtcctccatcctgaaccttgtccatgggtatcatgtcaccttttgaattgttgttccagactttcaattgttgggtccttgagatcacagggaccactgcttcttcagaggtgttttgtttttgtctcagctagggctgccataacaaaatacaacagactgtgtgacttaaacaacagaaatttatttctcgcagttccggaggctggcaagtaagagcagggcacttacaaagtagattttattctgaggcctcttctcttggcttttaggtggcctctagctcactgtgtgctcacatgacctcttctgtctgtgtacttggagaaggaaagagagcaaattctctggtgtgtcttacaagggcactaatcccatgatgagggccccaccttcataacttcatccaacctcatctaaacctaattacctcctagaagccccatctctagttaccatcacagtgggggtcaaggtttcatatatgaattttggaatgacacaaatgttcaatccataacagttttgttttgttttcctttgttttcatctctggcatttatgatggtgccagttataatggagaacagtaaatgcttaatcagtgaaagtattaagcatattcacctagacaagaaatccttcctattcctgtcaataaggttcaaggctctccaatgagaaattagattgttcagctctaatgtttgtcaaaacagaagttaatactttcacatactccatagttttgcttttaagcctttttgatgtcataagaaatatagaaaattatatttgttaacaatgaggctgctaatggccaggggtgagtactagagctttgcatctctctgctacattcagttccagcttccgcacctcctagaccctgactggtatcagctggcagaggggaatagttgtaacctatttgatcatgttttgctttctaatatagagaatagagattgattatgcttttaaaaattatggaaaaccatagttattcaacagaaaaaaacctgtaaaaaatgtggcatgtgactttctaatactgcttttgttgttgttgctatttagttcttaagtctgtgggccccacaaaatttatgcccttacacctatacacataactctggtatgtgttcagcacaattaggaaggacagatgtgtgtccgaatgtcatatgactcgaggcagtgtttcttagaatgtggtttgaaggccaccttgattgtggtaacctggattgcttgttacaaatgaagtttttccagcccaggcagtgacacacacctgttgtcccagctacccaggaggctaaggcaggaggattacctgagcctgggagttgaaggctgtagtgtgttgtgatggtgcttgtgaataatcactgcactacagcctgagcaacatagcgaccaccccatctctaaacaaaacaacaaaaaaatgcttttcaagagttttagaataagactcttccatgatgaggcctgaaaatctgcatttgtaataagttaccaggatgctttttatgtaccctagactttatgaatcattgctctatgtggtgcagaaagacagtagcaatgttctgcagtattcttccaatcttcttgatttcttctgggccaagacattttggattatggatccaatttagttattactggatcattctgtttttttattttctgtatatttctaacattaattatggtgttctcctctctcacacacacacatacatgcacatacacacattctagctgtatctaaaaatatatctatctattactttcaaatttgtaaatatatttttgcatctctttaggatttttaaaaaatgacatcaattgaatctataaaaatcttccactttttaaaatgcgtgccttttttcttaagctttgttcaagttttatctattttattgatattttcaaaaaccaagcttatggttttgttgactatctctacttttattctaattaatattttatcttcttattatttattttcttctacctaatatgtttatatttttatctttacttggcttttaaattaaattatcttattttagttttgttttgtagatacaattaagtctaaatttacctttaagtatcaccgtagctgctttccaacaaattttagcatatagtgcttttcactgtcatttagtcctaaacagttaataatttctattttaattccttgaattaatttagaagtgcatttaaaatttcttaaacatatggtttttttgctactttttaattattgatttctaatttaataatattggataaaaaatgtaatatgtctaaaatgtctttattttgcctgcaatcttgcataatataataggttgacagggtataaaattctaggttaatacttatacttccttaacaccttgaaaatatcatttcattgtttcttaccatctgttgtaaccagtaagaagtttattgtcagtccattattctaatgtagataatttgtattttctccttctactagactttaagattctccagtttcattacaatatatattcatctaggtttaaccttatatatttgatccttattttttctacttagtactttgtactttcaacctaatgacttatgtatttctttaattctggaaaattctcagcaatacttttcatatacttttactatttccttcattcgctttttctggaagatttgttggaggtcttttctgtagcatgaatattacatcataattttaagccttatctttctgtgctgcattctgggtaagttccttagtttttgttaccccttcattaattcaccctttgatcccagtttaaagttatcccatttattgtatcttttaattgcagtaactgtatttttttttttttttttttttgagacggagtctagctctgtcgcccaggctggagtgcagtggcgtgatcgcggctcactgcaagctccgcctcccgggttcacgccgttctcctgcctcagcctcccaagtagctgggactacaggcacccaccaccacgcccagctaattttttgtatttttagtagagacggggtttcaccgtgttagccaggttggtctcgatcttctgaccccatgatccgcccgccttggcctcccaaagtggcgggattacaggcgtgagccacagcgcccggccagtgattgtatttttttcagttttaagctttgtgtttttcatctttacctattcttatttcacttctgactgtgtatattttatgaattcattgtttttattgacggttttgtctttattaatttctggtcattgttagcatattcttttaatacctttgtcagattgtttcataaagttaattttatctaaagtgcatttatgttcaaattgttgattttattaattgccttttatttgtacctgcccagtgtcttgatttttgttccgtttctggttcacaaaaaatgtttgcttgtatttgtccttggcatcatttttactccccaaccttatttttttaatccatcattggtatgtatttagagtggactttcctgcttgaactcattgtgcatcttgaactgagagtcccaaacagcctggttgagtaagaggggaaaataaaaaaaaaattttttggagttgtctgtcattcaatagtttttaatgtcaattaggacaaaagcaaccttttctttccttacatccatgttggtactcatggctctgaaaagtttactttgaattaacttgaagctattcttatttagattggcttaatcttagaactgtttggctgttacttataatttacttcctaatgcaatatactaccataaacattgaaaagtatggttttttggagggaaaagataacagtgagactggcgatgtttgagtgccaaaagatattacttaaagacttccccagtgaatacttgtatgaaagctttctgtgatctagtctggatatgatggtgctccctcagccagaacctctgcttaattcccctctccctttcactcaacacatattttattgagcacctattatatgccaggcactgctctatgcactggatatatgacagcagacagatcatataaaatctctaccctcttggaacctacattccagcttattgttaataatagctttgctcagagagggtttttattaatcactgaaacactgaagaaagtataattctaggattgtttattttacaaagtattggtaggaaaagtaaagtgatgattctaggatctgcttttgttatctttcaacccaggaagtatatctaggggaagccacttttattcttattacatttctagaaacctgccacaagaaatcctaaccacatacatatatacttgtgtttctctattttcgatagtaaatctatgctggtggaagactatcagttattctaatgttattgttatggatttaagataaaataagcacaggagaagactgataatctgttttatttgtctatcaatcaaaggtgccagttttagaaaacatgttcacttcttccagctttgaaaacaaagttaaactaaagcaatgaaagggaagcacattgtcagtttaaacctcaaagttacattttaaaacataatcaaagaaggggcccatatttaattagatacaagatacagattagagtttctctcattaattaggtagctgtgtgagaaatcactcttaaaagcagttttagggtattagttttcactgacttacacattttgttctgatctgctgctgtgattaatgaatttttgagcaatgacgattaggttaatttgagttcattattcaaataccagcgcctaacagatggaacactaaactgaaggtcaggaaatgtgaattccactctaggctcacagctgactttccatgcaatttgaatttcttctgctttgtgaagatatttgtggattaatgttactgtaaataaaatgctctaaatgacaaggatataaagtactatgaaagcaaatgggaaaaaatgataacttaggataaagagtctctcttcatctgggaataatatttagaattcataaacaaccttttaggggaaaatttagatgctgtacaggtggcagaattgcttttttttacttgactttaaaataataatacctgatacttgaatagtgatttccaggtttttaaacactttcttgtcctactcttatgtgaaccttagaaaagccctgtaagttagaccattattctctgtggcctcatgtggaaaatagacaataatctgatttcctggagagattaagagagattagacatatatatgttgtccttcaaacctgatgccattttagagttctccatgtaagaagttcctgtcattcttacctagcctcatatcttcacatagttcagaaataacgtgttttctcaagcatataacttggtcttcttattttccttaggccttcaaaatgcattgtcgacttgttttcttctgaagaactgttcctgtaaacagctcctagcatttattgcagactagcagagcagtaaaagaactgcagttatttcaggctaagaatctacctcccctcactgactgtcttttgaggacttggatataaatctgattctgtcttgtaaccaaaatatgagttgctttgattttgtgaaatacaagagcacactcagtgttcaaactattccacaaagagaaaatatattatctgtgttactatctagtgttcactaagaatccaagctaagtcaaaaggccaggtatggttggcatttactgtgaatttatgaatcatccatgattttgttgctgctgcttcttattccatacttggccattgccagcaatgggactttatacaggtgagttggctgagtttcagtacaatgctctgtttaattgtaaacatatatgcactgggtataaatagggtggtgttttgtaccaggtatttttttcaggtaaccaggtcaataataaattattgagtgatatactgtgatgtttttcagtttgtggattaatttcacaaactgcatggaagcaaaaagccttgctctgttataactcaaacaaaagcccacagaaggagagaaaggatgctgcaaaggctggagccagccagtttgaaccggcactagttagtagtgacacagagaaaagaggtgggaccagcacaggaaggaggagcattcacactcagaggggaattacattcagccactgcctcatttctcaggttcactgtaaaggccatttagaggatgtaatttaactgtgtggttataggcctaatgttttcacaaacttcttattcttctgtgaaggagacacagaagtagctgtttgtgctacagcagtgctttttgcatttcccctcctgagatttgcttttttcccccctcccatttagaactgaatgtggatactggtaaaatagcatccttagttttggacatttcctgagaaaaaaatgaaaacaaaaccagcttttagagaatttctaagatcatggcaaggaaaagtacttaaaaaaaaaaaagtctaagcagataacaccatccaaagcaaataaaactccttcaaaacgatatctagttacaatattgtagaatgtgcataaagaaactccatttgctctaaataaatagagacaggatatcttttataacacctggtgaaaattaaagttacaaaagactttcttaagtaaaggcagtcaaattgattaacattatatgatcagtcatgtgaatatttaaaatacaaatagccattttttaaaatgagaatgacttttaagaatgagttaaattgagtgggcaagaaggtgattataggtcttctggtatctttcaagctcatcattgtcaaatcagttctgtctcattaatttcagggtttactactactaggcagcaatccaaaactatttaaaacctgctggatggttttcactctaggagtcactgccaaccccatcccccaaccaaaaatacagggactggagacaaaactgggagaaatgtttaacacaaacactctgccatgcagacatccttaggaatttgaagattcagcaactttagggtagattctcaccagttgagttcaggtgcatatgaaataaaacccacagctaagttaggcgtgtatgttgatgtttcatttagtagatgctatccagaattaactcataatattgtaatgactttggaagtcaatatgtgatgatacaattgattttaaattttccgtggtaattgtagtcatgaaaaacctgaataatctaataatcttattttagacatcggtttcaatttttcttctcacaaagccttatattggagcaatttgcaagaaaaccatgttctttattcctcctcactctttggtagatacccatggggtaaggaattgtccagaaataagaggttgtacaagaagcctatcttatctaaaccaaaagtgaataatttgcattgttaactagccactttttcttagttgtcgactcattgacaccgtacattggccaaatattttatgaaagctaatctgtactgtagcttcagagtgctaagatgatagcaagtgagtttatgatgatcccataatctttgaagaaacttatgtactggacaataaactaacaatgccaggtagtaatcaattaagaaaactcttaagaggcagacacaataaggagttaattctggaaaaacagtggactaggtgtatttggaaaaggctataacttgagttattccctggaagaggggtcccattggctgaaaggagagaggagagggaatagtatgaaatagttatggaagattggagagtttctcagggttaatagtgggttctgagtttgagactagtgagaagcttaagtttacagatacagtggggtcaggttaaagattgtaaagttaatctttttctagatcagggattaaaaacccaaatgccttctggggccagagaagctacttcagcgaggctctagggactggcaaaaggggtggtaacaggtgaatatgtgccctaagaggaagccattatttacctccacctaatcattccttatggcaaggacttcttatttttcaagagaaattgattatctgaacgattgtgtgaagtacctggatttttaaaacactaggcaaatcaaacaaaacccattttgaggcagattttaaactacacccataactatgtaggaaaagggagtcttggagctttttagtcaggccagagataatgatgaatactttaggaaggttatcacagtggttacctattggtgattttgaatggaaaagacctgtggacccaagtcatagactccaggaagccttttctgccccttctgcaatgaagagttaggaagacatttaaataagtaatcagcaagatttgatgactgactaaactggctgtcacatgtgttctttagggtgctttggctagggggacagattgtagttctttaaagctggcctttccctgtctctcataaaagtattttttgtccacaatatctgcaccacctgcctctagccagtggtggtgcctctacaacttcacttgtaattgctcagaaaattgaacagtaaggggtgggtgggtgggttggttagttcttaaggttcttctgagatatgggatgtagtgagaaaagctttaaccactcatcttacaatcagaagacttggaatcaagtcccaattttgctacttcctggccttatgaccttggacagatcacacaccttcttgaacctggcacattcttccttatcttggggctgtggcacaagctgtgttccctgacctgcataatctctctcttcacctttacctgaccctcaccttcttgtccttaagatcacagctaaaatgtcacttcctcagagaggccttccatgaccttcccatctaaagtggagcttctatcagtttccttgggctaatgtaacaaattaccgtaaactgggtggttacatgtccaaattcaagatgtttccagcagcatcctccatctaaaaagtagggaagaatccttcctggcctccttctagctgctggtggttcccagcaatccttagtgtgccttggcttgcagctgcaacattcctaccccttcctttgtggtcacatggccttcttccctgtgtgtgtctgggtctcttcacatggccttcttataagaacatcagtcattggatttagaacccacctcacttctgcaagacctcattttatctaatgacgtctgcaaagattctatttccaaataaagtcaacttctaaggttccaggtatacatgaattgaggtgtagggggggcactattcaacccagtaccaaccccctttttaaattatctttattgtatttactatatttgtagttatatattaatttgttggtttatctttctaacatgggaattctatgaaggcaagctttaagtccattttattcatttctatatactcaatgcctggataatttttgatacctaaaagctaaccaaaaagtatttatttagtacattaagtaatcttttttccctctggctaattgtcttcattgatgaaataatggggttggaattgctagtctttaaggtattttgcagttccagtagtatgtgactctgttttttacagatgcccagtgaccccaagttgctctgtgaatcagggcagcaggcatttacatgtatacatttttttattatgatgattgtactgtaccttccctttaggtcctacttgaagaaaaagaggaaaaaataaacacatgacattgaaataccaattggtttgcctggttttgaagagagaattataaaagagataaccaaggttgtatattctgattaagtatagtaaacactcattctgtgttatgtagtaaatacactagagattatataaactggaccccaaatctaaatgtatgtcaagcagtattcacttttatgctcagactggctggtacccaaaacacctttatacctcaaatattttttctcccataggagtataatataactcattttaatttaagaagatgtaggatgattatttctcatggaagttaatttattagttcgaattatttaattgacaaactgttggaaacatgtcatcaattttgacacttttcacagtacagtgttgctgaaactcctctttgggacctttaaatgctgtcaagaagaaaaatccatttaattttattgctgagaaaatgggaagtccttttgattaaacatgattttgtttgtatttaattcaggaatatttactttttaaaattaaattccaaaatttctaagcacttaaaagatgactctgtggttaaatcgaaaataattgactatattaatatttttaggccatgactaaacaaaaagcttgtctgtaaacatattttatcttactagaaatatcaccaacacaatcatggttatagtgttgattacagatgccttcagttcaattcaacatatgtttataaatccaggccctctttaaatcctgaggttaaaaaagcaaaaccacagggcacttcatggctaatgaactgaatttcttcctattccaaaaacagattttttttttttgttcttctctgttctctttaatattctaaactggttacttcaataacgagagaggaagactgagcccaccaaaactaggaggaggcaagaccacttatttcccaccttcccaatcaagtaagctgtggttcaagcagggcttcagagggtagcagggctcctgggcctctaagggatgctcagtcacatggacttgaccaacactgagggcattggtgagagacttccataggagggcattggccaatccagggcttgttttcaacacagcagattactatcttggggccaaaagactaaaatcaaactccactgagggagggtactagatgagaaagggagcagtggatgatacctaatgccttcatcctacagatatttattgaacacctactctgatgcagagcttgtgctgggtgctgaagttatcataaagaaatataatagtttcagccagacatagtggctcactcctgtaatcccagcaccctgcaaggctgaggcagatagatcacttgagcccaggagattgagaagagcatggcgaaaccctgtctctacaaaaaatacaaaaatttggtgggacatggtggtgtgtgcctgtagtcccagctactctggaggctgagatgggaggagcacttgaccccaggaggtagaggttgcagtgagacaagatcttgccactgtactctatctagcctgggtgacagagtgagaccctttctcaaaaaaaagaagggaaggagggagggagggacaattagcagacttatacaataagaagtaatacaaggaatatgatcaaggattatcttccgaaggaaatgacgtttgaactgagacaaataagatggacaagaaccacctagaaggagaatatcccaggcaaagggaagagcacgtgcaaagaatctaaaacaagaaagggcttggtttgttcaagaaaatgaagggaccgcagtgccgcagctgagtgagtaatgggcacagtggtatagatgatgaggtgacagagtagatagggcaagatcatatagggcattgcaagatcatggtaaggctttttaattacattgtaagaatcactccattagtggagatggacaggtagaactttggcaaaagataacataatgaattgagatttgaacataatcattttgcaatatctgtgtggctatacttattggttggatttttttttaatttaattttaagtttcaggatacatgtgcaggacacgtaggtttgttacgtaggtaaacgtgtgctatggtggtttgctacacttatcaacccatcatctaggtattaagccccacatgcattagctatttatcctgatgctctccctccccccactccccacacacaacaggccccagtgtgtgttgttcccctccctgtgtccatgtgttctcattgttcagttcccatttataagtgagaacatgcggtgtttggttttctgtccctgtgttagtttgctgaggataatggcttctagctacatccatgtccccgaaaaggacatgatctcattcctttttatggctgcatagtatttcatggtatatatgtaccacattttctttatccagtctatcattgatggacatttgggttgattccatgtcttcgcaattgtgaatagtgctgcagtgaacatatgcgtgcatgtatctttataatagaatgatttatattcctatggatatatacccaaaaatgggattgctgcttcagatggtatttctggttctaggtctttgaggaatcaccacactgtcttccacaattgttgaattattacattcccactaaatgtaaattattacattcccactaacagtgcaaaagtgttcatatttctccatagccttgccagcattggttgtttcttgacttttaataattgccattctgactggcatgagacggtatctcattgtgattttgatttgcatttctctaacaatcagtgatatcgagctttttcttcatatgtttgttggccacataaatgtcttcttttgagaagtgtctgttcgtgtcctttgctcactttttaatggggttttttttctcgtaaatttgttcaaattccttgtatattctggatattacgtctttgtcagacagatagattgcaaaaattttctcccattctgtagggtttagtttaattagatcccatttttcaatttttgcttttgttctaatttttttatgttttcatcatgaaatccttgatgagtggattattttaaatgttgatgtgattctcaggaagaagttgaaacgaaaatacaggtgtagacggcattagagtattgatggatgaaagtggggatataaaagacatatgaaagaaggcccagaacaccaatatttaagggaggtaggaggaagagaaagcaggtcctgaaatagggtgaggaaggtcagtacaggcactctacctaaaagtcttatcaaacaaaggtatgtttatcctccaggcacagagaataatttttcagagtgaaacgagaatccacatgtcctatctccctatatcatcaatcattgatgttattttatggcataatgacattaatatgtagtttaaataaacatgatattgagcaacaagtattataaaatgcagatgagttttaaaagattcaatgtgacacacacactcacatgtaaacacaaaagaagtctttggcaaagatgtagccccagacttcccaggagaactcagacattcatatcctttccttacaaaggtgcttgagcagaaatgtttgagatatactaaatgaattatgacttattctatgcagctactccacaaggcagatataattaacttgattttaaagctatcactaatgaagttcagaaagttaagtaacttccctgacattattctgttagttactaggtgatattagaatttgaatccaggagtctggttccaaagtctgaaatttttatgttttataaggaggtgagctaggagcaagcaagtataaagaaagaggacatggtcagtaatataaaataccaagcagtgcgagtaggatgaggactaaaaggttatcttggccttaggtgaccacggaacctaagttaaagaacattgaagtatgttgtataccacaatgatatacaactgttcaccaactagaatggctaagattaagaagaacaaacagtggataacataagtgttaccagtaggaatatctgcttaacgtataaacacatggtatcctatgacccttcaactttattcctaggtaaatacccaagagaaatgtcccatagaaaacaagtagggatggtccttgacttacaatggggttacatcccaataaacctataagtttaaaatgcattaaatataccttacctgtcaaacatcatagcctaacctagcctaccttaaacaagctctgacacttacattagcctacagttgcacaaaatcatctaacgcaaagtctattttataataaagtgtttaacatctcaaatagttgattaagtattgtactaaaagtggaaaacagaatggttgtgtgagtactccaagcacagtttctactgaatatgtatcacttttgcaccatcatgaagtcagaaaattgtaagtcaaacatcataagtcggggccgtctgtgtataaaatatttattgcagctttattaacactagcatgaaatagtaaacaactcaggtgtccatcagaagtagaatggatacattttcctgtattcattcaatggaatactatacgacaataaaaaaagtgaaatattgctacatgcaacagtatgggttaatctcacagatacttgttaagagaaaccgggcaggaaatagcacatactacatggttccatttatatgaagttcatgaataggcaaaattaatgatgatgatgcaagtatacatgaatactttaggtttcagggtaatgagagagccttgcaaggtgttagaaaagttctataccatgatctggtttgtgggtctatactttatatgggtctgtgtgtaaactttaactataatttaaggtgagtgcaccctactgtgtgtatgttaaacttccatctaaaaaatttttaaggtgatgataaagggaaatcccaggtagaaattgttttaacaacttttctgttatgaccttataaaactattcgatcttgcaaatcatgtagtacatgtattcctcttgatgactataaaattaaaaatgaatggggaattagtaagaaacattatagatatagatgttagaggtaataaatggaagagcaagttccagaataagttactgaaaggacaggtggtgggaaaaatagaaagaggacatcaccttcccactacagggaaattctctaggggctttttgcataacagagtgcccttgcacataatggctagatttggttagagtctaatgcaagtattctgaaatgcttttgaatgataagccagaaagaagcaaaaaaaataaaattatagaatgttagagctgtaagacaaggtatattacatttcatccagcccaaccctcttattttaaaatggactgtgtgcattgactctttggaagtgactcagtacagtacagagtgctctgatgtggtgtttctttgacaaggaaggatgcctttactgaagttttgttaatcatttccagaataatgcatgttaaacatgaactttgtacaatggtttgtccatgatccctatcagcatcttaacaattgaatgtttctgaatgtcggagaactggagatacattcattaaaatgtggtacccatttcaatgaaaaatgtagtaatgaacagactttaaagtaccatgccacatcttaaactgcatttatctcctggatgaaaaggaatgtcttattcccactttaagatatattagtatatctctcttagtgtatgtatattgctatatatcaatgcaattacactgttcactgtggagaggaagtattccaggtgagaaataatagtggaaaggggtaaggatggacatatttaagaactattttatttatttatttttgagatggagtctcgctctgtcatccatgctggagtgcagtggggtgatctcggctcactgcaacctctgcctccccagttcaagagattcttgtgcctcagcctcccgagtagctgggattacaggtgcccgtcaccatgcccagctaatttttgtattttgagtagagacaggattttgccctgttggtcaggctggtctcgaactcatgacctcaggtgatccacccaccttggcctcccaaagtgctgggattacaggcatgagccactgcgcccaggctttaagaactattttaaaaatataactgatagaatttgagaaccaattatacaggataaagaaaaaaagggagtcaaaattttgagtaacttaaaccattgagtgatgcacagatgctggagtagcgggagtactttagttgaaggggaacaaaatttcaacttggcaccttgtagtgagagcttaggcttgagtatttatctctgatcaacttgcataatagtaaatgaattataaataatgtttttctgttacctgtatctctctttcttcctatggatgatatggctaattaaaaaaacaatgatgaatatttcatattataggtcacaacaaagataagcctcgctcttcttttatatcctcattctcattttgcagagcaagcaattgtgttataaaatctgtggtgaaaacataaaaacaataggcaaaagggaagctggtatgtaactcatgccttgataatggcatttgctcatttttgcatctagatggtcctctctttccaagtaggaaacatttcattgctctgtaatgtcgtccgtatagcccacctcagtgctaggtagtttctgcctgctagggaagaactagtttaattggattgtagagaggcaataagaatgcttgttttccaaaactgaattggggacaagtcagcattctggatgattttttaagtaatacatgttttgaagttacctgtggtcatttattgaggaaagagtgaattacatttctgtaattattgtggattcttgaaaatagacaataggattttaatgatttcctgacatttttaagttttaaacctaataccgtatgaccatgacttaaatagagcctagtaactaaaattttattttatttttttcactgtttactcctaaaaactagcattttacttacattaatgcaatttctgttttattaggtgccagggctatcagtaattgacatgtactatagttaataatgtatttgttaaagtaaataacttttaatggggctaccaataagtgaatgtctccaattcaaacttaaattttaaatcataggtttgtaaatatttctaaataagttagaatactgcatataacaaatgtttattcaacaactatatagtaattatcagatcttagccaatatgctcagtactagagatatgtcaataaataagatccctgccctcaaagtgcttaaaatctgaactttgattcatgaaatccaagttataaagagttgacgctatttttaagatataaattatactgtatataaagctatattaatttttccagacaatagctaaattgccataatactgtcatgcaaatcagtgggaatactgataaagctcagttatttgtaattattgaagtaagaattttctctaaagactgaagactggaatttctacagatgtaaaataaataaaagttgtatgtggctgtccaaaacttcattatactatttatatttgcccatagtctgcattgtacttttaaaattctttctctctttttagtactggttgtcaccactgccaagatagtgcctccactgctaatttctatgacctgctgctaccacctccacctccctctgttttctctctgactttcttttgatttctgccacttctccagagaaaattcaccttcattcaaaacaactgattgtctatgggtgttcttaggcagttggcatgctcttttctttctgatcagccaattgtggaataccattagttatctttgtgcccttttcatctttatttctacttgctgttcaagagtactacctttgtgttaaaattcatttatgatggagggagggggtcatgataaacactggagtctgtggaaggatgggctatcttgacatctggagcattctggatacttgaagttgctgaaaggctgatctatagatatccaggacatgtaatatgattaaagtacagttgagcttccagaagtccttgtcttactccaaatattattttatgacttaggagaaccaaattttctgtttgggacttgaactcaggtgagctgtctgtatagatagtaataagtgaaaagtattcaaatctcctctaaaatttccgccattagattcggaagtgaacttttatgtagatcttgacttgtctctcttgatttgccttgttttcttccacacagtactcctttattttatttcctatttgctactggattgtctgtatcaggacatgtttttttaagataaccacttgaattttctgttgataattgttttgtcacctattttgtcagtgcgagaatataaattttagtgttcacataaaaggaaaaccagtttagtgattattcattgaaaagaccacaattttactcaccagtgaggttcattggttagcttggaccaagtgtacgggaacactggtattaacagaaatatttttgaaagccatgtgaaaaaatctcaattgcatctccattaattcaaagaactcatgatagcccttgtttgagtttcagaagttttcgtaaagcagcataatggcagcagagaatagcaaaaagagaactgagctgaggtcaggtaagcccaatgcaagttttgtcattggttagctgtcagacctttgttacctttgctatcacacagggacaataacattataagactattatagggattaaaatgaaataacctatctgtagaaatcacagaaagcctaccacactgtaagaatacaataaatgttgattacttccctcctcatttagttgagtcaaaatattactcagtgttcccacagcgttcaatattttaggacagttctggaatttatatgcttctttctccaattctggtaatactggatttttttgaaggatctagtttatttttatcagtttgcgagttttttgttttgttttgttttttaactgacctactcagataatgaagactcttaacaattcataaatgtcttgatatttcttctctaacagtcacacaaaataaaaacagctcttgaagaaaaacaattcaaagtttaaaacatataaaaatttaggtatttaatgtaatttgaagtaaaagtttgaattgaaaataattataaaactaatatgtgccatttctttgtaataattgttataattttcttgcataattcttaaaggggaaatggtgcaaagaacagcataatagtatggtaatggttgtagaaaatttatttcatttttcattccttaaaaatctagataaaagataggaactgttttctttaaaaacctgtaggcatgtgttttatttttaaatgttaatcaaatttatgctatactcctttattttaactatgccaatggactgatcaaataattaccaatagtgattaaaaaggactttctatatttaaacaaatattaaggtaactaaggggtaactcagctaacgtggctttttaatgataacaaaatatattagatatccacatgtcatgtaaaaccttgtgtaaaatattgggctgcttttcccagccttgctttttttttttttttttaacatcctatttataaagattaaaaagcctgtgggtgagagtgggggatgaaatttagtatcccttaaagcactttgctaatgctttgatttgtatatatgtgctcactaaatgttggatctgtatgggttagcatattttctattatacgttagaaaatactaattcacttttttaaatagctgaatgagatatgaaaagacagaactggtgagttagtagctgctgctttttaggcatgccatactatcaaaccaagatagaacattttaagtaaaaacatttgaacaaaatcctaaagacatataaaggaagtcactttatgaaaaatataactgcctttcaacatctttaccttttctcgtacttgctcaaattatgactatgatgcattatctataaacataaagtctaaaaagtataaacatttgatatatttgtgcatatgttgcattttcttttattatttctattcctagtataattcaatttaggccaaaatgttgagtttagtcatgattttatatttccataggttaacttgagacatgtaaacaagtaagttatttatgtgctatataatcctctacctactaggatatttacttaatagtagttttgtggcttaggaagcagagtaattaattagagtgaattaatggcacacactggttgctatgtttctgatttgctttggactgaatctttatgttcctcaaacattgtttctgccatttagcagttgcctaacagagtgatggtatttggagatggggcctttatttgggaggtaattaggtaatgacagtgaagccctcatgaccgagatttgtgcacttagaagaaaagaccagagagagctcgctttttctctctctgttctctgccatgtaaggacataatgagacgatgaccgtctgcaaaccaggaagtgggtcctcaccagacaccagatcttctggcactttgatcttggactttccatcctctagaaccatgataaataaacgtttgttgtttaagctacccagtctctgtaataacatttgtcataacagcccgaactgactcagacacatttcttcctcattgatgagcaaataaaccaaaatcataatatttttcttgctttctgtctgaaaataatgcatttcccaattttgtattccaaagacctgtatattttattgtctatacttctggcctgctgccccaaagcagagagtcctttatatgtttgtttattcaaacatcccaggccttctcaaaataacccccaacctgaaatagaatgtgatttaaaataacagaaccttggctctggaatcaggcatgtggcaagcacacagaatatatttgttgatggaatgaatgaatgattagataaaggaatgaaaagatctgatttgtaaaatgctctcatattgaaatactttccccctctttttttatctttttataggtcatgcaacacttttgtacttgggaaagtgttctaactaaagcaattatgcaataaaagtagtctttgatgttggcttctctgtcaactttatgttggataaaatatttgggaattctgctctgtagttaaaaatatacgtgtatgtagcagggaaatgataactctctcaataattaaggacaagcaatcatatcctcgatgtaaaatgggaggaataacaattttttttaatttataagaaacagctagtgtcactgcacttagagaaaacacattaatttcttttatgttgtcaggcagagaaagtataaactttggaggttgcacagtaaggttaggcaatggcctgtgagttaataaacactattgttagatttatatagaattttattagtcttgctcagtttctcttcaattccatctaacaaggtttcctttccagcttatatgtatgcttatctaagtccaaggaattccataagaaagttgaatcaaaatattttcaattgataacttatgaagcaaaaacagcaatttcccattatatatttcaaataagtttactgtacaattttgaagtgactgtagagtctgaattgtattcagactatgtatcagttgtattcagattctggccatgtatccactaccaaaataaaatgaaaaaatgaacatggttttgtcacaagttaattgttcaacaacaataatgacaacaacaaaattatctaaaatctgaattttctgagtaacgactcagtaccatcagtaaagtagtagaatacaaaccttagtgtgctatctatgtaaagaatttaattatgttcactccagatatagagactgttttgtttccacagaattcgtaaactgtcattacagaactgagaaatgtgactttgaaaatccaaatctacgtgtaaaatttagttcaacctttgtaatattcaaatgatcttgatgtttcagcttgatatttcagccagcctttgcactcgttgttcttccttcaaatgaaggtactttatgtacttctagagaatctcctatacaaacaggaagtatgagtatgtggctttagtgatttttggagtacatgctagcatcggtgattttaagtggttattttaagtattaaaagtggttagaagcacaggctttggagtcaacagacttggctcaagtcctgaatctgttgtatcttaggcataactgtgtgacatctgtggaaagagctgtaatgttaagatgctatcaataacagcaaatgttaagatttagtattgacagaatattcctgacaattaaatattctcttaagggactgagtagaaacactagtgaaaaagatgctagcccagaaaaaaaaaagtaaacatgctatgtgggcacaaggtaatgaagaaaagatacagaaaatgcaggaaactaagtatggcattattccaagtggcacatcatccaggcaatctctactaagcataattaagcaggaaaaaagtctttccttaggtctgtgcccttggcaaatgtatttacttttattaagcctcagtttccttctctatgcaataaaaaagaagtgatctctaaattgcatatattatttaaatatgatgaaataatatctctagggcctttagcacagtacctggcacatgaaaaccattcattaaatggtaactattattattgttgctgtatttcttataaaaataaattagtacttctttggctgtataccagatgaaaaagactagtcttggtgttaatgactcataaagatctgtttctcagaagatggctttttaaagaaaagagaaaaaataaaagcatattaaaatacctctataaaaattctgtagtgagggctaattttgcttcctttttctaatttcaactgtttatatatatatatatattacatatagtatatatataacatatatgtatatattttaactatatatgttatatattttacatatatgtatatataaatatatgtgtatatatattactatatgaagtttttcctagtatcaatctattttaaagataattaactattgaagaaaaaataatagcaaagtagtgtgaggtttgcaacatatataaaagtagaatatatgccaggagatcaggagagaaaatagtaaagtatgttattgtgaggttttcatgctatatatgaagtagtatactaccaaccaatgtctttcataaacatagatgcaaatattcttaatacaatgttagcaagtcaaaaggataatatatcacaacagaatgatagctatcccaataatgcaaggatgacttaaaattcaaaaattaatcaatgtaattaataacaaactaaaataaaaatattttttatttgggaggctgaagcaggtggatcacctgagctcaggattgcaagaccagcctaggcaacatgccaaagccctgactctacaaaaaaagaaaaaataaaaaaattagacaggccagtggtgcatgcctgtagtccccagctacttctgaggctgaggtgggaggattgcttgagtccaggaggatgaggctgcaatgagccaaaattgtgccactgtactctgtcctgggtgacagagccagaccttgtctcaaaaaaaaaaaaaaaaaaaagaaaagaaaagaaaaagggaaaaagaaaaagaaatattttggataatttcaatagggaaatataattaacaaaatttaatatcaattctcaataaactcccagcaaacagcaaagtaagaatagaaggaatggtcttaacctaataaaggtatctatgaaactatgtaactaacatcatacttctatttgtttgctagggctgccatagcaaagtaacacagactggatggctttaacaacactaattttctcacagtttggaggctagagtctgagttgaaggtgtcttcagggttgacttcattctgaggcctctctccttggcttttaggtggccatcatctccctttgtcttcacgtggtctttcttctgtgcatgtgcgtgtctgtgtccaaaattttcacctcttgtaaggataccaatcataatggattaggacccattctaaagacctcttcttaacttaattacctctttaaaaaccttatcttcaaatacagttacatactgaagtactggggtttgggacttcaacatgtgaatttggagaggaaacaatttagcccataacaatacttaatgctgaaaaactgaatgctttccccctaaaattagaaacaaaacaaagatgttcatttttgccacctctatttaatagtgtgtgtttatgtgtgtgtgcatatatttttcccagcaagtacaataggcaagataagacaattagagctttctaattagcaaataagtaaaaccctatttatatagagatgacatgatcctatatttaaaatacaatgttatctacaaaacagctcctcaaactaatgtgattctgtaactttacagggtacaagatcaatatataaaaataaattttatttctatgtgtcaggaaggaatgatcagaaactaaaatttaataaaaatatcaattacaataatatcaaacatataaaagaattaggggtaaatcttttttttttaatgtgtgaaggaggtatatgtggacaactacaaaacactgctgagagaagctagagaagacctaaataaatggagaaagacactgtattcatgagatgcaagagtggatattgttaatatgtcagttctccccagattgaaattcagctttcttttgtagaaattgactacctcatcataaaagtcatatggaaatgcaaatgactaagagtaaccaaaacaactttggaaaagaataaattagaacctaacactacccttttcaagaaatatagctacagtaacctagatgatgtagtattggtgtaaacatagacaaatagatcaagggaacagattagagagtccagaaatagactcccacatatataggcaagtatccaaaggcaatttactggaggaaagatgagtctttcaacaaatggtgctgaaaaaaattggtacattattttggaaaaaaatcaaaataattatgctgagtgaaacaaactagacacaaaagagcacatatgcctatatttatataaaatttaatagatgcaaactaatgtattagaaatagatcagtgtctgggcgcagtggctcacgcctgtaatcccagcactttgggaggctaaggtgggcagatcacgaggtcaggagatcaagaccatcctggctaacacggtgaaaccccgtctctactaaaaatacaaaaaattagctgggcatggtggcgggcacctgtagtcccagctactcgggaggctgaggcaggagaatggcgtgaacccaggaggtggagcttgcagtgagccgagatcgcgccactgcactccagcctgggtgacagaccgagactcatctcaaaaaaaaaaaaaaaacaaaaaacagatcagtgtatgcctagggtggtaggggtggtggtggtgcagagaggtactacaaaaggcaggagaaaacttttggggctgatgcatgggttcattattttcattgtgatgatggcttcacaggtgcaaaaacctattaagtcaaatactctaaatgtgcaccttttattgtctgtcaatcatacatcaataaagctgttttttaaacaaacacctactatgttcaaactcgatagaattccgtacaggatgcttgccgtgttctcttttttacaaaaatgtactttaaaataattataagaatggataggatcaaattgtttttaagaacttgacagttttcgaagacattaaaattaattttatttaaaacgagatttataagaaaaattattacaataaaatcttattttaaaaattcagaggaggaaaagtttgtttatgattgaaaggaataaccaggtattaaaaagtaggaaagtctaggaatctgccgtgatcagagtaagcaggtagaatttccagttattcatgacagagttctaccacgttttgaaaggtaaacatgagttcaacctgggaagatgagaaaaagaaattctagataaaaggaagaggaagaacaaaggcaagagtcaagacatgaagaagtatgtttagggaatagcagtaaatgcatttggatagaatggtgtacgaagagtcttatggaagataaacttagcaagagaaagtggggcagatgggacttgggttttctctctgaaaatttctttgaatccccacaagcagcgctaatactctcattctcctaatactctgcattctcctaatattttgctccataccctgctacaatacttgtcacattttattgtatcatgtgtctagcttcacccttaggcacccgtctattagaaagaactacatttggctcattataaatgctcgataacaaaatgctcccactttaaaaaataggatagtctaggtatctgccatgatcagagtaagcaggtagaatttgagctggtcctttaaaaactgactagttttggccgcgcgcagcggttcacgcctgtaatcccagcactttgggaggccgaagcgggcggatcatgaggtcaggagagcgagaccatcctggctaacacgatgaaaacccgtctctactaaaaatacaaaaaatggtggcacgccctgtagttccagctactccggaggctgaggcaggagattcgcttgaacccgggaggcggaggttacagtgagccaagatcgtgctactgcactccagcctgggtgacagagggagactccgtctcaaaaaaaaaaaaaaaaaaaagggggggtggcggtcatttcaagaataattttatagggaaaggagtgagagtatccgtagtaaactgagggaggagggtgtatatattaaggagcactgagaattgaggtttataggaaaactaatatttatcattagttgttatttagcccaagcaagcggggacacatgctgtatatttaagttttctaaaaagtatttactcttcatttccttcgttggctggcacagtagagctctaagcaatcagaataagcagagaattttataagtcattttaaaaagaatatctcaaatactttttgggggaactatatttatttttcttttctcttaagttgtgtatatgttatataaaaatggaattgagaatagtattatatttgctcttggcattatatttgattgtcattatgagcctgtggtgggccatggagtaaaacgaattgagaaacagtgacctagaatgttagcacttcgagaggggactgtgctcgatttagctttgtaggcagtagcatggtgctcaagaaagaatgctgctcctgcaaatcaggataccagaatttgaatcccaatttaaatttaaaacttgtttaaggacctttaaacatgttaattatcctatagttcttccttcgttatttactaaattgggatacaaacaataatagtttcacatcattaatatgtgagttatacacaaaagaacgagggaaaacatgtagcgccatgctggtatacagcagttttctgtaatcatgtacttcatcttgcccagcacaatactttgtagatagagggtacttaagcactcattcatactgaataaatcaatgtatgaacaactgagaacctttgaaaaattccttttttctgttcatgttcaacttaatgctttcagagaactgactgtgaaaataaccttttttctggtaatctctatgtgtttgaataaaagaacaatggtgaagctccatctatttttaggttatgtagccttaaaaatgagaaagctaaatatgctgggagattttatttattttgttttcttggtctcattttatttctgtcttaaattaagttaatgaaattttgggtaggcctggtcacatttaatacctagttctccaagtattttttgtgcatcccttttatagcagtgtgcaatgtgacagctcagcctcctcttgctgactaatctcctgtacagacagaagcaattcccataattcagataataacctggaacaactttcatgatttacaaaagtagatttgtaactgatcttcttataatttagaaaaggagattagagtgtaataaaatatcaaatcatagcttaggaatagaattttggatgttaaaactattctgaaagtaaatacagttttaaacaagaacctgtactgatttaattgcttcaaagaaaacatattgaaaaagaaaagaattatttaagttagcatatacttataaatagtttcatagaatgtttaaagctaaacatattcaattataatttggattacactattctattacataacaacctacataagttgattagaacaaaactacgaagtaaacttcaacacaatccatataatagaatctgaattagaaaggcttgaatttattgtatgtaaatttatgaagactttatggaaatagatgcacctttgtaaaaagacagaacatgaaatgttaaaatgattgcttttttatcctttatttatttatttttgctaaaccataccatactcttaagtcatagttccagtgcttagtgcatagaaggtgttcaaggaataattgtggaatttaggaaggtttaatttctgacctataataaaggtcagaataaatggtaaaattagacaaaaaagtcaaggaaaatataagcataatctctaataattcaaaagctatgttgtggtgcattctagaaaggtgaatttgtggactttttttttaagggaactcatttgtatcagattgtcaggaaataatgttacataaatttctattttctgctttaaatgctggcatgcgttctttttaatagtgtgtattacaaatgcaccaaatctagggctaagtaaacagaaagttgaatcaaggtacttctcattttaaaaattgttctggagtcttggagtagaaagggactttggagttgatttttcccaacttccttctattattgatgagggaagtagaaggggaaaatgactcgttcactgtctgtagcttgaaaaaaaagattttttaaaaatctatacttgatcaggcaggcacaggaaggtacttaatgaatagtttccaagaagagtcacttcggcataagagatacatattgtagattaatttacaggcaatatcaattatagtaataaattattggtgattattaataattattaattttaaattagcatgttgggtcttatgtaattgactgaggaatcaggttaaggtgcatctttcattgtgaaattgagattttgggaacatgcaaagcctcactgcagatcctaatgaatttaccacagggatgctgccctaccaatacacttgagtagaaattttcaaggggagttgagggacatgtccttggtaacaagaggattggggaagggtatatttcacttgaaatttaaacaacattttgttccatggtcttatttatttttgggcacattattgtttttttaataaattcaaatagcattaaaagcattcatgttttctttttaaaagttaagaggttttaaggcataagtcaactagttttttcctctgtccttttggaataaatcattcattcttttaataaacgcttattgatcatctctatattccaggcatagtggtaccctctgaaaatacagtcaaaaagttgattcctgtctataagggggagccagagtttattcattgagaatttacagcagaatattattgctccaagtttccccctgccatctacactcatcattgcaatatttgacacagtagtcatttattggagaaaatacaaaaagatagaaatcacaaagagtctttcacttcacttgctcattactcagcaagtatttattgagtacctatcatgtgccagtcactgagctaggtgcttgggttccattagtgagtaaaacagtcaacgatcctgtctttgcagggattatattctaggaggtgagactaatagccaaaaaaaaaaaaaaatgcaaattacaaagcatgttagaaggtgatgtgtgctggttaaaaaagagagagagagagtgagagagaagtagagttaggggaattatgtgtgtgagaaggaaatttagtgtggtcaagagaggcctcattgtgacttttgaacaaaggcttgaaggcacttgaaataaaaatccaaaaattaggataaccatagaatttgaatttttaaactcattttaagtctattttgttatctatgttacttcctggcaagaggctgcaggtgatggtaaagtcaaggattttatttttctttcttttctctcccattagctttgattttcacaaggagtggcatttccactattttctactttgctaaaataaatgtatttcatgggatttttgttcatcaatgataagaacaaggtttactttgagaattttctcttgagagcctagagcaacatgtagcataatttcatatcatgcgctgtttcttagaaatataaaaatccatatattgccatttttagaatgactcttagtcatatcagtttgggcaagaagtcaacttactttcacatggaatcactgagtcatagatttagataagaaagcagtttactttcttaatattcttcatcgattttagcatattttaaaaatagaagtatctgtttcttacagattctgtttctggcgtctgcatacgcaagtccccaactcgctgaggagagctgttcagctatggctgctgtcacacattacctgtatctttgccagtttagctggatgctcattcaggttggtacctcattccctctccccgcccctttaatcttttaatgaatctgggtggagtggtcttaatgtctgatactctgtactgaagtagaagtaattccgtatatccatcactgcattctcaggatataaatgacaaataaaaacaccctataagctgtacaacagtagagagcattgtgagtttgaagaaatgatggaaatctagtaggattggaaacaagggagtggttagagatgaagtctgcaatgtgggccctttaaagcacagttggaaatttgaacatttttctaggaaaagtaatagaatgattttaagcaaaggagtgacatgataagatttagattttagaaagatctccctgtttgtagtgaatatgagacaggaaagagtggataggcaagccaattaagtagatttagctgtattcatggggaaatcatggtagcgtgaactaaggaggtggcagtagaagcaaagggaagtggactgttttggagatttttttaagctagaactataggatgtgaagacttgttgtggggaatgcagaagttggaacccaggatgcttcccaaatttctggccgggtatctggtggatagtggtaacagaaattacgatcactgaacaatggggaagagctggtgagtttcgtttgggacatgctgaatgtgaagtgcctatgagacttccagtgggaactttgaggagagggcgatacatttagaaatgcactgggaatgccagtgctttgggaggccaaggcaggcggatcacctgaggtcaggagttcaagaccagcctgtccaacatggtgaaaccccatctctactaaaaatattaaaaattagctgggcgtggtggtgggcacctataatcccagctactagggaggctgaggcaggagaatcacttgaacccaggaggcggaggttgcagtaagccgaaatggcaccattgcactccagcctgggcgagaaaagcgaaactctgccaaaaaaaaaaaaaaaaaaaatagaaagaaagaaagaaatgcactgggaagctattggcttagagttggaaaatggagccattggtttggaagagattacttggcgagaaggtacagagtgagaccagtagagtcctagcatactcccctgaggaactagtaaatgttgggggagaaatttcaattttccttttctaaataaaatcccaaattctctccattattctatgctgatttggtcgataaagaggctaagagaggaggatggtgcgtagtatttaagtggctcaactaaaatgctgcctttggtaatgcattctgtgtaatggtatttttaaggttttcatgtgatactgtttcatatgcatttctgagtatggatgtaaactattttaatgaaacagatgcattcaggcccttgcatattcttttttcttgttgaagaggaaggttgtgggacttgatgatgtagcaacagtgaattaatggtaaaaggagaaagaaagtgaggtggtggtattatgagagaataccacataccacacaggctcaaggaagggttgttttccccagtatgatatgatagtagtgggggctgaagaagagaactgaactatttagctaatagaactagttgaaacaagtggcaccctggatctggatttgaattctggctctgccactatctgtgtaagcttaatcaagctattgactctctccaagatttgtttctaaatctgcatatagggataataattcctaactcatagaattattattaatattttatagctctttgagcagttttaatcatggaaaattaatggtgttttcaagctcccctctcaaaaaaatttgcaaataaaagtgaatttaaaccatataacataaaacttacatatctgctgaaattagaataacatttgcgagattttctgattgcaaaattctgtaagagtttatctgagttaaacttttttaaatgtgccctatttatgttgttatctgtctgcctgtattgaggtccccagtgctatgctaaaggtctttgtccatgcccctgacctattcagaatttttgattcattacttggatgaaaacacaggaaattgcttatcagatatgtacgtggtacagaactgaaaggacagctgcaacagagagctgcctgcattaagattacaagtagagccaatgaagagaaactgtactgtgataaattaaaaactagagtgaaagagacatcatctgatggaagttaatgtaaattactcaaaattataatttaacataaactcagcagcaattgaatatgtgaccagaatgcttaacaataacaactactgtaactacaaaaacaacacacacctaggttgcgttgatagcagtatggaagcagacatgtttacgttgtaatttacaaaattcagactattttgggacatagcaaccactctcatgggtcgtgtttcagcaggaacattaattatccaatgagaagttggaaaacaaccccctaagaaactttgaggcagctggacataactaacctggaaagaatttaggtaaatgtgatggctgtctacaaataccggaagggctactgcaggaaagggtggactatgtagctccatttggcacaactcagagcaaatgggtcaaaaattagggaaggaaatttttgattcaggttaagagtgttcatagcaataaaactgtcaaagttgaagaggcttttctaaaagtagagtaaattcaatcactgaaatatatggagagggaaatgaccaactttcaaacatgttttagatggattttctgctttcaggggcattagacaaaatcatatataagatttcacccaagttaatgaagattggtatattctacatctcttctttgagttaggtaaatatgattgtgcctgattcacatttagtagaccaattagattctggatggctaatggcttaggaaagctatttaaagtaccagtgaagtttaatgtatttcagatggtacaccacacatttttcatggtttgtgatttgaccacaagggaaaaagtcagtcagttctgaattctagttaggttacttttaatgaattattttatgatcagaggttgcacttcaccaacctacatattcccatttataaaacagtgactgctgaaatctttttttttctaaaatccgttttaaaaacattatgtagaaggttagactattattagttcaatcctattagttgaattaggttgaataaaattgagagaagtttttactttaatgattctacttcatttttttagtaatataggagcgaatatgatactacatatgtctgtgcatagcttataatgacaataaattaatcattaatttgtaattactgagttaagcatgtcagaattgttaacgtttatttttatctgcgtatcttcagtcttagaataaatacattgaaatgactttatcttgaaaattattttacttttatatcctatacttttagtgccatataataaagttagattatattttagagtagcttagggaaaattttattggtaaacaagttacataacctctctgagccttgattttcttatttgaaaactcaagttgtaataacagtacctctctttacagactgtgaaaagacaaaatgaattaatgtatagaatgaacttgaaatggtgtctgggacagaatgcatactctgtacatatttacccatattatttgttaagataatatgttgtggctaaaatttcatagatttgaaaacatcttgaatactctgctattccaatataaatttataccttctttttaaccaaagaagatcatcttcatgtagtggaaagaggtccgactttgagtgaggtggacactaactagctgcaaagccttagcaagctggagaacctttaactccttattaaagtagatgcatggctcataacaggctccataaatagcagccttgcctctgtttcttcaggcttcccttttctttgacagagaagtcacacagtgcaaagcgaggatgtattaacaaattattttgcttattttttaaaaggaaacaattcataaattcctttcttggccatagatattgaattatccatctgtttgctcttcatgtaagatcactccttgaaactattgaaatcatttctcccttaagaaggcagggttggggcagttccaagatggccaaataggaatagctccagtctacagctcctagcgtgagcaacacagaagacgggtgatttctgcatttccaactgaggtactgggttcatctcacggggcctgatcggacagtggaggcaggacagtgggtgcaacccaccgagcgtgagccgaagcagggcgaggcatcgcctcaccagggaagtgcaagcgatcagggaattccctttcctagccaagggaaggggtgacggacagtacctggaaaatcggatcactcccaccctaatactgcgcttttccaatggtcttagcaaatggcacaacaggagattatatcccgtgcctggctcggagggtcccacgcccacggagcctcactcattgctagcacagcagtctgagatcgaagtgcaaggcagcagcgaggctgggggaggggtgcccaccatggctgaggtttgagtaggtaaacaaagcagcagggaagctcgtactgggtggagcccactgcagctcaaggaggcctgcctgcctctgcagactccacctctgggggcagggcatagccaaacaaaaggcagcagaaacctctgcagacttaagtgtccctgtctgacagttttgaagagagtagtggttctcccagcacagagtttgagatctgagaatggacagactgcctcctcaagtgggtctctgacccccaagtagcctaactgggaggcatcccccagtaggggcagactgacacctcacatggccgggtacccctgagacaaagcttccagaggaacgatgaggcagcaacatttgctgttcagcagcctctgctgctgatacccaggcaaacagggtctggagtggacctccagcaaactccagcagacctgcagctgagggtcctgactgttagaaggaaaactgacaaatagaaaggacatccacatcaaaaccccatctgtacgtcaccatcatcaaagaccaaaggtagataaaaccacaaagatggggaaaaaacacagcagaaaagctgaaaattctaaaagtcagagcacctctccccctccaaaggagcacagctcctcaccagcaacagaacaaagctagacggagaatgactttgacaagttgagagaagaaggcatgagatgatcaaacttctctgagctaaaggaggaagtttgaacccatcgcaaagaagctaaaaaccttgaaaaaagatttgacaaatggctagctacaataaccagtgtagagaagtccttaaatgacctgatggagctgaaaaccatggcacaagaactacgtgatgaatgcacaagcctccgtagccgatttgatcaactggaagaaagggtatcagtgatggaagatgaaatgaatgaaatgaagcaagaagagaagtttagagaaaaagagtaaaaagaaacaaagactccaagaaacatgggactatgtgaaaagaccaaatctacgtctgattggtgtacctgaaagtgatggggagaatggaaccaagttggaaaacactttgcaggatattatccaggaggacttccccaacttagcaaggcaggccaacattcaaattcaggaaatacagagaatgccacaaagatattcctcgagaaaagcaactcgaagacacataattgtcagattcaccaaagatgagatgaaggaaaaaatgttaaggggcagccagagagaaaggttgggttacccacaaagggaagcccatcagactaacagcagatctctccgcagaaactctacaagccagaagagagtggggaccaatattcaacattcttaaagaaaagaattttcaacccagaatttcatatccagccaaactaagctttgtaagtgaaggagaaataaaatcctttacagacaagcaaatgctgagagatttcgtcaccacgaggcctgccctacaaggggtcctgaaggaagcactaaacatggaaaggaacaactggtaccagccactgcaaaaacatgacaaattgtaaagaccatcgatgctaggaagaaactgcatcaactaacaagaaaaataatcagctaacatcataatgacaggatcagattcacacataacaatattaaccttaaatgtaaatgggctaaatgctccaattaaaagacacagactggcaaattggataaagactcaagacccatcagtgtgctgtattcaggagacccatctcatgggcagagacacacataggctaaaaataaagggatggaggaaaatctaccaagcaaatggaaaacaaaaaaaggcagaggttgccatcctagtctctgataaaacagactttagaccaataaagctcaaaagagacaaagaaggccattacataatggtaaagggatcaattcaacaagaagagctgactatcctaaatatatatgcaccgaatacaggagcacccagattcataaagcaagtccttagagacctacaaagagacttagactgccacacaataataatgggagactttaacaccccactgtcaacattagacagatcaatgagacagaaagttaacaaggatatccaggaattgaactcagctctgcaccaagcggatctaatagacatctacagaactctccaccccaaatcaacagattatacattcttctcagcaccacatcgcacttattccaaaattgaccacatagttggaagtaaagcactcctcagcaaatgtaaaagaacagaaattataataaactgtctctcagaccacagtgcaatcaaactagaactcaggattaagaaactcactcaaaagcgctcaactacatggaaactgaacaacctgctcctgaatgactactgggtaaataacgaagtgaaggcagaaataaagatgttctttgaaaccaacgagaacaaagacacaacataccagaatctctgggacacattcaaagcagtgtgtagagggaaatttatagcactaaatgcccacaagagaaagcaggaacgatctaaaattgacacgctaacatcacaattaaagaactagagaagcaagagcaaacacattcaaaagctagcagaagacaagaaataactaagatcagagcagaaatgaaggagatagagacacaaaaaaccctacaaaaaatcaatgaatccaagagctggttttttgaaaagatcaacaaaactgatagaccactagcaagactaataaagaagaaaagagagaagaatcaaatagatgcaataaaaattaataaaggggatatcaccaccgatcccacagaaatacagactaccatcagagaatactataaacacctctatgcaaataaactagaaaatctggaagaaatggataaattcctggacacataccccctcccaagactaaactaggaagaagttgaatccctgaatagaccaataacaggctctgaaattgaggcaataattaatagcctaccaaccaaaaaaagtccaggaccagatggattcacagtcgaattctaccagaggtacaaggaggagctggtaccattccttctgaaactattccaatcaacagaaaaagagggaatcctccctaactcattttatgaggccagcatcatcctgacaccaaagcctggcagagacacagcaaaaaaagacaattttagaccaatatccctgatgaacattgatgcaaaaatcctcaataaaatactgacaaaccgaatccagcagcacattaaaagcttatccaccatgatcaagtggacttcatccctgggatgcaaggctggttcaacatatgcaaatcagtaaacgtaatccagcatataaacagaaccaaagacaaaaaccacatgattatctcaacagatgcagaaaaggcctttgacaaaattcaacaattcttcatgctaaaaactctcaataagttaggtattgatgggatgtatctcaaaataataagagctctttatgacaaacctacaaccaatatcatactgaatgggcaaaaactggaagcattccctttgaaaagtggcacaagacagggatgccctctctcaccactcctattcaacatagtgttggaagttctggccagggcagtcaggcagaagaaagaaagaaagggtattcaattaggaaaagaggaagtcaaattgtccctgtttgcagatgacatgattgtctatttagaaaactgcattgtctcagcccaaaatctcaagctgataagcaacttcagcaaagtctcaggatagaaaatcagtgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggacacaaagaaatggaagaacattccatgctcatggataggaagaatcaatattgtaaaaatggccatactgcccaaggtaatttatagattcaatgccatccccatcaagctaccaatgactttcttcacagaattggaaaaaactactttaaagttcatatggaaccacgaaagagcctgcactgccaagacaatcttaagccaaaagaacaaagctagaggcatcacactacctgacttcaaactatagtacaaggctacattaaccaaaacagcatggtactggtaccaaaacagagatatagaccaatggaacagaacagagccctcagaaataataccacacgtctacaaccatctgatctttgacaaacctgagaaaaacaagcaatagggaaaggattccctatttaataaatggtgctgggaaaactggctagccatatgtagaaagctgaaactggatcccttccttacaccttatacaaaaagtaattcaagatggattaaagacttaaatattagacctaaaaccataaaaaccctagaagaaaacctaggcaataccattcaggacataagtatgggcaaggacttcatgtctaaaacaccaaaagcaatggcaaccaaagccgaaattgacaaatgggatctaattaaactaaagagcttctgcacagcaaaagaaactaccatcagagtgaacaggcaacctacagaatggtagaaaagttttgcaacctactcatctgacaaagggctaatatccagaatctacaaagcactcaaacaaatttacaagaaaaaaacaaacaaccccatcacaaagtgggcgaaggatatgaacagacacttctcaaaataagacatttatgcagccaacagacacatgaagaaatgctcataatcactggctatcagagaaatggaaatcaaaaccacaatgagataccatctcacaccagttagaatggtgatcattaagaagtcaggaaacaacaggtgctggagaggatgtcgagaaataggaacacttttacactgttggtgggactgtaaattagttcaaccattgtggaagacagtgtggcgattcctcaaggatctagaactagaaataccatttgacccagccatcccgttactgggtatatacccaaaggattataaatcatgctgctataaagacacatgcacgtgtatgtttattgtggcactattcacaatagcaaagacttggaactcacccaaatgtccatcagtgatagactggattaagaaaatgtggcacatatacaccatggaataccatgcagccataaaaaaggatgcgttcatgtcctttttagggacatggatgaagctggaggaaccatcattctcagcaaactgtcacaaggatgaaaaaccaaacaccgcatgttctcactcataggtaggaattgaacaatgagaacacttggacacagcaaggggaacatcacacaccggggcctgtcctggggtcgagggaggggttagggaaagcattaggagatatacctaatgtaaatgacgagttaatgggtgcagcacaccaagatggcacatgtatacataggtaacaaacctgcacattgtgcacatgtaccctagaacttaaaagtataataataaaaaaaaaataataaggcagggttatatctactttaagaaaaattgacagtaagaatttaaaatcttgcagtatctttactctgttttgctagttctgtttttccttcttctgttctgatttggtttcattttagagatagcatatactaatggtacaaaacataatcgaatactaaataaaaagtacatctttttctcactatttcttgcattctccattctttgctctaccctcaatgccaattcctgaaagtaaacactactgttttcctgtgtatctctccatcaatattccatgcatagacaaatatttataaatatttaaataagcagacatgtgttcttgtgtgtgagtgtgtatatatatatatatatacacaatgtacatatatttatatatagtgtatatatgtttacgtgtatctgtatgtgtgtgtatatgtgtgtgtgtgtgtgtgtgtgtgtatatatatatatatatatatatatatgtatatgtatatatggacatctttaagtttaccatgcatgggtatacctttttcctatgctataatatgattattacataagttatttttctggcttccagttgatgaaattacattattttttgggtattgtgttactttttgctatagtaaacaatgtgtccttgaacacccttgcactctgaatatttgtttacttgagccatatccatagaataaattcctaggaattatgcctttgctattcatgtctacatgaaacatgctctcagttggatttccaaagcatgaggtaaataaattgcaagtaaattatttgagatattcatatatgatataggtaagcagacaaatgatttttgcctgtatattcatttggccgaattttatgatcacttcctgtcaccaagttaaatgattgtatagcagtctgcatcagttatgaaagatatacaacccttgcattgtttttgcagtctgctcatctcatgcctagagtcacagcttaatttgaaatataatcttttcttttgaaactacagcttaattgaagaacacatttttaaaatggtagaataaggttagaaattattttacagttgtacttgagcattcacatcttgtgcgttattttctcaatataaccaggctatgaacaagcaaatgtgcgtgttatttattccttggtagaaaggctacttagtgccagagcatagcaaaacaggaaggaaaatgctaaaattagccttgtttctcgttcatcgttgatttaattttgggggacatcaaaggtattaaggacaacagactgggaattatcaagataaaaatgacatacccagaaaatactgaattctccagtcctcaaaaagtcttgcaatttatttcatgcaataaatgttaagaaagagggaggagaactggggcaaggacgagggataacatttcttagactcccatctgaaatgaatgattaagggcatatggaatagacagaattaatagcatctgtgatctgtaactaaacttgttgctatagtcagtttgaggattctggtgacacagttaataatcaactattaaacaacagtcaggataccaatctttatttcatataccatgaaaattatggagttcaaatagcctatttttaactttaaaaggcatttctcctttatattttactcatatgctaatatgcattatatgaagatatatgaataagcgaatgaatgtgtgtttatggaacatatgaaatcataactatggcctatgacaatcaaaacacttaacaagatatgtcttcaatttttctatctggatattgggaaaaatagtagggaaaatgttattgtaaaaataaatagataggtttgtgtaggaatgtaagtaaatatgcttatagacacagtcttttagtttactgctatctatatttgacctaaattatatctgggtatttcagttggttgcttgcatttaacacagaatcagtttaaattccaatagcctgaattactaattctgaaaagtatacttctcccatcctccgtttcctccggtgtaaacagaacatagtaaaacctagggggaaagtcttgattaaatgatatataactttatgtttggcctacgtttattaatcaatgaataaatatttgttttgactgggcacggtagctcaagcctgtaatccaagcactttgggaggccgaggtggggggatcatgaggtcaggagatcgagaccatcctggctaacacagtgaaaccccgtctctactaaaacacaaaaaattagccaggcatggtggcaggcgcctgtagtcccagctactagggaggctgaggcaggagaatggcgtgaacccgggaggcggagcttgcagtgagccgagatcgcgccactacactccagactgggggacagagcgagacttcatctcaaaataaataaataaataaataaataaatatttgtttcattcttcccctcttaaactattaccttcaacgtttttcacttttcaccagttaacttctgtccttcattgggagttcagccaaatcgattaaaattatggagtcttctaaaattctttctggaggagatggttaatgggcgcaaaaatatagttaggatgaataagatctagtatttgatagcacaacagggtgattgtgctcaacaaaaatttactgtatattttaaaataatgaaaagagtggaatagaatgttcctaatgcaaagaaataataactggttgaggtgatggataccccaattaccctgatttgattattacagattgtatgcctgtatcaaaacatcacacttaccccataaatatatacctattgtgtacccattttaattaaaaatttaaacacatttaaataaaattatttttaacaaggtggcatatatatgtatataaacaaactcaaaactaaaccaaataaattgtaaaattattgttaaagtcaataaaatgttttaaatgctcaaaacaaattgtgtacatcttcatttatttcatatttctcaattaaaattatatgcaaagcattttaataggtactacaaggtaaagaaaaattaatccatagttcacaattgttttgggtattatattctgataagcctttgtaagttttccttaagacttaggaaaaaaatgaagatacagaacaaattatctttttacttctacaagtaaaacatatctccactggcatttaaagtgagtggtgaaaaaaaatgagaacaggaagttctcatgtaaataataatattgtcaatatttgtgtcaatttctttttttttttttctttttgagatggggtcttgttctgtcactgcagctggagtgcagtggcgcagtctcggctcactgcaacctccgcctccctggctcaagcaatcctccgccttatcctcctgagtagctgggactacaggcatgtaatcatcatgcctggctaattgtttgtattttttgtaaagacggggtttccctatgttgcccaggctgatctggaactcctgggattaagcagtcttcccaccttggcctcccaaagtactgggattgcagatgtgagctaccgtgcccagcctatttgtgtcaatttatatggaaataaatcttaaatataatcagcctttacaaggcagtttggagtatgttgcactcccagttctatagctaaccagaagatgaaaaagctatgctgttctttcattgcctcagtttccttataagagggcatggtaagatgacttgtaagatctgtgttgctgctaaaaaaacatagtctgcatacatccatgccattagtgtttttacttaaagaattgtcatttctgcaataatcaatcacagtgttaggaaattatgaataactaaaaatgtaacctctccttttaccacagaaggaaattaaaacccagagaagccaagtgaaattggccaaaaagcagtttatccattgcagaaccatgtcaaagacccaaatcaagttactaataatcatgtccttttgaattttgtagatttttaaaaaatatataacatctatataacttattattcacctggacctttacttctggatgagtcctttgcaaatcttccttttccgtatttgtatagattgtgtttgtaataggaaattttcaaaaatagcattacatagttttctttacatttattaaaatgggctttcaattaggtactcccaagtacagttacctaggtgatcatgatatgctggtaattgtgagaagtgtgagaattcaagagtacatcatctttcctgataagcaacaatgaaaataagaagatggtagctctaatatactaatgtttagagttattaaagatgagactatttagtaacatcactgatttttaagctaaaaaaattttcatttaattgtctctttccaactgacaaatttggtggtttataatgctgaaaatattttggaatttttttggacttgtcttcagagactatatcgtatctgtttaaatgaccttaatgctaggaaactttgtattcggagtgtgtatgaaatgtagaaacagtcaagtaggatgaatttagttggttaactttgggcataataacatttcggctaaaaatgacatgactacattgtgagggtgggtggtcttaagatagtttataagatccttctaacaacattttaaaagcttagaaacagaagtgtaaatagagacctacatattgaatattttagtacagtctttagcagaaaacgtgtaagataaacagtgaacagtaagctatgtttagttagcatgaagcatatttaggtgagcgacaccctttgacttgcgttctgttagttccacattggataaacgcatagtcaatcaggcacacagatcacatttgctatatatctgttaacattaaattattgtgcaaatataatgatctgttaatactcttaagttagattatgaaggaagaacagtgatttcaaggaaaggaatacaacaggtcctcaagtaatatcatttcattcaatatcgttttattgtaacattgatgagaaaataaataaattgctagccttggttactctctgtgagatgtgaaccctgaaaatttgagacaggtctcagttaatttagaaagtttattttgccaaggtttaggacacacgcccatgatacagcctcaggaggtcctgataacatgtacccaaagtggtcagagcacagtttggttttatacattttagggagacatgagacatcaatcaacatatggaaggtgaacattggttcagtctggaaaggcaggacaacccaaagcagaagtgggaagactcaaagtggggagtgggcttccaggtcataggtagagaagatacattttttgaggcattattttgagtttctgattagcttctccaaacgaagcaatcagatacgcatttatctcagtgagcagaggggtaactttgaatagaatgggaggcaggttggccctaagcagtcgcagcttgacttttccctttagcttagtgatttgggggccccaagatttattttcttttcacagtggagtttgcatgttctccccatgtttgcatgggttttctctagtacttgggtttcctcccacatcctaaagctgtgcacgttggcttaattggtatgtctagatgttcccgctctgcatgtgcatgggtgtgtatgtgtgagtgcaccctgtgatgggatgacatcctgtccagggctggttcctgccttgtgccctgagctgccagaatgggctctggtcatccttgaccctgaactggaataagcaggttataaaatgaatgaataagtgaatacaaattattgtaaaataaaaatttataaagtatatgaagaaagtaaatcatgtaaatgcaggacaataaacaatgctgtacagaagtgcacagggagcctgccatgtttgtgattgtttttgacatgcctagtggtagaaggtgctcctgacaattttcactgtgcaaacattgattccttgatttaacccaccatcatgacaaccagtggcactcattgattcaccaaaacctggataaattacttacttgagaggctgaggtgtcaggattgcttgagcccaggacttcaaggctgcagtgagctatgatcatgcgactgcactccagcctgggtgacagagcaagaccttgtctctaaaaaaaaattttgtaaaaataatcatctcacttgttcttatccatctttcttaaaggtatgtataggtcacacttaattcattgtttaatatgagaagtatttaggtctttatttagaagcttggtcattgttttgtgaccagaaacatgccataggaacttaactcttttctgtatcagttaatctatggtaacgttggtttcatgatactttgttttgcttaattttgcagtttccaagaacctattgatggtattaagtgaggacatattgtatagtcaaatgctccaccatcttcttttggtttttaaaaaaaatggcagtaactagagattttaacaccactgctttgggaaagcaatacattaatacatctcattcaagttttgggtggaagaagaaagaaaaactaagttaactaagttgagctaatgtaaacaaacattgaaattgtaaaggcattttggataactcattgaacctaagaactgtaactacagttagacctcacagggactgtgagcattcttctctactaacacacctctgcttcactgccctcatggctacgccctttctatgtccacttacttcagtcgaccagcttagacactcatggaacatcaaggaattcagtgtagatgattggctcagccgggccaggcttctcccctgattaaatcagctgtggccaggggagcaatgtcagggagtacacagagcacactgagcgcactctgcatgtggtgggaggagggttagagaggcagggtttggaaaagggctgctcatgagctaggcatttgtccaaaaatgtgcctaccacactacattaaaataaaattcaagtaaaacttgaaatgagctagtcaacacaaatcttacgtttggcctatgtaatgtttctaaaataattaaatgttgttccattacattctagtatttctagtccatagctttaaaaatgatatattatgggaaatacttctctagagtatatttcagtgatcatattcttttaagaagaaatttaaattattttttatttataattggcaaaagcttatgacatttgaagcttgttttacttaatcaagtattcagtaattcagccactctgggccttgagctctttgggacagaagcactgcatgtataaatctaacaattacatttgtctcagtcttatctgagcctgtggtcaaggccagacagctgctgacaggttgagtaattctgactgatggaactaatgtccttctgcgtaaaagcagacattttgaaaatgtctcaatctttatcatggtgaatcagcttagagtcatttagcaatctgtaccctcctccttgactcttccacctactgcaccaccgagttacgatgtcacatggatgcacacaagcatctatccaacataaataattagtacttttgtttagaagatggattaatcaatgattcttgctttgtatgaattttcattctttaacaggcagtattgattaccccagcaacaacactttacacaaccccgcttatttgagtccacatccctatattaattatagaaagaaaaaaaaagttggatctagtaatttttaaaaatgaattagaacaaagttacataagcaacaactcaaaacatgcttcataattacagatataagcagatgtacatagagatatggagtgctggcaggaaataaaattcagagacacaaatctctaagtaaccaaacatttttatccttccctggtttagcctaatactaatccctcaaggctaatttggtacagatacaatcttactcagaagcctcagtaaataaaacatctgaaagccttcccacaaacattaggaatgcttatttttcaaatagaaaagtgtttatcttttgtctttcacactgtctgacctcttaataagagatttaagaagaggcagtcacattttccagcattgactatgtatgtgctcagcactttacatgtaacatctcatttaatctttataataaccttgttgtatacatgcaactgaggctctgaaaatgttgtgacttgcccaagattatccacttaaagtataacattaatgagtatgaatgaattatagacatataataatatagacataatatataattcattcatactcacactctttctaccatacaaaattgagaaggaggatttatccaggcaataagtattactgtttgaaatatgtatggcatggcattcaatattgttactgtactaaatgataattaaatatgagcattccttatggaaagaagacactagaagacttagatccaagttaggtgtgggatttggagccaacatagcatttataggcctcagttttcttactcttatttatttaatgtgtcccctcatcccccttcactctacacacttgtcccatttatatgttttatctcagtaggaaataacagatataagatgtgatgtaaatataatataaaagaaatattgcccttaattatttgtgtcccacttatttggaaactaaggttcaagaaagtaaataccaccccatctctttcactgctgtatccccagcacctacactggtctgtgaaatttagtaagcaataaatatttgtcatgtgaatgaacaaaagggagagagtataaattgggaaacatggaccacaaaatgaacaccactatagtactttctctctgtgcgatcattttctgtttatttgtctacaccttccactggacactgagatcaaggttgtcttcaacgttatttccccactagaacagtatctggccctgccatatgataggccctcaataaataaaaattgtcaaaaagcttgaaaatatagggctttttatttcattatcacctggaagttaatgtgggaagtaggtttgcatatcagagtatgtttcttcaaagacacgtttacaaaacagtcatagaagattgtaactgagagtaaatcagagcaaattaaggcaaataaaaaatacagcaaatcaactaaatatttccctgtgtttccagaattttgaggtatcctgaatttcttggataagaatgaaattgttatgaaagaatgaatgtatgaactaacttaaaaaaatcaaaactaattattaagtagatcctggccttttgttggtcggtaacattgcctaagccagtagagtttgtgttctgtgccattaaagaagagcctgttcattttatgttgttttcttccttagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtaagtacacccaggcaacacattgccctagctttcatgtacctaagcagatttcgttgccataagagctgtgattgaataagtaccaggaagatctttgcttttctgccacagtgtctgaagctctgcttactctaattactcttttaaataggaagctgtggcctctcaagtttctttggtagatgcagttttctcaagtgagttggtgtatcaaacagttcatggtaatttgtaccttagcatttagtttattagattggagcaaactaatatttagcaaaatcagggcactatgaaatttttgataaagaatttgtgaaaacagttggagtgtggcacattctctaagcagtgtgtttttggtgagggtgggggatggcagccaccatcacccataagatccctgaatactgaacgactgcctcacagtgaatggagagtgtctgaagaagtgcataggaacaagacaagatcaccttggtcttagatattcttattaaaatacccttttaatcttgaaatcttaacacttttttatgtacatatgcacatatatatgcataatatatatatatatatattatgcatatatatatatatatgtgacttaatcctaaatccggtatgttgtagctttgaggaccactgagcccctcttaatagctccacatgtagggggtggaaaaacactttgcaataataaagctcaaccaattcttggtataaggaagagaaaaagtagaattctaaataagaaaaaatagcctattcacaatcttttgaagacagtattacttaattatctcacaggttattatgaagataaaattagctagtagacatgaaaaatattgaaagttaaagtactatatcagcagtcattttaatagaattattgcttatgatcaattatatacttaataaatacttgttattgatgtatacaaatgtatttcacacataggcaatcacagacacataccccataccacattcagataaaggaggctagctatgtaaaacacacctaaacacacaaacgtacacaaacatgcaaacacaatacacacactaatatactatgtatttttgtaattctgtctttttattgaaattcaaaagactccctaatactgattattttatattataatgtattttatgcatatacaagtctatattcctataatcttctaaaaaggaacgatggcatctttcagaattatattatgattttttacattttactatcccttgcattaatttaaatcgtggactgccaggattaatttcagaaaattctacgtcattctttgtgatatgcaaagtaaccacgaagcaagccgtggtggctagcagatcattcttttcatgagctccctggcaagacaggacttatttaattttagcattacatgtatacccatccagccttgctaaatggacccaatgaatgtaatattaattagaaaaaactatcttgatccttttaaaaggatttttaaagggagaaataaactatgatcaaagaatgtccaaatgagcttactcaaagtatttgccttcttaagcttttggtaaatgttctctatgaccaactaaattataataagtgaaatgtaaaatatagttacttctacctggttttaatcttaaagatttgttagaccagaggccgggcgtggtagctcacgcctgtaatcccagcactttgggaggcggagacaggctgatcacaaggtcaggagatcaagaccattctggtgaaaccccatctctagtaaaaatacaagaattagccaggcgtggtggcgcatgcctgtagtctcagctacccgggaggctgcggcaggagaatcacttgaacccaggaggcggaagttgcagtgagccaagatcacgccactgcactccagcctgggttacagaacaagactctgactcaaaaaaaaaaaaaaaaaaaaattattagatcagcgtgtctaacctttgcattacaggttacttttctccttaattcacaaagaatattcctaagtcattcccatacgaatttattctagcttataaaaattctatatcttacttcaattttaatataaggttataaactgatatattatttatactaaaatattgtatacttatatcatcattttaaagcatgccatttctctagaggtcataatagattgatggttgtatgaactaatggcccatctgttgggcagtggttacttcatagtattttgcttgtcttctaggctcttccctagaagaattttaaaattcttagctcattatggaagagctaagaatttttaaaaatgcctcaaggggaaaatctccaagtgtcttgttcacttctttctggaacgtgttttctcaagttctctttcctgccagccctgaagtctaatttttgtctccttagctctttgagattgccagataattcgctggctttcctgactctcagcatctttcctcatcctggattttcagtctccctttcttctccaagtattaataggcggataccctgaagggaaaagtggtatgctgaatgtagcgctgatttcaataagcttctcttctttacaagattggcctgtcaatgttggctgcctcaacagctttacagtgccttcaaacaaatggttttgtttggttgattttgctttaattttattttgtctgattattctagatggaattataaatcatgtacaagctatttcattatacatagttcagtattttaagatggattttatagatagtgtgcatgtctgcattttaaatagtaataccctggttaagtgttactgattaaatatagacaaagtccaaaattttaccaaatttatataatctagggttaaatttcttatggaaagcagtgaaaatactttaaatactggtgtttcctaagtgctgactttggtctacttttccccctgtacgttgttatctattcttatggcttgacattttctatatgataacccctgaagttgtgtctctagcctataaaacacttttctgagctccatacccatattatatattcaaatgtcttataaatatctttaccagagtgacacacagctatttcttttttttttattatactttaagttttagggtacatgtgcacaacgtgcaggttagttacatatgtatacatgtgccatgttggcgtgctgcacccattaactcgtcatttaaattaggtatatctcctaatgctatccctcccccctccccccaccccacaacaggccccggtgtgtgatgttccccttcctatgtccatgtgttctcattgttcaattcccacctatgagtaagaacatgtggtgtttggttttttgtccttgggatagtttgctgagaatgatggtttccagcttcatccatgtccctacaaaggacatgaactcatcattttttatggctgcatagtattccatggtgtatatgtaccacattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatcgctgggtcaaatggtatttctagttctagatccctgaggaatcatcacactgacttccacaatggttgaactagtttacagtcccaccaacagtgtaaaagtgttcctatttcttcacactatttcatatttagtatgtttaaaattgatatcctaaaatgctttgacccacattctctatgaaatgtccactatccacccacatacacaggttgtgaacccaagttactttctacttctttcaccttacactcaatattctataatcatgaattattttctaatctaactcctaaatgtttgttttcctaatccagtttctcatttcaaccatcatctcttatttcatctcttcagttcagcttctgtcttctttggtatgttgcgttgcctcctaacttgtgcccctatctataatttcttcattttataatctatccattaagttctgaaatatggaaatgattgtattactctgatgcttaaaacccaatggttgccttttgttaccttcaaggttgtagcttgataggtcatccatggtttcacactaaactgctgaaccagttttttaaaaatcattcttcccactctcctcccttgttttcctttgtaactgaattgcttgatgtttcccatgatctcttatttcttttttatttttttgagacggaatttcactcttgttgcccgggctggagtgcaatggcgtgatctcagctcactgcaacctccgcctcccaggttcaagtgattctcctgcctcagcctcctgagtagctgggattacaggcatatgccaccacacctggccaattttttgcatttttagtagggacggggtttctccacattggtcaggctggtctcgaactcctgacctctggtgatccgcccacctcggcctcccaaagcgctgggattacaggcgtgagccactgcgcccagccatgatctcttatttgtatacctttgaatatatcttttatatctcaaatccctttctttcatttgtctacctacaaagtccctgtttttcctcaaagcatcaacttaaatatcaacttagtaaagtatctgttttcagattaaaaccctacctcttatatatagccttggtagactcacaacccttcataaatcctaagattgtactaattatactatattgaaaatatttgtttatgccagccatgtaacttgaaattcagcctggagaacagtgattacttacagactctatggaaagggttggtaagtttatcccttagtggaaatatctaaactagaaaaaggaaggccttaacaatgcaccgttcacaatagggttcatactcctattataatctaatgcctccactgatctgacaggaggcagaccttaagcggtaatgctggctctcccaccgctcacctcctgctgtgcggccctattcctagtaggccatgggcaggtaccagtccacggccctgggtttggagacccctaaaggatatatttatcgcttttgaaattagtgctagaaatgcttccaacttcttttctatcttataattggacggtgcttaaactaaaacaaaggcaaaagtaaatgaaatctgcccctgagtgattgctattggttacccgaagtaactctattgagagtacctggaagtagtctctattgagtagttttatattgaatgtctttggaagtagtcacctagttttcttgggacagattcttggctactttaggtaaagaaaacaagctaaaggagaccttatcatgcaaagtgtagggaggggaaaagagaatataaaaagagtcaagacccagggtggaagtaaagggaatgtggtcctgaggaatgttcatacatagagaatatgccttttatctggaaccccagttatgtgaatattgatagagtgattggagtgagtgtcaaagacatgccatacagaggtgagaggacaatgaagacattactttgatctcaatattctaacttctaagcaaccccaacacattaataaatgtcaataacagtaaaaatgacacaataaagatgataggttgttttgtacttctaaaatgcctgctttgtttcatccttactaattcatatgaattcaagcttaagaaaaatcaacaaataacttattgaataatgactatatacaaaggcttaagtgaattctcttatgcctaagcttagaatttgattgtaatgaaaaaattgcgtaacttcataacttaattttaaaattgattactgttttttagtttttttgttttttgtctttaatttgtagagacaaggtcttgctgtgttggccaggctagtctcaaactcctgagctcatgcaattttcccacctcccaaagtgctaggattacaggcatgagccatcatgtccagcctagttttttagtatttcagttttttagtatttcagcattatgttttactttagatacactaaacaaatctttattataacctactctgattatcctgcttctgaactaaattaccagttttgctaaatcctctgaaaataatctaattttgcaagctatattagaagaaatgttattaatatagaggacaaatctctattctaaattagaactaagtagaagtaattgtactctatgggaaatatgatatcatatgagagtctttattttcattaaattactttaaaagagaatcatgaaaaaaaagtttgttagagagcacatttacttattgtctgaggagtgaacaaagtcaccatacatctttgaaaaggaatgttgtcaggatctcttcatgcatttgctcaggtagggatatattactgcctgtgggtgcacatgcacacgcatacagaaacacaagtacatccacataaaaatagcaaccttagactagcattttctatctattcagaccttaaaattaaaaaatcttgaaagtacgcttccccacgaagtcttcttaggttaatggaatctaagagttagatgtctagcttgctttaataaagtttcccacacatccttaaaacatgattcaaattcttattcaaaggcctgttaactccttcaaatttttattctaaacatgctcagtatatctgactttttatggcgattaattatacaatttgttctgctaataccttgttctcttagtttgatttttacattattatcactccaaaccacaaccttagcttttctgattactgctttgtctctctgagaaaaatccaactaatgttttgagttatatctctcttggcttcccttagttcctggatccgctttgcacagaaggtggaacctaggtgtaaaaagaactttatcaagcttttcatccaatctccgtgtagttcttgagtaaccttcacagcattgctgacaaacattctttcactttatgtttgaactcttccgtgagaaagaacacactttctcccaagacttctttgtgtagaataggaagctatctcttttagattctggtttaatttctaattgctgggttcattgcaagcaagcaaaataatgtgatattttccacatgatactcctttaaatatttctcccagttcttttttccaagctaaacatttctgattggtttatatagtttttcatgcaacatctcttcactattttgatagatctcttctaaacttgttttatgtcaattctttttacttttaagaattttaaacttatagaaaaattgcaaaaattatagagtttacatataccttttatccagtgtgcatacatacttacataattatagcacaatgatcataactaggaaattaacaatgataaaaccctttaaactgcaaaccttgttcaaatttcaccagttttcccccaatgtcttttttctactctgaaatccaatgcactatgtcccattatctttagtgcttgtgtgtccttggtcttcaatctgacaatttctctgtctttccttggttttcacttttttttttttttttttttttttgacggaggcttgctctgtcgcccaggctggagtgcagtggcgtgatcctggttcactgcaacctcctcctcccaggttcaagtgattctcctgcctcagcctcccgagtagcttggactataggtacgcaccaccatgcacagctagtttttgtgttattagtagagacggggtttcaccatattggccaggctggtctcgaactcctgatcttgtgatccacccacctcagcctcccaaagtgctggcattacaggcgtgagccaccatgctgtgccggttttcacttttgaagagtactggtcagttattttatagaataactccaaacttgtctaatgtttttttcaagattagatggaatttacacatttttggctagaatgacacagagtgttaaagtacaagttttttcatatgaacatatgttttcaattctcttgagtatatgtctaggagtagaatttgttgggtcatatgatttaacttgctggtttcaagtatctcgttgtctttggctttcaacagtttatatatctaggtgtgggtctctcggagtggagtctgtgaaacttcttggatgtgtggattaatgtttttaatcagtttggggagttttcagccattgttttatcaaatatcctttctcctcctctcctctgagtcttttattatgcatatattggtacatttgatgctgttccacaaaaatctaaggctatgttaatttttttggttctatttttttttctgttcctcagacatggtaaccacaattgacctgtcttcacatttaccaattttttttttttcttcctggttatacctattgtttggcatcattagtgaaatcttcattttgggtattgtacttttcttttctttttttttttttggagacagagtttcgctcttgtcatccaggctggactggagtgcaatgacatggtcttggctcactacaacctctgcctcccaggtttgagcaattctcctgcctccgcctcccaagtagctgggattacaggcacccaccatgacacccagctaatttttatatttttagtagagatggggtttcaccatgttggccaggctggtctcgaactcctgacctcaggtgatctgcccatctctgcctcccaaagtgctgggattacaggcatgagctgccatgcccggcctagttattgtacttttcaattcaagaatttctatgtggttcttttttatgatttctatctctttattgatattttctatttgatgtcattctcatatgctcatttagttatatagacatagtttcttttatgttttgaacataattaaaatagctaatttaaagtatttgttcagtaaatctaacatctgggttgcctgagggatagtttctattcattattttcttgtgtatacatcatatcttcttggttttttgcatattttgtaaatttttgttgaaaattggacattctatgtggaaattttagaaatcataaatttttctctcaggatttgttgtttctgttcacagtagtagttgctatttattgacttttctgaatttacagatttaatttcgtatatctatattctttgtcacacgtggccactgacatctctgtttcattaatttagtggtcagctaatgattgaacagagatttccttaaatgcctgtaatgaagaaatctcctagtctttgccagaaggctctatgtgcatgttggggcatgacttcaacactctaccaggaagttagtaactgccttaaccttcacattatatataccctcaaagtcaaccagtggtaagagagtctagggccttctcaggtctttcctgaacatgagcaaagcctcaagcatgcacatggcattttaaattcccaggaatgtattggagctttccaaagcttatgtgtatatctcatgctccagcttttcttttaagcttttgaggttttttgctccattgttgttatccactggctcagatagccatgatgttaaatcacttgcttttagttgtttttaacaagtaacttcctgtctccttaccctatacccaaggaatagattttttgcattggctgaactctgagatacgtgaaatacagaaagccttgcaagttgggattttctttgggactgaagctttgaaagagctccagcttcattttgctccccaaacctcctcccctatgggtgccagagtgtacccagaatgagggctatttttccaggctatatgagtctagagagtctccccagccatgccttctgtacagcctgtggaactgtgagttaattaaacctattttcttcataaattacccagccacaggtagttttttataggagtgcgagaatggactaatatagaaaattggtacctggagtggggcattgttatgaagatacctgaaaaggtggaagcaactttgaaatggggtaacaggcagagattggaacagtttggagggctcagaagacatgaagatgagggaaagtttgtaactttctagagacttgttaaattattgtgaccaaagtgctgatagtgatatagacaatgaagtccaggctgaggtggcctcagatggagatgaggaacttactgagaactggagtaaaggtcactcttgctaacctttggcaaagagactggtggcattgtgcccccgctctagggctctctggaactttgaaattgagagagatgatttagggtaccttgcagaagagaaatttttaagcagcagaatgttcaagatgtgacctggctgcttctaaaagcctatgctcatttgcataaagaaatgacctgaaatatttaaaagggaagcaaagcataaaagtttggaaaatttgcagcctggctatgaggtagaaaagaaaaacccattttcagggtagaaattcaagccaactgcagaaaattgcataagtaaagaggagctgagtcttaatagctaagacaatggggaaaatgcctcctaggcatttcagaaaacttcacagcagcctatcccattacaagcccagaggcctgggagggaaaaatggttttgtgggccaggctcagagccccactgctctgtgcaacctcaggacatgataccctgcatcccagcccttccagctccagctgtggcaaaaagggccgcagatatgtctcaggccaccgctccagggggtgcaagccataagaatccttggcaacttccacgtggtattaagcctgtgggtgcacagagtacaagagttgaagcctgggagactccaactagatttcagaggatgtatggaaatgcctggatgtccagacagaagtctactgcaggggtaggaccctcatggagaacctttactagggcagtacagaggggaaatgtggggttggagtcccgacacagagtccctactgggacactgcctagtggagctgtgaggagagggccacagttctgcagaccccagaatggtagatccactgacagtttgcaccatgtgcctggaaaagcagcaggcactcaatgccagcccatgaaagcagctgtggaggctgtaccctgcagagcacagggtcagagctgaccaaggccttgggagcccacgcctagtgtcagtgtggcctggatgtgagacatagaatcaaaagagattattttggagctttaagatttaatgactgccctgctgggttttggatttccatggaacctgtagtccctttgttttggccaatttcttccttttggaatgggagcatttacccaatgcctgtacaaccattgtatcttggaagtaactaacttgttttttattttgcaggcttataggcagaagggacttggcttgactcagataagattttggacttgaacttttgagttaatgctgaaatgagttaatatttgggggctgttgagaagatatgattgtgttttgaaatgtgaggacatgagatttgggaggggacagtggtagtatgatatagtttggttatgtatccccactcaaatctcacgttgaattctgatcccgagtgttggaggtggggcctagcgggaggtgattggattatgggagtggtttctaatggtttagcaccatccccagagtgctgtcttgcgatagagttctcatgagatctggttgtttgcaagtatgtagcttcttcccctttgctctctctttttcctgttctggccattgaagacatgcctccttcctcttcaccttctgccatgattgtaagtttcctgaggcctccccagccatgtttcctttacagcctgcagaactataagtcaattaaacctcttttcttcataaattacctagtctcaggttgttctttatagcagtgtgagaatagactaacacaacttcatatctagaatacccaggtactgaaatacaaagacctaaaattacattttcacaaactcattgtactaaatatatcttaagatatgcctctaaaattatctttgattggagtacagtggaaagagcaggggctttggaggtagatagacaatgagtcaaataccaactcaggcatgttctagttgtgtgacactgagcaaattacttaccctctgtgagcttgaagttttccatctgtgcaatgggcatcataaaacctgtgtcctaggattgtgatgtggattaagcgagatgatgtgtctagggaaaatgcatgtacagtacctggcacagagcaggggacaataagtgagagccatatgtataagtctatgaatgtgtgtctcatatgaagtagtaattacatgtaaacaatcagacaagcccagttaaacattgttgaccctgtaagtcctgaagagttgcttaccattttgctatctccagctattttgaaagtattatttacatcatttccatccttttcttctgcactcatgtttgacataaagattgcaagcactaaattctttaatatttctgaaactcagaagcttctaccaacctgagttaggagcttgttttattttcatcataaatgagaaagaaaaatgtctctaaagcttacagtcttctatgagactgtcttggtcggtgagtgctgctgtactagaataccatagactgggtgacttaaaaagtaagcattatttttttttacacacaatcacaacaaaaatgggatatcatgtgcactttccaatttactttttatttactgaaaagtaaataaaaagtttgctttttatcagtatgtaataccctgtatcggtatgtaatactcattttctgtgtcagtatgtaatacccattacattataatttgtaatgttctattgtgttgatttaatcaacctttttgacagacttctgaactatttctagttcttctttttatcattgttgtgatgaatatccatatataggtatctttgtacacttatgttaatatttttatagggaaaatttcaagcagtggaatgactcaatgatatatgtataattttttactttaaaagatattgtcaaagtgttttcttaaaaagatgcacgtgtttacactaaagcaacaaataatggcagtgcctgtttcccaacattcttgccaactctgggaattataagtttttaatgtttgccagtgtgatttgcacacacctaaatatacacatatatagtaccttaaacttgtatttctttaattattagttatgttttaatagcttcatttatcatgtaccagacactctactaagtgcatactctcattaattcttatacaaccctgtgagtttgaatatctttgcatagatttatacagcatttgtttcttttttggattacttgttcatctccctacattaatttttctgattgcttgctcatgtttttcaatgatttagagagtgtgctttgttcttgctcttttcttgtttccttcttttcttttggaggtgaggtgggctatattatagctattagcttttgtctctcctgaatttttatttctctattaacacatctttctcctatctatttttaaggaaatttacatcttaatatgagatgagtttttgtatgatatcaaattgtttcagataattattttaaatattttgtgtgctaattcaattttccatctacaataatagtacagttaacatgttgagaacatttaaagttatgtttaactttaactcagggttaaaacggtgaaaacatatgttgccataagagtctcagtctatattcatcctaatttattaactagatgcagaatcaggaagattaatgattactttttaatgcaaagtgctaagaatttaggcatttgaaatatcaagcggaatagagcattaggaaataggtaattgtaaaattgcgggtggcagagttgtaatgatagagatattcatgagatcacatttcatcttttttattcccattacaaattttagtgataaaatggaaaattgggcaccttttgttgtcagaagctctataatgcaaagtttttttcagtatttcaaagatttccagttggaaaactgaaaaagctcgtacaaccacagatggtcaagtgtgtattattcaggaaagaaaacagttctttatagaggaagttctgttgtagatgtctctaatgaaaaagggaatacctgcaaatgtaagcatcttgtcaaacaggatacttcatacaatttaagaaaaaccattcctggctcaaaaggattttctgacaattgatttgaggtttgtattatttactttgtagcttctcagaagcaaggatctgcctactctttctttttctgaaaataatgttatatttttcttataaaattaatcaatatttattttagaaattatggaaagcaaaaatatacaataaaaataaaaatcagaggtatcctcatcattcagatataaacacttgatgtgtttctgtttatgtctagatttatacatttttgttttataatagaaaattgagatctctcaattttatctcctgcttatttcactcaatgttatattattagaatttcccatgcattgagtatacctcagcattttttaatggattcacaatgtctgtctcatgatagatttatcaaacatgtttacctttcctcagcattgaatgttaaaattctctccatccccatttttaatatttaaaaatctgcagtgaatgtgctatgttgtatttctacttcacagatcccttgaaatgaaattactagattaaggatataagatttttagaaatattggaattatgaaactgtcttccagaaaggttgaaaatttacaatcgtaacattttttgaaggtaccagtctcccaacgcaagagctagttagtcttaattgttttattagcagtatgattttgatagtaaatattgtatattaggttgatgcaaaagtaattgtggtttttgccattacttttggtgactctccagagaaacagagcttacaggatctgtgtgtgtgtgtgtgtgtgtgtgtgtgtgtgtgtgtgtgtttatagacatttattataaggaatggctcacactgtcatggaggccagctcaagatctgtagggtgagttggcaagctggaaaaccaggagggctgatgtttcaatttgagtacaagggcaggaaaaaaaaatgatgtcccagtttgaaggctattgggcaggaagaattctctgttactcggggaaggatcagccttttttcctcaggccttcaactaattggataaggcccacccacagtagggagagcaatctgcttcactcagtccaccaattttaatgttaatctcatctaaaaccattcttacaaaaaacacccagaataatgtttgaccaaatatctgtcaagttaggttctcctttgtgtttccatttttcttttatttttgagacagggtctcatgttgcccaggctggagtgcagtggtgcagtaatggctcactacagcctcaacttcctggactcaagtgatcctcctgcctcagcttccctagtagctgggactacaggcatgtaccaccacacctggctaatatttttatcttttgtggagaccaggtctcactatgttacccaggctggtcttgtactgctgacctggaggaatcctcccaccatgacctcccaaagtgctgagattataggcatgagacactgcacctggccatttttcattttttaagaagtctgcagtgaaagtattatgtcatatttcaagttgacacatgaaattaaccatcacatgtcataatatgttattgtttttgttgctatttttttaatgagaccagggagtttaggcatactcttatttattcattggccattttgtacttacaaactgtttgtattttttgtccattttcttgttttgttattgatttgtgagaactttgttcctattaaagctattactttgtagtattcgatgaaaatatttgccacgctttgtgatttatgtttttaaattgcagtaaaatctatccaactttttgtatatttttattgcatgtttcagaacatttttcttcaattacatctttcaataccattttattccatttcattttggagggttctttttttcctgaatatcaattaacttatttggtctttctatctcacacatttgcattatattttctctaattcttttctctttgtgtctttttctctcagttgttgctaattcaattgcaagctgtgtttatttcctatgacactaaatattgtaacattatttttgcttgatattattcacatcagaactcagaaaatatgatattgttttttctagcattttgtgttaaagagattagcctgatatttttccatttagttaaattttttcttcaccttcatgaatgcttatagatcttaatatttttatttctataatgtaaaactttgagctgagtatatataattgtagctattttttcttaaacttgtctggtcttgggtgggctcctaagtccacagacgcggtgtgttctgctcaatgaaatttttcaatcttacacagtctatttgctattttttcattgttctggaatcagagacgtcaaagtattgtgagtactttgtctttcatgttcataataatcgtgttttttaaaaacagtttgcagctctttgactttatcccatgcatctgtcacagcttctccagcttgtctgctatgaaagtgattttggattctgcagtgtcattttgcttattactgcttccaatgcgaatgtcaggtgttatttcattttcccccatttcttttcctcttttgttaaatccctcagacaacctttatttgggccttattttgcttcttttcctttgggtttgtcttcttggatcctatttagacttccaagccattttctaaattttttctggcccctttaataattttcaaaattattatcttttttttctgaatttgagggctttcactttttcttctcatgtacccatgttgatattttttgttaaatttatttactcattctagaatgagatccccatggggcctcatgttgtccaatacatgaagttatgactttggttctgttcactttcttcttagaatctccattttcaaatatagagcctaattttaaatgtatgtacattataatagcccaattaacagtgattagtaagtattcatttactacagatctgtaagatggatgtggtagttacctactgttacctacatagcctagttatctgatactttaaaaaccaatgaaatatatggaaaatgtcagccccccagtagactctactcctgaggtttttcttgtctctgtacctgtgtaatagatctttccttacctcccagggtaccacactctaacacagtccctttacttcagctactcatgtggaattggtgagctgcagcctctaaacagtatataaaggtaattaggactggttgaagggatggactgctagcataagaaaaggtggtactcagtcccaaaaagaaattatttgagctgcccagctttttagtggatagaaatcctgcgccttttaattgagtgaataccaggtaaaccattaggtaacttgtttcttcttgggaaattaaggtgtaatgaggtacagggacagaataattataggtagcacagctagaattaaaccacatgtatctgacttatccacagatccatagctgctctgaaacatacgctagaaatcctattctgcttaaaacacagtcactggtgatattttatatgactatctgacagtttctctgaaggtagaggaagcagtgaggcaaactacttgacataattctgttcagttctagaaatagaaatgacgagatcccaggagaaaacatctcgccttgtggagcccttgataaacagggagggaaatcctgaacgtaattaaatgtgtgtacacactaaaatttaggaagatccatttttaaacactcagacaaaaattggatatttcatgaacagaggtactgaaaggaaagagtgccagaggaataaaagtttcaaaagttaagttcaaatggaatggttgggaataattttaaagaaaaatatttacagtcatcaaaatcagtatgggtacatgtattcttcccggtggactcagatgtaagaaggacatgtataatgaaagaaagtaggaaagtatcattaatgggaaaagaatagccaatgtaagaaaaagggaagcttaaatctaaaatgaagtgaggcttgctaaaaaatgatgaaatggtaactgtaggaaaagagaggccatttaaagtatacattcagattaaacatgcactcaacactggagaaaatgtcgactataaggagatgttacagtattagaaaaaggaaagaagcttaagtcctattttgcttcaatcttctctgtcaaatagaatatttggggatgggggaaggctacctgtaaaagacttccaactatcagataagtgaactgatgaaaaagcatctaggtgttctaagtaacattgtgttttcttcctgcatgaatgataatattcaaatatgagagaacctgatgaactgactttgaggaatgtagcatgcaggacagtttcgtaatggaaaacaaatgaaaagcaaatatttttataaatctaatttataaatctcaaccatcttatgaatcctcaaaatctaatttatcggctttataaattagattctgaatcctcccggtcctaaaaaaaaaaaaatttcgtaaaatatcttattcatctgatttttggggaacgcttagggaaagaaagtggtgataaactagaagattatgtatactattagaccaacttcctttgcaaggtgtataccaacataggagaatgctatagacattgtaatctttcactttgactcctgactttcttaaggatgaaatggtgaaatatagactggatatagttgagttgttttgtgattgctttaataaatgtacctaagtattgatttaatcatttgttgtgaattctaaagctaaagagaaatgctggaaaacactggggcttcagggggagaatggccatgatggttaggaggatgtcatatgccatcatggagagggtcacagatagaagcgagggggagggctcaagtgtgagaagtcctaggggagagagcatggctttcttcaaatgaataactgacatagccaaaaaggaggcctggagaatcgactgggagaggcaagcattgaatggaagttaactgaatgaactctgaagttcttccctcaatgttttataattttgttctcttttataaacctaaagtacagacatattttttaaattgttgttaaatgcaccacattcaaccctacactaaatttaagtggatattttgtatattttctcagaattcatcttaaactttatagcttctttatgctggtttcagagtaaatgctcaaaaaactatttggttggctgatttaagtttcttgttgctaaaatatcacctaagatatggcttgtaaaccaaaattaccttctcttaacagaaaaagacaacgtaagatacttatgtaaagaaatttaacagaattttaaaattatatcttaaaattgtatcataactttgtaaggcaacaaatccaatttgtttgctattgctgtgtatatatatatatatttttttgaagtgcagtggcgcaatcttggctcactgcaacctcgcctcctggattcaagcaattcttctgcctctgcctcccgagtagctgggactacaggcacacgccaccatgcccggctaatttcttttttgtattttagtagagacaggatttcactgtgttgcccaggctggtctattgctatttatgttgtgaaaaatctgcttatgctgcactctcctactttattatccacagtcttgttcctctaggtgctcaagctagatcatttggagtcatctttggcagcactctctcaccaatttctgtatcctgttagtcacagggttattgatcctttcgataacacttaaaacctgttctctcctgtccattcttatttcacaggcctaattcaaatcctcatgatcttgagcaaagtctattgcaatagcctcaaaaccagttatatcatttacccccattccaatgctttgcctctaccatcgctatagttcattccaaaacacagatctgcttaaaacccttcaggaatttttaaatccctggggaaaaaaaatccagactcttctacacagtatgcaatgtccttaattcattggccccaaccttcattttcccagcctttcatagccactcatgcctgctaagccctgagtctgtatttttcaaactagaatacttgtagagtggccagagtcacagagccacaggatagacatcgcccatgttcctggaagtttaattttatttaaatatctaggattttttaaagtagctcagctggtaaataagttaaaatgccatttttatactacacaagttataccctgtgacgtctgaaggggaatacaggtacagagccttacaggggcagatgcaggtttcaaggagactgacatgtctgtgatttggaaagccaaccataagaaatatgtacaaaattgcaaatccaaaattagatacaaaaatgaatatttgtaaagagaaaaaagtcacaacatattgtgtacttaaaattttgacaaacaccacaaacatacaaaatccagaaataaagtaactttattattagttgtcagacatacctctctaatttttttcacaaaatttttgtatactttttgatcacctctctgcatggtatcaattagtaagatgttctatggagaaacctgaatgatagataagtacttcctctaacacggtcaattgaaatctgttcctatactcatagatgttctcactgttcatagtattgctacagattattcacaacaaagacagaatcctcataaattctacttcatgtgattttttaaattaaaaataagtatattaagcatttataatttaatatactagatatctttctgataaaaagagaaatacgggtatgataattggaagcatttttcatagatcagcttctgtatctgttcttctgtatctggacccagttggacattttcatatctttgtataacctctgaccctgcatgtccctgtcactgttgccacaggaggtggtacagtgggtgattgccaacaatgacttcatgataagtggaagtgcctgcaagccacatgaatatttcccacacactccagcaaaattaaatctcatctgaacttccccttaaccacatcccaaattaccagtcattccaatatacccaatgcaagagcggttatgccagaaggaaagttgggattgaaaagacagtggccttaactaatcgtaattaaaatatcttagttttacaaacttaacaaaaaatcttcaccagttgaacatattgctggggccactcctgaccctggaaggggccatgcaagtgagtggccctgacacttaaacttcattagcttcatggtacatctacctctggttcattacaagaaagaccacactttactggctcctgataattaatacaaaatgttttttaacatatactcatagtgtagccttcagtgcttagactcattccattcttttcctcctttgatctccctacctacttccttttctctcccctgggtcctactccatcctgctactgcctcttgtggtcacggtcaaagatgcccatttctgtctccattttgaaaggttactggtgaatccttatatcctcagaacagagcatatataagaaatacaaatgtttttcttgataatattgatttttctctcatagctttaagtattagtattttgatgtactgaaagacttccccctaccttgcagagaggttgagatggaaaagagaacagagccgtatcgcaagtgaaaatacataagaaagataatgggaaattccagtgcatttttaggatgaaacagaagaaatcaaagaaactccatcttagcagtgggccttttaaagctgcaacttcagatcaccagaattacccattcgttctttgccacttttctaagtggaaaaatctgagaaacactgctgtgtacatattcaattatactactaatagtattatttcctattttgccctttgcttttttttagaagagcatttcccatctctgccaaatgattttttactcaactttcaaggtctagttcaaaggttattattctatgttattctatgacacgtcctcaggacacttaaagcaaaattaattgtgtctctttcttcttttctaatggctttaacccctattttatcatttagaagatatcttacagtcaaatatttatctctcataaataaatattaggtcataatatttataaaggcgatgtctcattcttttttgtaatccaggaacctatcctgacagtgttgtgctggtaaatgtttaacagctgacttccgtggtcaggagacaactgacttggagcatcagttaatttctgtgttttaaattctcccaacgtggtagcttccaaactaccaatggagaatcactgaccacagaattggaaagagatgcatacggcacactattctggggcatttctaccagatagatatagtagatgcatgaataataataaaatgtagcaaaataattaagaagtcatgagttttcagtatttattacctttgcttttaatctacttaattgtaagtctatataattttatttatttttttatttatttgagacagagtctcgctctgtcacccaggctggagtgcagtggcatgatatcaactcactgcaacctccacctcccaggttcaagtgattcttgtgcctcagcctcccaagtagctgaggttacaggcaggtgccaccatgcccggctaatttttgtgtttttagtagagagggggtctaaccatgttgaggcgggtcacaaactcctgacctcaagatatccttccgtctcggtcactgaaagtgctgggattacaagtgttagccaccatgtctggcctgtataattttacataatggttgtgtttaataactggttcaccaaattcttgaaaatttaaccatcagttctcatagagctagtacaaaccagccccagcacagtattttacatggctccttgaaagtgaatattgacaaatcacaacagacattttcagaggattctagaaaaaattcatatttgtagtggaggaggaacactaattctgacccttaaattgatactgatgttatcctcagataatctgttgcatttatatgcagcttgctatctcttcaattcataaaaattctcaaaatgtgttgttcatagaagtaaatcacagagtaacacaaaaactgttgatcattccctgagttctttcaagcttgacattttcctttgtatagatatgaggtcaaagggagcaactatgactttccactcacagaatctgggcaaaatgatctttcatcaaggcagatgataaagagaatagatgtgacatcaagaattgttgggatttcctcggataaaaactcttatagactcattattgcaattctgccacaggtctcagattgtacttactggtcctgttggagacaattgaaacaagacaaggcaaataatacagctctagtgtgttccaagaataacagaatgacttactgttatccgtcccatgagatgaaattagatatttctgagagatttcagaataaattttattttttattctaaatgttcatacctgtaatctttgctctatcatatagtaaatatctgtctataacagacatttagaaccagataatgaaaaataattggaaattttcttttctaaaagctataacttttgaatatgattttaataaaagaattccatgtaagttttttttctattttgcagtagctaaagagaaattaattagtcatgtcatgaaccaaagttatataatatgtgtttataaaatagtactaattcaccacactaaattgactggatttcaaaacattctatcacagcccttcaggtatttagagtcaaggagaaagagagactaaaagcatcggaaaattaaggacatacaattaaatatgtttcaataaattaaggatagttgtataaattataagtacaaatttcatgtgtttcttaaaacatcacaagttgctttaatttttgagttccattaaggcattacagagcaaaaaaaaaaatgttgacttgatcagggttactctggtaattactcttatcatcttagcatttcattcgtaagaattggcctatggtagattacaaacataatagtctttaaacatgaattactaaaaactggccgggttaggaagtctgtgttaataggggaacaaaatgaatggggatgcataaaagctaactacaacatgacacacaggcttccttagaaataaataatgagctaattcaccatttctgagaagcagtagtttcatacgcagttcctggggtggatcaaaagaatcacctaaatatgagcacacatctatccatcttctaaaagaaaaggaaatgctcaactatacacaaaggctatgttaaaacaccaggcttgttctcagaaatcagatgatcttggagggacttttcattgacttttgtttggcctgtgcaggcatatttatgaattgtaagagaagctgaaatatttgaaatagagatatcaagttctcatttatttagatgaatttttagtggaccaaaaatgaaatgaaaggttttaggccaaagatattttcatatattaaacccaccaggaaatgagtactttaaatgacagtcaccccataatacaaagaaattttgtctgatttatctgaaatgctaaatcatgtactacttacagtggaaaccttctgtaaattttctataagttaatcaaatttgcatcctaagaatcacttttcattcatttaaactgtattgatcttaatctctgaaaatattctgaaatttttgaaatttatttaataattattagacaaagtaatattttcttagtgctgtgtgctgtattgtaataattgatttacctttctttcccactaaactataagttccctgaaaatagaatttcaatatcatttgactttggattttcagcatagtgcacttaaactcactatttgatgagtgaatgatttcttagagaaagatattgaattcaatttatgttacaattgttaatatgcataaaaaatatggaacaatatacgtcaatctactagcagtagttttctctaggaaatgggatggggaaggggtatcaggagtattttactttctgctttagatttgtatgattgtcttcatcacaaccttgctttactactttcataataaaaatgttgaggacataaaaaagtagcaccttaaagttagtagatgaaaaacttggcaactatccaacttcttgttaatgtttatggtaaagtcttcactaaattgtattaccagttattttattttctgaggaagaaaaattggatttgaatacttttatagtcaagaacatattatttctagttcttttctgatgttttggatttgtcttctcttcacagttgtgtgtctgtttctctttcttccagagttatcagtttccttatttagtcatcttcaccctaataagtggcaaacaagcactactgcctagattctagggaatttcactccacattttacctcatctatttagaacattatgatgttcagaatacttttgtagacactctatatgtattaacatattaatacattgtgtatatatccaacatctctaatctataaaactagaaaatggtgaatttaaatttctgtgttctttctctaactagtatcatcattatcaagttatatgtttacgacattgccggtattttccattcacaaaggcttttcccatttagatttgataaggccaggggggaaaaaaaaaagcaatgctaacagaaatggtttcgtggttaataaagctactttattagcttggaattgcatttcatggatagtagtagcaattaaccaatttatccatttacaccaaaacacttctccctgggaaatgagctacaatctccttcaatactgaaaattcccccaggtatctgagcacttcattccccacccctctcttcacggccaataaaattaccctttctttttgattaaccattatagtgtatctcacatttaacctttccttttcattcccactattactgcttaaatccaggacctgaaatacaaacgacttcaatagcttgctaaccgtgttcagtttttctttacactggggctaagttgttctaccttcctctattgccaattcacctggtagctggtttcctacttacttctaaacaaaatttgatttcccttaaaccagtgttcaaggtccctggatacctttcagcttggtctacaactgttagacattccgtttattccagtctggttggaatacttgttattattccccattgaacaacttacgctttcctttctccgcccattttcttataccatttatattaataagttgccttcagttctcctttataatctattaaaatcatattctttagacctttaaattatttagggttccatgaccttctagaagccttgctttatttccattatagctgggttctttcccctatgaatagctatttatttgaaccatcttatgacacttaccacatattttcttgtatcatcatttatgtagctctcctcccattactttctttatttcctatgtgtcaagtaatgtgctcaatgctgagggaaaagtggaaaacaaaaagcagttttctccctcttgagacagggtccatggtaatgtatattcataaatgtttaaaatacataattatatatatgtttttaattcctttttaaacttttattttaggttcaggggtacatgtgaaggtttgttatacaagtaaatttgtgtcatgaggggttgttttacatattatttcaagtattaagcctattacttgatagttatttttttctgttcctctccctcctcccacctccaccttcaagtagacaccaatgtctgttgttcccttctttgtgctcatgagttctcatcatttagctccaatttataggtgagaatatgcagtatttggttttctcttcttgcgttagtttgctaaggatgatagcttccagctccatccttgttcccacaagaaaaacacatgatcttgttcttttttatggctatatagtattccatggtgtatatgtatcacattttctttatccaatctgtcattgatggcatttaggttgattccatgtctttgccattgtgaacagtgctgcaatgaacattcacatgcatgtgtctttatgatagaatgatttctattcctatggatatcatacccagttgaatgatagatctgcttttagctctttgaggaatcaccatactgctttccacaatggttggactaatttacattagcaccaacagtgtataattgtccccttttcttggcaaccctgacagcatctgttattttttgcctttttaataatacctgttctgactggtgtaagatggtatctcattgtggttttgatttgcatttctctaatgatcagtgatactgagctttcttcatatgcctgttggccacatgtatgtcttcttttgaaaagtgtatgttcatgtcctttgcccattttttagtggggttgtttgctttcctcttgtaaatttaagttcctcatagatactgagtattagacctttgtcagatgcataatttgaatttttttctcccattctataggttgtctgttttctctgttgatagtttcttttgctgtgcagaagctcttaagtttcattagatcacatttgtcaatttttgcttttgttgagattgctgttgttgtctttgtcatgtaatctttgctatttctatgtgtagggtggtattgcctaggtggttttccagggattttatagttttgggttttacattaagtttttaattcatcttgaattgatttttgtgtatggtgtaaggaagcagtccagcttcaatcttctgcgtatggctagacatttatcccagcaccatttattgaatagggagtcttttcccaatggtatgttttggtcagcttagttaaagatcagatgatcctaggtatgtggccttatttctgggctctctattttgttccgttggtctatgtgtctgtttttataccagtaccatgctgttttgcttactgtagcctcataggcaatcccattcacaattgccacacacacacacacacacacacacacacacacacacacccctagacatacagctaaccagggaggtgaaagaactcccggggctgaagcctacttgatcatggtggattggctttttgatgtgctgttgaatatggtttgtaagtattttattgaggatttttgcatcgatgtttatcaaggatactgtgctgaagtttttcttttgttgtttctctgccaggttttggtatcaggatgatgctggcctcatagcatgagttggagaggagtccttcctcctcaatttttttgaatagtttcaatagaaatagtaccagctcttctttgtacatctggtagaatttggctgtaaatccatcaggtcctgggagtttttttgttttttgtttttttttggttggtaggctatttattactgactcaattttggagcttgttattggtctgttcagggaatttatttcatcctgattcagtcttgggaaagtatatgtgtccaggaatttatccatctcttctaggttttccagtttgtatgcaaaggtgtgtttgtagtagtttctgatggtaatttttatttctgtgaggggcagtggtaacatcccctttgtcatttctaattgtgtttatttggatcttttttcttctttattaatctaactagcggcctatatatcttattaattttttcaaaaaaccaactccatctttcgaatggtttttttgtgtcttgatatctttcagttcagctgggattttggttgtttcttgtcttctgctagctttggggttcctttgttcttgcttctctaatatttgagtcgtgatgtttgactattaatttgagatctatctaactttttgatgtgggcatttagtgctatgaatttccctcttaacactaccttacctgtgtctcagagtttctggcattttgtatctttgttctcgttagttttgaagaacttcttgatttctctgttaatttcatttttttacccaaaaatcatttaggagcatattgtttaatctgcatgtaattgcatggttttgagcaattgtcttagtcttgacttctgtttttactgcactgtggtttgagagtgtgtttggtatgattgtggttcttttgcatttactgatgattgttttatgtccaattatgtggtagattttaaagtatgtgccatgtggcgatgagaagaatgtatattttgttgtttttgggtggagagttctgtagaggtctagcaaatccatttggtccaactttgagttcaggtcccgaatatctttgttaattttctgcctcaatggtctatctaatactgtcagtggaatgttgaagtctcccattattgttgtgcgggagtctatgtctctttgtaggtttctaagaacttgtcttatgaacctaggtgctcctgtgttgggtgcatatatatttaggatagttaggtcctttaggtgaattaaaccctttaccaatatttaatgcccttatttgtgttttttagtctttgtttgtttaaagtctgttttgtctgaaattagaatcgcaacttctgcttttttctgttttccatttgcttggtagattttcttccatctctctattttgagccaatgggtgtcattatgtgtgagatgacagcgtacaattggggcttgcttttttatctggtttgccactgtgccttttaaatggggcatttagcttgtttacattcaaggttattattgatatgtttggatttggtcctgtcattgtggtgttagctggttattatgctggcttgttcgtgaagttgctttatagtgtcactgatctgtgtatttaagtgtgttttgtattagctggtaacagtctttctctatttagtgctcctttcaagatctcttgtaaggcaggtctgatggtaatgaactccctcaacatttgcttatttgaaaaagatcttatttctcctttatgtaggaagcttaatttggctggatgtgaaattttagttgaagatttttatattttttaaattattaatcagcctttaattggctaatttggaccatgccatgccttaacaatgacaaacaatatcttgtgttttttaaggatttattcattatctggtttcaggtattgtgtggtaggaagttctttagaaattaccagaccctggagggtccttgttcttacacactctagcccccatcctagttctcagtccctgcaagcttcacacacatgtgaacaaatgcagagaaaaattacttgtgacccaggtcatttacctggtctctttttctgtcttaatttccttaagctgattattgattacaaagaaaacctctggactttggaggtaggggaaatgctggccaatatttcatgaaaaccattcactgtcctctgcatcattagtagaagaaacagacatgcaatcctataagcctaccaaaggtcagattgatgaattttaggtatcctgtggcaaatggtgaaaatcagagatgacgctcacctgctccagcttgaggatatagactaagttaaaatggaataaaagataatgtgaccaaagaaaagaaagtcatttagttcatttttttgttgttcatcaattcaataaatattttttaagcaccttctatgtgccaattgctctagtagacactagagatacagtaataaaagtagtccctgatattaatccttggtgttagtaaaaagagaaagtacagggatgaaaagggaagctaatgagggaacagagaaacagagaagagaactttaacattgatctagactgtaatatgattggaagacgtagggatattcaggatataaactgaagagttccaatgggagaaccgtttatgaaatcattgttccattgcactcagtagtaccaagcagtccacaagaattgacacacatttcaaacatgacttactacaagcatggctttcaaaatggatatatgtgactcatgaagagccttgttcaatctactattgctaaactttcaattttgacatatttttcattaagaggtgctgttctgtcttgcaatactgattgaccagccgccaaaccacatgaactacatttggaccacaattggcagaatgtattctaatgtgaaagataatacagcaagtacttctttgtaattccatgttcaaaatgaaagtataaaataagcaccaaaaaaaaaatgataaattttccatttaaaatgtaccagtggatctgtgggggtctatgaaatgtcttttgctttcctatctgaaggagagctcaagttgtttatattgtgctgttacttcagcagtgagtcaggaacactttatcctcccgtggcatgaatacagggggtgattgcaggcaaaacaaccagtcagagcaattattacatgctctttggaactctgtgctgtgcctcttggtaaataggattttatgataaaagcatcaagatgtagacatgtcaccagtgatgtgaattgttgttaagtagagttataaggtacaaatgtatgtatgcccttggatgtgaatttacccccaggacaatgttttccagtgtgtggtttccaggtgacttgtatcactagaaaatttcgatttctagtctcctacagagattcttatttctcaggtctagtgtgggccctgggtgtcagcactttgaacaagtcctcagaggattctaatgcagattgaggtttgaaagctatggacctagaagaaaaagaatcacttccaatcagtcaacataactaaattgttaacagaaaactataattttatatattcagcagtataaagtatatatgatattctgaaagaatgtaaaacaaatatattatattgagagtattcataatctaccctactatgtttttaacaagtacatgctggatcttctatattcacttagaaaaagaaaatgatatacagagacctaataaagaacctggttctgaaagggaaggaaataccttttctgaaagtctctgagcatcttttctctcttctgaccttgtctgttctgaaagatgaatgtcctacaggcaatcccagggggtcttcctagactgcaattctccctgcccttaaatatgtggagttaactgaagctccagacagctcagctccagatgaatttctcaaacagttccttctgctgtcccgggacctggccagagattccatgggagatgcctttggtaaactggatatgggagatttacatagcagcatagtgggagagaggttttggcagagcctcttcaagagaagtgttgaaagaaaagctgagatttatgttacacagtatcttgacctcaagtagtgtttgctttgggttcttaggtgtgaaaggcaacttttgcatttctaaaaagaagaaacttgtaggtcttgcataccatgtttgccctaagtcagctaaaggggaaaatgcaactggacattcatacaaataaattaagaaattaatcttaaatccttttgttaaatagtcacatttggattcctttatgaagctgtcttctaaagcagagttatactgattcaataaataaatatccctatatttgatgaagcaaacttaggattcatgctaatacaaatgacagaaatccagtgtaaactgccatggcttaagccttaaagcttaagtaagttggcgaatgactggcttcaatcattgctgaattcagaggttcaagatgtcacagcattctgactttcaccatctaggtgttgagccggtgttatagaaatcggtcatttcatcactgtaagatgcctccctcagggtggcaacataatggctggtggcttcaggttctcatcctttcagcctaccagtccagaagaaagatagtttctcttttcaacagttccaacagaagttctaaataggagtcctgttggctgcatggattcaatatccacgcctgaacttatcattgtggctaggagagcagataacattgattatccaggtcatatgcccatggctagagcaaaagcagggaagatgaggtcagttatgatgaaatcacatgaatttcaaaggaaattctaaactgctgttaccagaagaacagggaataaatgtactggcaactagcatctatgtctgttacacaggtacaccataattagtaagtagtaaggaaagtagcagtgggctttttgtgcattcacctttgtgattgttgtctcctttaatctggtatggatgatcattttagccagaacacctttaaccactttttcttaccttaagacttatactatttgatgagtctgttatactttagagcaaagtgagaccaacattaagacagctcttcttgcccttggctaacagcaacagatgtaatagctttgaacattgctgtacattaatttacttggttatttctcttctgtgggaaaaaaatggatatgatgccacttgatccctcttttttcataaaagtctgatgacttggaaactgttttgtaattattttttaatccttaaattcctgggatttcggtgatagatgtcattcaaacaaactggttgttagtgaaaatactgctatctgagcacatgacccttaaaaaatgattattttctatttctccacatcgttagctcttcagattcactatgattatttaaatatatgtagagcgaaatctaattattctggtgcagaacatttttcatacatttgtttaactatttcctactctctgtctgtcttccacccccaggtctcatgctttctccctgtataattgtttgagcagctagaatgttaaaattttcacccaataattgggcctgtcaaagccttagtgattaaagtatgtcatgtttaagaaagttttagaagaaatatagtgtttctaactttaatttttaaggcttatagttacggcatattggctatgatttcttccccatggatggcaagtgatgctcctatccgtataaagttaactggtttacattatttctgagtaagtcccagcaattgttcttgtcaggctaccactggtgtatgcttttgtaagctggccttgatcccaaagagtagggctaggaatctaacatgtgtccggttccatttctcaaccctctaaactatgtaactttcttagtgctgacacactcactggcctatattatttaatcagctgatcacagaaaaaagaatttgccagatagcttccattacatatgacttttcattttagaaagtactttcacgtatattatctcacttgaatctcataacagatgaggtcctattatcttaaatttgcaggtcaagagtagaacttagggaccttaatgacttgcaccaggttacatcactaggaaatgacagagtcaggtctttgactctggactgtctgtgttctttcaatcacgccattgcctggaatccattccagcatttgcagactatgagacagagctaagcatgtgtgaaagacccactgccattgttcacatccatcaagatggctttaaggctgaagaatgtgcaggcatctcagttggaaggcatgcgagcttgatagaaattgagacactaggaagacactggaagaggaatgaaccagcagaagacattttaaaggatattaagcctactgaacaccactgcttcgacatctaaatctttgaaatattatttaaggggtactgactttgagtacaagttagttcttgtgctacctgtacacaattcaaataaaagaagtattttcgttgaatgtcatttcatttgaaatatgtttaagtttgagtactttcaagcttattcattcccagtttgctaatatgtaaatgagagtttactttttctcttaaggcctttttatatgttttcaaatttcagtaggaatttaaagcaaatctttccatatcagaaacagacacaaatcaatgctttggatcctaagagcagttatttaaagtcagttaacttattgttggaactttgaattgctaaaggaaaatattttatctaacctcatttttgtattatttctagaatgtcaataacaactgtcacaaatgatatttttgaagagctataatgtaaaatggcattaggttgtcagtttcacttaccagcaagtaagatatgacttgaattctatacggggcctagcctactgtctttcccttggtggtattatttttctcccaatttcctcacgatgttgtatttacaaagttaagtacagaaaatccaatttgagaggctggaagcagatcaaatggtttaatgagctcagttttatttatattaggtggggaaatcaaagctgagactaataatttctgtgcccataaaagaataagagacctaattaagcccacacagtgaaccaggttagagactgcttatcttccacatttcctgtgtgaaatagtcctgtcccatctcatcagctttcatgtgaatctttaccaaggaagtgcaaatagaggtatctggctgtcctgaaaggatagcagcaggtagatacagtgtgattgcacccctaaattattgtttctggtgtggcacagacaaacagtgatccttgtcctggcttttgaggaaatacctaggaagatatgaattttatttcaaaagaagagtagtgcctagataggaggtatcataatgtctgcatctagaacagctgtaacatttggaattcagatctagctgcttcctgtgagcaaagatatacatccgagaaacagccaatgactgtcagcttgtaactgattgcctacctgtaagcatgggtcagcaccatattagcgtagtcttcagtcaagaaaagcggcaatcgagagtatcaatatagtgacacagattctaaaatcatacaaacaaatgatagcgcatgcaacttgaaaactttttgaaattgaaaaaacacagtggaatacctgatatagttactaatcacagtcctccaaacaatttcattttgaactagttaaaatagcataatcattatcttttttctagctttatctgccggattcgattgtagcagattctatccagtgtatttatcaatgtaatctagaatctatgatgacagatcttcatgagtagaatttataactgagtaaacctagtatttgtgctaaatccggacttaggcttaggtccatccaactactcatcgtgtcagtggagcccaaatggtgagaccactaaatttatcatcagggagagtttagtatgaactccaaaaattctctatggctttttgctgccataaaaataggcaggaaaaaatatttcagtaaaacatttgattcagaggctcagtaggttacctactccctgtgctttaaggtttatggaaagaaaagcatctaggcaattttctaagttctagatacatttgtagtcttatttatgtaactcctgtaatcaaggctaaatgcagacagctgagagttcggtttggcctgtatttacttgaaatggctaacacccatttacaggctcataaatctttcaagtgttaccactgcgtgcatttgtggaaccccacccccattcatgaacaactaaaattgggtcacagataagcttgattacttgtggggaaacaatttggggagatgaatatgtaatttagtttcccttaatgtgagggatgaatttgttccaacaggtttacaagttacagttttagcctgcagctttctgtgttgctattttaaaatgtcatatttaaaggagacacaagagctaaaaataagtaaatttaggtgtgaagtcctagggccttggggtaggacatttgggatcctatggatctttcgataactatgaagcccacagttgtctcaggacttacttatttttgtgtgtgggttaaaacagaaatgattgatttttccccattgaagataccacagataaaaactaattatcttaatggaaacttgatgcttaaacagaaacctttctttataaacaagtgtatattgaatttttacagttaataaagctagtgcttatatattaaaaacactcttgtgattcaaaacaccataatgtgtagctaaacaatgagttttatacaagtgctatgtacttggagtaagaagattaatctgcagctattcacaaggtgagttaggggtaagataccagagcccaggtgaaaagcaaggaggtccttgttacagtataaggaagtgaggaaggtgaggtgataaagtgggaatggaaaggaaagcaaatacctgatactggagataaagttgttgctgtatattcaaatgaaaaggtatatatgtgctctctttttcttttgtttggtttttgagttagggtttcttttcctgaattgtttagttgccagaatactgggtgaaagagatttggaaattctctctagtatcaggtttggaaatacaccatatccccatccatggtttctatttcagaatggcaaaaagatcctgggccacccaagctccagggctggcttgatgggcagggaactcagggtcctagcagtgctttctcctgaagccatgagcaaggctgttggagttacatttcttttttcgaaaattcgagtggctatactgacaagagatagatgaaaaacagggagtatcactaaaacgcttctaaaatattatttttgtttatttttaggacctaaatgtaataactaatatatagtaacttgtcacctacgtgtaactgaacctcagttctctcaagttcatcttttcgtgtttttcatcttaaataaccactatgtctcaaacttgagtacacagtggaatcacttggaaaactttttaaaagtagtactaattcataggcccaatcctaaaccaatttctgcacctagggcctcggggccaagcatgagtaggttctgaaatctccccagctgattctaatgtgcggcaggattgagttcctcctctctaaacactcacacctgtaacatctgtttatctcagttgattcttggtgatcttagccatttcttccattgtatggccaccctgtctagtgttggatgactttgaggcagaggagaatgacaatgaaattgaaggtttgggcattttcgtcctaagggaagaaaggaagcatgttaataatatcctgttttagaaacacaagcagcctctgtatgcctgaatcattttagtaggttaataaaccctaaagtattgctctattaactactgtctttactctgccaacatttaggatttgaaaacattaaacccttgtttacatcctctgtaagtcagcattgatttgtttctcttctgggattcagttaaaagcagtgcttagttgcacacacattttacaaaactgaactacacaaaatgatttaaaaatacaaagtaaaattcctaatccctcaaaaatgcccctgatcgtaggcatacttcataatgaacaatccagggttccataaaaattttttttgttattaaaaaaaagttactttgttctctcagaatacaaactacagcatgagcgttctccatagggtttagaatgcggcttattgctttaatgggttaaagttaaatctttcttttcagtagaaggcatgccctttaaatttcttgccaggctaagtgacacatgagacaatttatatccactaagatttcggtaacttgatgcaatagccttggcaacaaaattctaccaaatgaaaagcatcaaattgcgcagaatggtgttcatagccagtgggtctccccatcgacttccctgggaattgtgccaaggtaaaaggctttagagtttccattggttataaacggcagctttttgagctctctttagactaggaaagttgattacctatagcaagcttctctgaccaacactggcaaccttgagaccactctgaatccatcatcacaaaagacctgccacatattaattacggtataactcctcttctgcataattctccttctctctaacatttccgtgcttttctgttctgttttctgcttactctttctcttattcacagtttcccacctcctcccccatgcagaatataacttgcataaaaatcacacaagtagtcaaggggcaaagtcaggagctaacatgttacagaagcaataatattgcctaagggcaaaaggaagatttttttttttttaggccatgtcttatctaagccagatagttgagcattttaatacaaattatcaaaatagatgcataactactacccaaaaagcatatgggatttagtataaaaatcaatgacctttgtggacatagaggttaaataacagatataattactttttaatagaaaagatcattttttctgtttgtgagacataaaggaagggcatgctgtcagataaaacaatttgtttcagctgatctcccaagagactgccacaggcaaaagacatagccggtagagtacccgtctccccacccttctgctgcacattcagaatggcagcctgggaaccaggggcatcaccaatcagcaacagtgaaaagggccgcaaaacccacacattttcatttccattgcatttattctagttaccttcactgataaacagggaggtgaaacaaagctgttttactgttgtttcactgtgatcaatccagaaactatgaatatactgttaagaataagcttggcaggtgagcttcaacacgtgaaagcatctcagttctcaacaaggcaagagtgacagacttgaagagttaggcacagtttattgctgagataataaccaagaaaatgccgtctaataatgacggtaatacttaagtgcttactactcagtgctacagtgaaattgatagtactcttattatcaccatccccattttaaaaatgagaaaactgaggtacaaaaaaattacatacaattaatacaaagtcccacagccagcaatacacagcttagctggtattgaacctgctccaaggtcagtgctttgaaccattaggccatggttctgttaagctttatgaaacttctgtgcctgacaaacaagattaaatatttgcaaatgctctaaagctgaatagcatgatgccaagaaaggaaatatgaaatatttcatttgagcaaggcataaaacaatgcctttcaaaaaaataagccaaagatcatttcactgctttattgctttgtaaatattaattaagcctccattctaaagtcctgcgatttaattatgaaataatatttttcttctatctcagtacaattccctttccctacattccaacacagtcctgaaaagtgaacaatttcaagattaaacctctattcttgatattgaattaagtacacactattaagtagacatgactttggattggtacctccttggatttcagttatggagggaaagtggaagctcttagggaggcttcatgacactttgaacatgagcattcctgaactcagaggcgacagagccatttgtgctgtgagtggattttggaggagtgccaaaaagacctggcaggtaacaaaagttggtaacactgagggcctcagttaaaatgtgtaagaaataagtaagaattaatgtcttcgtaaagataagctaacctcagcttttatactgcaacgagaataggatccgagacccacagaaccagaaattagtccttgctgtctaactaggttggtgcagtggctcacacctgtaatcccagcactttgggaagccgaggcaggcagatcacttgaggccaggagttcgagaccaaccgggctaacatggaaaaactccatctctaccaaaaatacaaaaattagccaggtgtggtggtgcatgcctgtagtcccagctactcaggaggctgaggcaggagaatctcttgaacccaggaggcagaggttgcagtgaaccaagattgtgccactgcactctagcctgggcaacagagcaaaacacagtctcaaaacacacacacacacacacacacacacacacacacacacacacacactgtctaactagaggagaggagcaatctctcagttcttcatcttctaatctataaaacaaataatggactaaacaatggttgctaacctctttgataatctaacagaaggagtccctggactcctcatcctacaggttaaaaacttgtagattaaatccctcaatctctttacaatgcctacagtggtgatttctgttcatttgcaatactgagaaggtgagatacagtgagtgtatttccttggttggcaagatggcaaggccagcccagaacattgaaagatatggaaacagcataagaaggaaagtcaaaaaggctactgggctagttaggacaggcactctggaaggagggcagtcactgaggagatggctctgctctgtgctgaaggcaaactggaatgaactgacaattttgctttcaggggagggggtgatgaagagttcagttttgttctcctgctttagtgtactatgctttatacattggtccagactatctaatcaggatctcattaagggaaagcttagcattgtttgagttctctttcacacagcagagctaaaagtaaacagcggccaaagataaacaaggagcattgctttttcctgtgttgtacaatagttaagtctaatttattgacaataattgttggtagtataaatactgaatctgagatgaactttgcaaagagcctgctggtttttaagctttaccaagccagcagactttcttttgttgctaagggaatttttttccaaatcaggatttcttaaatagcaggctttgtatgctggaagacacaagtgacccactcactactgagatccagctttttttttctttctttttttttttttttaattctttaaatcaatgaatggctgaacttcaacttttctctgctgttgtttcttataaaagaagtagataagatagatttatgagcaaagaatagagcttctgcttctgaatcctcctttggggtcgtctgagtcatggtttaggaaagaattcctaccaaaatccctgaaacaatggaccaattccactattccctcttctccctcatatccagctatccccataaacccagagagaggacctgaccccgtaggagcaaaggtgccctggattatggtcctggtttgtgaaagaaaattgcatttaccaatatctgcctcacagttctttcttgactgattgcttatttactcctggctatatttacaaaacacttcaggccgactttgatatccttaaagttggtcttgatatcttttcattttgctcttttttgtccggcccaatccacaccctgccctaagcatattttctcagtaatgacgcccatttacacatgaccagacttatgtaatttactagatctatcctagtcatgctgcactatcttgccctcctccagtttaagacatctctaccatcaaggaccagcctctttaaacacaatctgttccaggcagatttatcatgacacccaacatgtctgagccaaagtccaagtgaaaacactagactctgtttttttttttttttttttttttaggagtcttgctttgttctgtcgccaaggctggagtgcagtagtgcaatcatgtctcagtgcagccttgaactcctgaggtcagggagtcctcttgcatcagcctcttgcatagctaggactacaggtgcacctcaccatgtggctaagttttttttattttacatggagacagattttgctatgttgaccaggctagcttgaactcccaagttaagtggtccttccacctgggcttccaaaagtggtagaattacaggcatgagtcactacacctggccaaaacattagaacttttttctttagggtttttaaaaagaaatgtatcaaatgtacaattccactccacattctactccttcatattatgaaagttggtgtatattttttccatctatctttttatattcttcatgaactacataaaaaattaattgatggagcgagactccgtctcaaaaaaaaattaatttatgcagatgtacctatccttcagcaatttgcctgtttaatcaatataatgttttagatgtgattccaaatgatatgcataactttagttgactcacttaaactattactttcatgtcaaggtatgaatatgatacaatttatttctctatcagttattaatagaaatttagattttcctgaatttttcattgttataaacagtagttcaatgaacacatttccatatacatatgtgcaaagtttctctggaacatgtaactagaaatgaaattgcttgacctcatgtagatatatcttaaatattagtagacattgacaaattactctgaaaaatggttgcaacaatttaaacataaccagccatgttgaaacatatccccacagcttcaccaacacatggtgtcttgctctttcaaatagttgtccaacaattttttgtaatcggttgtttattttttcttattgatttgtagaaattttatttatttcatgaatataatcatttgtcaattaaatacattgcaaatatctgcttctagttttccttgtcttttaaattccatatatcaaatgaagtattcaagtttgatacagtcatattaaccaatattttccttaactcttgattttaaaaaaatcacctacagtatttcaatgtcatactctcttacagtgttttctaaactatttaaagttttattttttacacttagatattctattcatctggaatgtattttgtgaatggtgtcaaagagggatctactttttaaaaataataaccaattgtctcaagagcatttattaagtaatatctttccccatttacttgtcatatactaaaattactattcacatgtgggtaagctctctcttctgttccatttgattatccctgcaccaacaccatactcttttaattgttgtatgatatttctcctttaatctgctaatgatgagattatattgatagatattcaaatattaaagtctttgaaatgcttagataaaccctttattttagtccactcttggattcaaattattatacttaattcagtttttgcatgtatattctaagtaaagcaggtttataatgattctttctcatatgtttttggtattttggtatctaaattatgataacataaaaaatgaagtggagagaaatggtacagtttttttaagatggagttctttgtgtgtaaagatttgtttaacttttgctcgtaaaactttattgattttagaggtgtagggtgaattttgactctaatttcttcaataatttttggtctagccatgttttctatttttattgagtcacttttgagagttctttttatgtttcatcttgtataaaatttaaattttatgatcatgtgtagacctttttatacttaacacaatggaaatgttcatatttattttttccccaaaggaaaaatttctgaatcatcactatgttgcacagtagaataggaattcaggtacttagtcaagttaagaatgcaaataacagacaagattaacttctaaagtctgaagtcatcaacatgattttgtagtactctgtctcaggctttacctaaaaattcattattattcagataaagataccccctaattacatgtttttgaaaagcctctgccccaccacaatttcctgagatctgtgaagaaactgcagtcttgtgatcagagtccatatagtactggcagttttgtaatcaaaggaaaaaacgtcgactgattttatatgtcaatcagttgtagtctgctgatctgattagaaaccttgacaaatgcctggtggcgattgcaaataactgccaatcatatagggatgatacagtagctcagtgttttgggatcagctcttgtacacaagtaaaagaacagaaacatctgtaagtaaggtattagaaaaataattgtccacaaccaaaaaggcaagaagagtaatcgagatttccaggagtgtgtccatgtggttccttcaaggggctcctcaggttgctgttgaatgtgttccaaggccagcctgttgtaagtctcattgatttcaaacatagtaaaatgctgctgcacttgctaacagatacaatcccactccaatctatctcatccgctgacggaagttcatcattctgcatgctctgtgccatggtcccgaaaaccttcctgttcccatggccagcattaaagagtcactcaactctgaataatctggtggctttggcatttcagagaaagccaccataaagtaaatcccctgggtcaccaggctgggagaaaggtctggagcaccagctactagtgattaagaaccttgtgactgtggcaggtcacaccccactcctgagagttctttttagaaaatagtttataatctaagtattcaaatatgttagcataagatgagtcatattattttctgatacctgaggttatgtctcattgtttttgtgccttccttcttcttatgatcaataatgccaaagattgttagtatcttttcaaagaattagctctttaaacacttatatttcatttatgtgatcaataaattttattaactgctatataccagactgttctaactaattgggtttctttttaaaaagtaaagagtaaactaatcctagatccctgcgcttgcggattttatgaggcagagataagttgttcaaaaaagaaaaaataattaattacgtgatatattaacaagataataaatgctatgaaaaaataaagcagagtgaggagaatcagaagtgccacatgttgggagcagcatgcgggctgcaattttaaagaaggtgggcagaaatattattgagaagatgagatttgagcaaagatttaagggaggcaggaaagttagccatgtgagcatcccggaagtaatattcctggtggagggaacagccagtgcaaaggccctaaggcgggagcaagctgggcatgtctggggattgcaaagaggccagtgtggctccaatagagtgaatgagagggagaagagagaagtcagaatagataaggatagtgagtctgagtttaagaaggctgtgggaggaatgacataatctgatttatagttttaaatataaacggaagcagagtagaaaagttatgatgctattgtgatgtaaaggcaaaaaatgataggcgtttggattaaggtggtaacaactgacatgtaatggtgaatttagagtcgtctatctctgctaccttcatttgtctttatttcaccaatattggcttatatcattagtattgtcttcctactttctatagttgagtcattaaccaccttgtcttatctgttttgttctgctaattataattatatatatattttactaagtctcttaattatataatttattctttctttgccttactaagtttttgtttttctcaacttaatctgtcagtttctgaaagaaacaaaatctcccattatggttttggatttgtaaatgttactttatattagtgtttgaattatatattttgaggctgttttctcttagatgcatatagatccacattgttatatcttccaggggaaatcattttttgagcctttttaaatctctatgaatgttttaaagacttactttgtatatgatttcctattagtattagtaccccagctttctgttctgctgtggcatttcctggccatttacttcagacttcaagcgtcattcgttattttaggtaaatcttatatagcacagatctggatttgtttatatcaaatctagagccctgttagttagtgggttttatacatttacagttattttgattgctaataaactttgagttatttctactatcttactttgtgttttctatgaactgagctttttgttaacttccttttttactttccttccattgatgtgattaaacactccactttttgtttactaatttgtatggtttttaaaatacatatacttaaaaacattttaagttaataatgtctttaacttgttcttgaatgatacaaggacctttatttccttgtgtggcttataatttttttattataagcatggctagagttttctataggaattccttgtgccctttgacggggtcctacatgatttaaagattccagaccagttttatgttactttctcagcttcatgttcctgatctctgtgaatagtgtgaatttggatgtcacatgtacatgggacaaggtttgcagttcaagtttctgactgttaactatttgccagtctcccagggcagtgagcaaagatttttctgattccctgttcatgattttggcagccattcatggctcctaggtctctgcatgtaattcagtcctggcaatgtgcaaacagggccctgacacctcctcacaggcattaaactttgcccttcccagttctgattctctgtgagccgcaggacttcagtcctattacccagtgtgacattttgttgtggctttatttttggcacatgaggatttatgattccaaattttgagttacactataaattccaaattgtattattcttatttattttttaagcagtttatttgttttgagcagggatgggggattcttacacatcagtactgtcaaccatattgacttgaagttcatctttcacatttttacatttaacagatattcaaatcttagtgattttttatattctgaatactgcattattcagagacattgttcatttaacatttctttttctcttatttaaagtcaccaaatattttgatttctttatgtaagagaaatgaagcatgcagaaattcctaaccaactacagttttgtgataacccgattttttctatagatactaaattttaaaaaatttaaagtttgtatttaatgtgattgctttctgtcctccaaatcttccaaaatatagctggaagaccaaatctagtataggcggggaggttacctaagcattttgctgaggcttgtgaaaaccagctatggttagtctaactacaaatgcattacatttaattttaataaggtttggtttacaaactttaagcaggttaaagtctacataacacagaactcatggaaaaatctgcctcactggttagactgaacaaagtttccttaaaatttgaagagagattcaagaagggtaatatgtcatggtagattattaacattaataattctgttttattttagaaaagaatgtgtttttagaagttttattcttaagtactacatcctcctaaagtcatccttccatataaatgttttgagagcttggcctaattccttatcacaagaaagtcagggcgtacagtgtcctcaccagtatctccatggaaacttgtgcttcgaatttctgctttccctgtattatctctctccactcttgattctagcttctttcaggtgttttcttctctctgtctcttatccacacagacatgaaggacagactccttttgtttttttgcatcctgccaaattctaaaagtacaagtcagagtgacaagcagacaaaacagcataatgggtgttttggtggacatcctctttatccccctgttatgttgccaaggctggagtgcagtagcatgatcatagcgcactgcagcctcaaactcccaggtgcaagcggtcctcccccttcagccttcccagtaggtaggactacaggcatgctaattttgttatttttttgtagagacagggtcttactcttttgaccaggctattctccaactcctggcctcaagcaatcctcccaaagtactgggatttcagatgtgagccgctgcatccagactaacatccttatttttaaagcttcctctgtcatctgtaacacagggacttttgcaatggctctgtttctccttccagccctatacttcttccaccatccagcctgccaccatatgttgtatgccatcaacccttttttatgtccttaattctcactgcctccctcttgagctgcctctggaaagaaaccaaattttcctcactttctgttgaaaagcaaatccatcttcccttggtgtcaccttgtctttgtcttgaggcccattcacttacttcccaatggactattaaggagttttgctgaacaaattatttccccaagaagaattctgtttataagattttaagataacattttcctcttccccaatatattttttagaatgatttttcaactctttgcttaaccccaattttctgaaatgctttgatattactaacttaggttttattagataatgaaaatttcaagaatgtaattcttgtgaatggcaaactattagtttatatttataatatttactaggctaatttagttagagcaaaaggaatctaaaaatatcttgaattgagaaaccaatgtagcttggatatgaatgatatagatgaaatcatgtatctgcctgcctagtttcaaatcttcctctatcacttactagctggtgtgaccttagacaagttatttaacccctctgttctttggtttcctcatctataacatcgaataataataataacaataataatctctatctcatatggatgttgtaagtaataaatgagtgtgtatatatatatatatattatatatatatatatatatatcttacaacaatgcctagcacctggtaggcactatatacatgtgtcagctaagatttccttacttacacacagaatctcaagaacaaaaatatgagataaaggaagcttgacagatgagggttttagattaagtattgtagatatgtgatgttaaaaatatacttaatgaagaaatcattatgtttaaatgtattctaatatacactaaatgaattcacaatatacttcacataaggaggtaaggcatgtatccttaaacagctcttggtatttttttctggctccttagaaaatctggtaacagtaacttaactcatttcaagagctatgttaaagctgggtatggtggttcacacctgtaatcccaacactttggaaggttgaggcaggaggattgcttgaagccagaagttctagaccaacctgggcaacaaagcaagagcctggtgggcggatcactaggtcaggagatcgagaccatcctggctaacacggtgaaaccctgtctctactaaaaatacaaaaaaaaattagccgggcgtggtggcgggcacctgtagtcccagctacttgggaggctgaggcaggagaatggcgtgaacccgggaggcggagcttgcagtgagctgagatcgcgccactgcactctagcctgggcgacaaagcgagactccgtcttaaaaaaaaaaaaaaaacggccaggcctgcgggtgagcgcctgtagtcctagttgctagagaggctgaggcaggatcacttgagcccaggagttggagtctgaagtgacctatgattgttcaactgcactcaaacatggacgacagagcgagaccctgtctcaaaaactatatatattattaattgtttttaaaaggaactatgttaaagtagtgattacccaggggattcacaatgcccgtgaagcacattcttatacctcagattaagaatccctggcttaagagtttctggcaggaaattaaatgcaagaaaataaaaataaaatatttttaaatgttaaagattatacaacttagatgacctttttgttgccagggactctgatggatctgaaatactaccctacttgctagctaataagttagcctgccacagtttcatggatactgacagatatgaacattctgggtcagagacaaagcaattttatcattcatggcatagcaagcagcactgctccatgttcgtatcagttctccttgccccaaagacccaggcaggcaacacaaaggagcccaggtgattgctgtgcatgcagtggacttgcatcacagctgaggatatccaagtttaggaaagcccaatcttttataacaggtacaagcaaacatgccttatcttttcagtagaaggacacgtcttttttgtactagacagtaagcaaatctgctgtctgctgtagaggaaagcaactgtgtctgtcctccaaagtggatcatatattcttaaaaaaaaatagtccagaatgaaagctgtcagtgcctttgcttgcaagccatgcagaaacaaagaaaaagagttgtcttccaatgtttgtcccatcaagtcaggaagggaaaatattatcatatattagttaggagaggggggataaagttagttatgtggatggaaagataactaataatctcttcactgtaatcaggaataagaaaagaacaaggtatatgtaatgtttgccttcaaggagctaacagtctggtgatagtgacaggctttaaacagataagccataaaaagattatttgcaatttagataagtttcaccagaagaaatgaagatttatgaaattatatattcgagggacttgatctagtttatgatatcaaagaaagtgtccctgaggaagtaacatttgaaaacaaggcctaacagacagagtaaagttgagcatctctaatcctaaaacccaaatactacaaaatccaaagctttttgaccaccaacatgacatcacaagtggaaaattccacacttgacctcatgtgataggccacagtcaaaatgcagtcaaactttgtttcatgcacacaattattaaaattattgtccaaaaattattgtatgtgtataaggtatacatgaaacataaatgaattttgtgtttagacttaggttccatccctatgatatctcattatatgtatgcagatattccaaaatctgaaaaaaatccaaggtctaaaacattttgggtcccaagcatttcagatacttcacctgtggtaggaattgtcaggtgaagagtagggaaaacaatattctgggtagaaggaagaccctattgaatgaaggaaccctgtattattagagaaactacaagaaagcgaggattactagagcagtgtaagataagcaggagccagattgggttttggacttgattctgatggcaatgcaaaggcagtgaagggttaagaaagagaatcacctcattatattagcattttaaaatgcccctccattgttgtatgagggatttgttgtaggggaagggtgaatgcagaccttagagttaagagcttgttgctacaagcccagcaagagttgatagtgctctggctacagacagtggcagtgtagatgaagagaaatgaatggattcaaaaaatatgtttataaagtgtagttgtcagacctgggtgattgatttcatctagagggagaaaaagaaggtcgtggatgattctcagatttctggcatgggcaactgtgcaggcagagtgcctagaaagaattaactagcctcttggggatttatctcataaattcacttctatttcagtgacagcaagcatcttaaatatatacacacagggaacctgattctctccagagccctaagaactaactttggtacagataaaagatgagctgtagggaattgagatgtcacactcacctcaatatacaggtagtttttacttgaattcattgaagaaagaataccattgtgctatcagttggttaaaaattgcacctcaaattttcctaccagtatgatcccttttaagctgtataatttacactggggtgtgatgccatcattaatgctccccatgttgattctaatgaggagtatgtccttttctcattctgagaaaagtatgctcttactacccacagatattctgaatatatagttgatattcaaccatatcaaatattgaacctggtgcttccaatatataagttattccttaggattaagaaactactgaaagcatttccttggagtatttaaaacgcagctgacaaaaatccaactcaagctagcataagaaaatgtgtagctcatataagtaaaaactttcagatcagggtaggactcaggcagccatagatacccaagatgttttcacgctgttgtcctgctccatgacttcctttctggagtcctttgttaccttcgttatcggttaggctttcttcatgaagtacaaaaggaagtcactggtagctccaggcctacacggtccatctgatttcccagtggaaaagtgtcttgcttcctgaccatgaaaacagggaagactgtttgagtcatgtattcacctctgaaccaaagctctgattgtccaagttgggtcacttgcttgccttggccaggctaactggaatcatatttggttctggttctaatctgttctccacaagaagaggggattttatcccagaacatggggaaataaagatggatgggcatgcaaacaaacaaataataaatgtccacttccgataagtaaattgggaaagagctgaaacatcacagaatgatttcagtacaggccagtgtagaattgcagacgtggaaggttaaaacaaggtacattgatataagatgaaggaaagataatgatgcagtaatatacattaaaagatggaaggactgtagtatgttgcctgtgaatcagcaggtgtcaagttttgaaaacaaagatgtacaaggatgaataaaaagtatgtctagaatatgggagtggtggtttaatttggctattttactactcttaaattagatctttgtatctgaggtggaactcctcagctaaagaaaaatgaaaacaattggaaagagccagaagagacctatgaagatgagtaatgggtagaaaataaaatttaaaaatcaataaatatatatgtagtgttttgtccatgcaaaataaagccctttgaggaggataaaatgtagaaaattattgtaatagcaaaagagaaatataatgcttttacatatatggtttcaattcagaaaaaaatgcagctatttttctctttgcatccatactcaaaataaaacagaataaaagaagttcaagcaggtgcacgaaatatttatatgagagataaatatttttaacttggaattaataactgttagaatgaatttcaagccttctctgagatcttttaaaatagagttccttctcatatgtttgggctgtggggcactgtactgctcaaaggtaaagtgaccagttagacgactatatgcttcatgaggacaggaatcctgtgttgggtgaattcacatctgataggctggagcataatggtctctaaaatatttgctaagtatgtgttgatgttaatttgcatttcacttagttgttaattatatatgtttggaatctgctttatggatctgcttaacaaatattacgtttatattaggtggtatcatcatacatacatggcatcatacatagactgccaactttctagctgctgtgttttcagtgaatagaagctagatgtgctaagtaaaagatgatgacaacaagatactgatagaatttccagttatctgcaattttggatcatctgatccattatctccatctattatcaactaagcattcatttgaagagtaattatggaagatgaggtttgttaatattataagttatactgaatacaaaggacaacggtcataacacctttatgaatagactcaatattgcatccaggtcatcatggaattgagcaatagaatttaggttcagtaaagaaacttaaggaccatcttctacccaatcttctcttcttctctagttatctcattatttaagtgatgatgtgattgaaacctaactatgttaagagacttgcccaattacactgttggtgggagtgtaaattagttcaaccattgtggaagacagtgtggcaattcctcaaggatctagaactagaaataccgtttgacccagcaatcccattattgggtatatacctaaaggattataaatcattctactataaagacacatgcacacatatgtttattgcagcactattcacaatagcaaagacttggaaccaacccaaatgtccatcagtgatagactggataaagaaatgtggcacatatacaccatggaatactatgcagccataaaaaaggatgagttcatgtcctttgcagggacatggatgaagctggaaactatcattctcagcaaactaatacaggaacagaaaaccaaacaccacatgttctcactcataagtgggagttgaacaatgagaacacatggacacagggaggggaacatcacacactggggcccatcgaggggtggggagctaggggagggatagcattaggagaaatacctaatgtagatgacgggttgatgggtgcagtaaaccaccatggcacatgtatacctatgtaacaaaaccgcaggttctgcacatgtaccccagaacctaaagtataattaaaaaaaaaaaaagagagagagagagacttgcgcaatttgaaataacctctttatggcagaaactgaaccaaaacctacttgaaagaatttcaatttcctgaagctagatgagagttttccaaggcctagcttaacatcaatattaatttcaattggtcaatataatctctaccttcatatcatcttgagactcaattggttggccattttcatgatgctttaagaacaaactcaacacagacattaaacacatgcatattatgttagtttttccttatctatatttaaggaaagtattatatttgaggagaacttaggggatgtggctaaaattagccctccactaggaagtatttttgagtgtgaagaaatgtggaagttatttaactgttttacagatgttttaaacttgaggctcttagttttattgatttactgtgatctaattaatccattcaccactgaccaaggaagtcatagtgattcagttcaaaaatctccccaagccctgcctgaacttctctgaaatcagtagagtagttaatacatgatgaaaagattgtggtttgctacagaaaattatctttatcttaaataataaaaacaatcaaggtgtcataatggtgggagtcaccagcaatggtaatgaattataataaatatcacagtacagttgatatattaaaaacaacagctttcttacagccaccaagtaaactgttttatatcatttacagctaggccagagttgtcccttggacataaggagacatgcctaccttggatgttcaaacaaatgttatattgcctaagcaggatatgttcaaggttttagccaatcacattgcagacagctatctttaaatattaaaggttatttcaaattgcacaagtctctctcttttttttttattatactttaagttctgggatacatgtgcacaacctgcaggtttgttacataggtgtacacgtgccatggtggtttgctgcacccatcaaattaaccatcaggataatttaatctgaattgagtttcagtattagaaaatagagcagccttttaaaaataatgccctccacattagcaaacaatctctgtcctgtttcctttatgcagttataaaattatggatgtcaggattttaacaaacttgtgcttgtagacccataaatgggaggcaccctagaaagcagcctccatgacagtttcacatgtgattcagagtgctgaaagggttcactgtttggcttcaactctttattgagatccttaaaacttaatttctgggtgttttttttttccttcacaagagaacaaacaagctatatttcgagccagtagtaaccccaagcatttttattaatgtttgctcagcaacagtctgagctttgtatggttgctttatccccagttcactgtgtatcagcaatttcctgttcaccatctgggaaagtcagatgtaactcttatgagaagaggcaccaacgtttcctctgtacttcattatttcagatgtaatcaaaggagtaaatctacagtgtgttcttggctgtaatacagtggagttgtccattgtctggatacaaatccatttgtgttcatcttctaaaggaaactcttttccagatacagttctgttaaatactatatcaatacttaatgcttaaggtttgtcaggttcaagctgataaaccctacttttaaaaaacctaatattcttatatcttgatggtgatactcttcggggctctagaggttcttgctaccacttttgtaaggagacattgctcagtgcccagccccagcagcctttttgttcagagaagcagtgtgcacagtggttagagcacagactcgggagccagaccaatgcttgggttcaaactctggttctgcctcctcctaggatttaaccttgagaagttaaataagctctctgtgcctcagttcctccatttataaaatggggattataattctagtaattacctcttaggattattgtgaggattaaataagttattctaagtgattactgaaaagagtgcttagcacttagtgggcaatacttaaaggttagatatttgtatagctgctcttatctcaaggatttgcatttgctgtctcttctatctaggatgttctttcagactccacatggtatgccctctccaaatgtcactcctcaaataggcctttcctggtcatctttttcactgttcctatttgctgctttattttttttaaaaccttgaccaccatccaatattatattttatatttattttatattttgaactccctgtttcttcaaaaagaaagcaatctgagtgaggtcttttgtataagactgtatacttggagtctagaacagtgtctggaatgtgtataggagatactcaacaaatatttggagaatgaatgaagaaattattatagaaagatatttatattagaatgcatttctgtagatgcatgaatctctctatcagaactctccagagcacaaaataatcacaattactacaagataaattagatcttggtttaggctgtgcttgcactgaattgaacactaagctcatatgaaacacttaagattgtctgcagtgattcacaacataagcctgatattttagtttgacttctcaaagtcagttatattttcagtataaatgaagtaaaacatacacttgaaactgaaaaaaatagtacaagtttaaagatttaagacagttctctacacacaaaaatgataatactttctatcactggtcaagaaaaagtcacttttttaagtagtaatcacttgtgtgcatttttttcagtattgctattaaaagaactttctcattttcaattttgaatcattcaacaatgaaatgttagagctgttgccttgctttaccacataccacagggtaaaatagccaaaggttgtttaagtgggttaagtaaaaatggagaatgtcagtaaaatggaagacctcctaacccacagcagaattgcacttgctttgatactgttatttcaataatgtcaaacaaaaatgaattgactttgccttttgaaattttatttaggtacacgctgtcagtactttaaagataaaagaataaatgtttcttctttcttgaacccttgttatgtaccagtatgcttagcattgagctggatacaaaaatgcataaagttctgttcttgaaaagtttatagtctgtttagagcaacaagacaaaaaacctgtaagaaatcagtacatatcagtaaatcattagtttctaaagaaattcagatgtaggaagattattgtgggtggttgagaacacaagaagagagtgatgctttgccaagcattaaaggatgaaaagcattttattaggtaatttggaaggagaagagaacattccatgcatgaaacacagcctgagcaaagataaaaatgagcaaattataccagacattcaaaaagaagaattggcaccattactgttgacactattccacaagatagagaaagagggaatcctccctaaatcattctatgaagccagtgtcaccctgataccaagaccaggaaaggacataaccaaaaaagaagactacggaccaatatccctgatgaacatacatgcaaaaatcctcaacaaaatactggctaacggaatccaacaacatatcaaaaatataatccaccatgatcaagtaggtttcataccaggcatgcagggatggtttaacatatgcaagtcaataaatgtggtatgccacataagcagaattaaaaacaaaaatcacatgatcccctcaacagatgcagaaaaagcatttgacaaaatccagcattcctttatgattaaaactctcagcaaaattggcatacaagggacatacctcaaggtaataaaagccatctatgacaaacccacagccaacataacactgaatggggaaaagttgagaactgcaataagacaaggacgcccactctcactacttttcttcaacttagtactggaagtcctagccagagcaatcagacaagagaaagaaataagggcatccaaatcagtaaagaggaggtcaaactgttgctgtttactgattatatgattgtttacctagaaaaccctaaagactcctccagaaagtttctagaaccgataaaagaattcagcaaagtttctggatacaaaattaatgtacacaaatcagtagctcttctatacaccaacagcgaccaagctgagaatcaagtcaagaactcaacacctcttataatagctgcaaaaaaataaaatacttaggaatacactaaggaggtgaaagacctctagaaggaaaactacaaaacactgctgaaagaaatcatagacaacacaaacaaatggaaacgcatcccatgctcatggatgggtagaataaatgttgtgaaaatgaccatattgccaaaagcaatctataaattcaccacaattcccaacaaaatatcatcatcattcttcacagaactagaaaaaacaatcctaaaattcatatggaatcaaaaaagagcctgcagagccaaagcaagactaagcaaaaagaacaaatctggaggcatcacattacctgatttcaagctatgatataaggccattgtcaccaaaacagcatgatactggtataaaaataggcacatagaccaatggaacagaatagagaacctagaaataaagtcaaatacagccaactgatctgtgacaaagcaagcaaaaacataaagtgaggaaagataccctattcaacaaatggtgctgggataattggcaagtcacatgtaggaggatgaaacaggatcctcatctctcaccttatatagaaataaactcaagatgggttaaggacttaaatgtaagacttgaaactataaaaattctagaagataactaacgttggaaaaccccttctacgcattggctcaggcaaggatttcatgaccaagaaccaaaagcaaatgcagtaagaacaaagacgaacagctgggacttaattaaactaaagagcttttgcatggcagaaggaacaatcagtggagtaaacagacatcccacagagtgggagaaaatcttcaccatctatacatctcaccaaggactaatatccaaaatctacaacaaactcaaacaaattagcaagaaaagacaaacaatcccatccaaaagtgggctaaggacatgaatagacaattctcaaaagaagatatacaagtggccaacaaacatatgaaaaaatgctcagcatcactaatgatccgggaaatgcaaaccaaaaccacaatgcaataccaccttactcctagaagaatggccatgatcaaaaagtcaaaaaataatagataccggcgtggatgcagtgaacaggaacacttctaaactactggtgggaatgtaaactagtacaaccactatgaaaaacaatgtggtgactattgtagaataaaatagtactgatctgggagttcaaagatctgaatttgcgctctagttgccacgcctagtaactgtgaacaaatttcttagtcaaacagttcccttattgttataaaaaagataatatcctttatttttccataatttttctctttacatgtatgtattagagttctctagagggagggacagaactgtgaggatagatgtgtgtataaagagaagtttgttaaggagtattaactcacatgttcacaagatgaggtcccacaataggctgtatgcaagctgaggagcaacgaagccagtccaagtcccaaagctgaagaacttggagtctgatgtttgaagataggaagcatccagcatgggagaaagatgtaggctcggaggctaagccagtctcatctttccatgttcttctgcctgcttttattctggctatgctggcagctgattagattgtgcccacccagatgaaggttagggtctgcctttcccagtccactgactcaaatgttgatctcctttggcaacaccctcacagacacacccaataacaatactttgatccttcaaacaagttgacactcagtattaaccatcacagtgtgactaatgtgttaggattcatgaggtctaatcataaagtgatactattttgtcactggttgtttctttataatttattcaatgaaagaagtcttctgccactgaataaaaccttagaaaacttcttgaaacctctaataattctttggaaatagaaagccttgtgattactgtaaatcacaaagatagtcttgacgcaattatttaaaaatctagtcccatgggattgtcaaagtagctaactttatttagttaaaactactatccttccaacagcaaggacttactaaggcataaagtttatgaatagggaagagcgtgtggttagcctctttttccctgcctctttacacttctgctaattaatctttatttctgtctcttctgggttggaacatggggaggaagaatatggaagagaggcaggaaaatactggcacatttatttgattggtactgtcataagttggctgccatcctctggacagttgcttatgatttgcacaatctctagcaactcagtaccttctgcctgtctctgctgaggcctaatggcccttccagaaggttctatcagacaagaactaggatcatattattctagctttctcttgtgcaatgtaccagataaatctgtgcaacactttggcccaataaacttttgaagtgcaagtttacccaacctaaccacctctttttctagcctgctgctagagtagcaagccagcctctctctcacactggagattttccaaagagggtcaaaaccagaactcttcatcccttcccctcagctccaggggacacacagttacttctacatagcacaattgtaggtatcttgttctctctttttcctatacaagtgcatgccaaaaaaataaataaataaaactaatcctttccttttctaaactttctttctctctttctgactttctttctctctttcctttgacatgtaaagatatctagcctgttctcagccacgtagtttcacaagttgctctgatgctttctgtcttccagcttacttcgatacctgatgccttaggttcttgatcaaaacttccagtttaacagcaagatctatcaatttttgtaaagtgacttaaataaatgaaagtcgcaaaaaagatacagctttttttgcatcttcagtagttaggcaacactaacagaagtttatttgactctagttactttgcctacaattccattaagtcacctgtagatgggtgatggtgaccggattataaccaatttatctaaaaacccaggcctattggtgtgactttcatattgcagcctatatttatcatgcattctgcttttccttaaaaaaaaaaaataaaccaagaccactgaactgaaccaattgataattatccatgttaacaaaatatatcttaaaaagtgatatggtttaaagatttaagaataatttctaggtaaactagtaaacctttctcctttaccctagagtttatgtgacacagcactggtttattctcataaagcttgtgtttgtttatggatttgtcactggtttatccccataaattcacatgtttgtttatggatttgtcaggccaagtctctgtttaaatgcattgtctgatgatccaggatgtctacttcattcttttgaaatagttaagtctaggctcagtggaccttacagttaggataacagcagattatttcagcattttaaaaaaagtcttaaaactttccatatggtgatctacttggaacaagttagcccatttggaataaatgattaaatacttaactaaatacacgaattttacactaaatggccatacctggacacttgttgccctttatattaattcaaaatcaagacaaatattatcactcaatgtaattctggatagcttgtgtttaggcaaacactgggatttaagggatgactataaccaaatgaaatgaattttcataagaaaaatggcaatctcagacaaatataaagctcacataaccagtgtatcttgattatttttgaagggggagtgctttagatgaaagaaacaaactggttgtaagcaagaatgacaatacagtgctacgggttccacagggccaactttagggcttgagcatccttagattttggtatctgcaggaggccctggaatcaatgcaccacaaatactgagggacaactgtatgtgaggtttggaaacacctcataaaaatttacagacttatcagttatctaatgcaactgttcctctgacatgagtcatgtgcgggcctgccagggagaattccagatgtcctcctccagatcctgctggtaaggaattagaaaaataattaactataccaatctgggtacttgtgctgacactaagggtctacattttttggaaataaagcattaggactcttttccagttggataaggtattccttgggtggtatcttgacatttgaggactagcattaatttgcttgaaacaacagcatgttaataagaacactgcaatattaattcagtatatcttttcccgttgttctgaaagagacatcagcggtctagctccctgatttggtagtaggaaatctcaaatctcagtttggcttctaaatagtgtactttgtgcctctgaccctttcatataaaattaacaattctcagcacttcacaatgtccttatcctattttatttttccatcatggcattgttgatatcattatcaatatcaggtatagtatgtatttatttgtatgcattttcatattttctgtatttcaggtatctgtgttggattctggcttgggtttaaaagacagttttttgttttttaaaaaagtctttctaataacttagctctgaacaaggttagactaaaaagaatttgggaggctgaggtaggaggattgcttgaacccaggagttcaagaccacccttggcaacatagagagaccctggctctacaaaataaattaaaaattagccaggcatggtggtgtgtgcctgtggttccaggtactcaggagctgaggtgggaggattgcttgagcccagaaggttgaggctgcagtgagatgcagttgtactgctgcattccagcctgggtgatggagtgagaccctgtcttgaaaaataaaattaaatatttcaaaaggatccagacaaagtgatatccactagaatgtaagctccaggagggcaaggactttttgcagctgcggttgttcacttctctaaccctggagcctcgaacattttctgacctatagccaatgctcaatagtcaggaaggaatggagattaaaattaatgcttgtcttatggatttcttgtgaagattaaactaaagattgcatataaacttagcacaacatgagatacagaatccaaaaaccctaaaaggctccttatggcacccagacttttaaatgtatgaatttcatcccataaactgaagatactgattatatgcatgttttaaatatattcaacttctaaatattatacaggaagtccctgattcacaataattcaactaaacagttttccaactttagaatgatacaaaagcaatatatattcagtagaaactgtactttgagtacccatacaatcattctttcactttcagtatagtatttaataaattacatgagatataaaacactttattattaaatacgcttgtgttagattactttgttcaactgtaggctaacgtaagttttctgagcatatttaaggtaggctaggctaagctataatgttcagtaggttaggggtattaaatgcattttgacttaggatttttttttttttttttttttttttttgaggaagagtctcactctgtcgcccaggctggagtgcagtggcgcgatctcggctcactgcaagcaccacctgccgggttcatgccattctcctgcctcagcctcccgagtagctggaaccacaggtgcccgccaccatgcccagctaatttttttgtatttttagtagagatggggtttcacgacgttagccaggatggtcttgatctacttaggatatttttgacttaaaatggggttacatcccaatgagcatctatatttggcatccttgtttatgtaagtggacttttttacaatgatgagaacctcactctgatgtcattaacaattcaccttatgtttgctatataaaaacttctttcatataaaaggtggaagaatatcctgtttacgatattcattttagctaaccatagactgaagaccacttgtgactttatttgatctgtattttggcactatttatttaataattattacagccaaaactagagaacaaacttattggtttttcttttttaaaattaatctccttttctttttcttttcaatagttaatctagaggcagtgctccactttgaactttaagcaaatataagccttaacattagggtctctgcagtgagtttttataaggattgaagaaagggagctacaagaaataagacatcaaatcttaggttgtgtgatagcctgataccttccatgttttcttgaacatttcttctaaaaaaaaaaaaaagtgtattttagaatctaactttccaaaattgctttgtagtagcatttactgaatggattgtagtgttttgttaatagcactgttttgttgatagcactgaaaaaaatgaaaacctctgcatatttctttttttttttttttgacagaattttgctctgtcgcccaggctggagtgcagtggcacagtgatctcagctcactgcagcctccacctcccgggctcaaatgattatcgtgcctcagcctcccgagtagctggtattacaggcccccaccaccacgcctggctaatttttggatttttagtagagacaggtctcaccaccttggtcaggctggtctcgaattcctgacctcaggtgatccacccgccttggcctcccaaagtgctgggattacaagtgtgagccaccacgcccagcctagacctagcattttaagtatcctgaggcttgttaaagatgtctatgtcacagtccagttgtagtttaagagaaacttttctgtatcaataaagggcaaatttagattaaaaaagtcagggaataaacagtatcaaaggcctctcctccccccagaaacatgcttctatagtattcttcagtttgctgatctactcaatattaatgctttcttcagctgttaagttttgattcattgcaggctaataaaggaaagtggaatttttcagggcgtggtgaattattttacctctactacacttcctaaggcccctccactcagctttgatcttatggttcattccttgtcattttcattgggttgaagggacctccaaagggaacattggtttaatcactgcttccttcctaatgtagctctgattgctaaactgtctggggttcttttgaaatccttatattacagctctcttgggctttcctctgcaatcacccttcacacagtctttattggaggggttacaaaatgatatatgtcactcagtctctctaggccctttttctaaaattagtaaaatgcacagtccttgtatctttggaccctcaagcctttattttaattctatgtgtttattaattgtggtccctacccctcagaatcagagcacatatacaaatccttgaccttgaaagttttatggccccagagaaacaaagattaatcataattgttatcttcctgaaaatctcaagccctgcttccctttttaagtgcacagatgattcctgaaccaacaggaaacaaagttgagaaatttttgagcgtttcttttctttgccattgtccagaaagagaatatagttctcccaagactgtccaattcattttcatattgttaaagtaacaaatgtccttcttgattctaatctcatctcgttcttggcaaataagatttcactgtcttaacttccctgcacataataattcactcctttccttgcgctccagccaaactccaggtggttttgctatcacatttaaaacactgtctaagttactgcatagtgtgagcctcttctccataccaaactctgatctccagctcaggaagcatgtcttattcatcactgtatgtccagagcatagcaaatagcatgcacatagttactgcttaataaatgcatatacaatgaatgaataatgaatagcagtcatgtagaagtcagtagtgggttttccgttagcataagatcaagaattttgtccattatatggcacaatagccctgctgctttcatactgaaagttgtgcttcatttcaactactctgtgtgtgtttgtgtgtgtgtgtgtgtgtgtgtgtgtgtgtgagagagagagagagagagagagagagagagacaaagactctgaaacagctgctaaagagagcaaaccgggatgaatgtataacctattattagcagatagcattttgataccccactcctagttcaatcctagtttatttcttttttgcctcatttctctcatttttaatttttttatgttgagcaactttataagcaacttaaaaccttttttaggcacatcagttaatcttttgtgttttgtagaaataataaagaagcataaaaaagatctagtccctctttgctgaagaggaaagtatggggcaaaaaatcatgaggatgctatttactgctgcctggatattgaagtaacatgttaggagcctgtcttagtccatttgggatactataacaaaataccatagaccaggtagcatgtaaataatagacacttatttctcttggttctggaggctgggaagttcaatatcaaggcactggcagaaggatcccatgttggtttatagacagccatctttttgctataacctcccttgtcaggaaggcaagggcctgtcttgggcttcttttataagagttctaatcccattcataagggctctgctctcatgacctaatcactcccccaaagcccttcctcctaataccatcacgttgggggttaggatttcaacatgtaaattttgggaagatacaaacattcaaaccactgcagaacctttaatagaactgcctcatcttcaaagtcacaatagaggaggccactgagattgagtgtgcttccccacctatcaaaacagcaaccataaagaacacatccctgagtaggtaagtaatctacatcccaacatgaaggcttaattaccatttcccctttctgtgattttacacgtaggatttactgtagacagttttgagttaccttgacagaaccgaataaacatttaaacacatattataaaaaggttgtaagtttttcttgctttcaaatgactgagcaccaacccagagccttcacatttaactcactgctataagtgctctaaaggaaatgtttgctcttctgagaaatggtattagacactggattagaggtgatgacaactttgtggattaagacctctgataagcttgctgttgcaaatatatatatatatatatattaaccaaacatttgaatagcatgtaaaatgaaatatgaatacagttaagtgtcatatatgatttctatacatgagtagacattacagtgttacagcaaagaaattaaaccaatttgcatactaaagttaatgataataatggctgtcctttactgactccttatcacatgctaggtatatgctaagcactttgattacctcatttatccctcacaacaaatttatgggggaaaaaatagattttatttatattttacaaataaggctaatgaggctcagacaggtaatttctttcacccatagtcacaaagctattaaaaagcagtgctggtgctcaaagccagggctatctgattcagagttcacatcggtaagctcttcactttctcactgttttgtgaaattatcatgttcttttcttcacttcagaatgacccagacagtggtgagttttggtgtatttccacacataatccaacccagtgagattagtctctgttctatgtgacaacaggcaacagaatctttaagcaagtctttaatttagaggttggtgcaaaagtatgaattttaaatcattttataactaaacacatctttattaatcaaaatagaatccattacaatgaacacatttttgccaacaagaaataagtttgtttattcctgtagtgtaaaaatctgtgcttctggatttgatgaactgttggaaagcattttctgcatcctgctggttgtggaagcattttccctgcaaaaagttgtcgagatgcttgaagaaatggtagtcggttggcgagaggttaggcgaatatggcagatgaggcaaaacttcagagcccaattcattcaacttttgaagcgttggttgtgcgacgtgtggttgggcattgttgtagagaagaattgggccctttctgttgcccaatgccagctgcagcgttgcagttttcagtgcatctcatcgatttgctgagcatacttctcagaggtaatggtttcgccaggattcagaaagctgtagtggatcagaccagcagcaaaccaccaaacagtgaccatgaccttttttttggtggaagtttggctttgggaagtgctttggagctcggtccaaccactgagctggtcatcgccagttgtcctataaaatccacttttcatcgcgcatcacaatccgattgagaaatggttcattgttgttgcatagaatacgagaagatgacacttcaaaacgacaattttttttttgaattttctttcagtcagctcatgaggcacccacttatccagctttttcacctttccaatttgcttcaaatgcccaatgacagtagaatggtcgtcattgggttctttggcaacgtcttgtgttgttgtaagaggatcagctttgatgattgctctcacttggtcattgtcaacttccgatggctgcccactaggcttcttatcttcaaggctgtcgtctcctttgcaaaacttcttgaaccaccgctgctctgtacatatgttagccactcctgggccaaaatgcattattgatgttgcaagttgtctccactgctttatgagatattttgaactagaataagaaaatcgctcgaatttactttttgtctaacataatctccatagtctaaaataaacataaaacaaacagcaagtaataagtcattagcaaaaaaaccataaatcgagaaatgcccactaaaatgatgtataatataaccacatttatttaagaatgtattccattatcaaatggcaaattccaacaatggaaattccttttgtaccaacctaatattttctcctgactcctctccacacacctaggtaataggccaactatatgagtaaggaagagcagccctgacctttacgaaaattgtgttgtttaaaagcacatgataccttcccaaatgggatggatatcacacttttgaattttcagtgtgtttttaaattatttccattttgtagcacatgcaagatttatttgaagaaagaaaaaaaataaagaaaagaacaaataaactattgtaccatcataaagggaagtgtttgaagatattagctggcccagctccacaattaagaagtttggctacaattaaaaacttaagaatatcagtcaaaaatatttactgtctattagatcatcatttttttaatgagaagaaatttagaaagtgcataaggagacagccttacattgtttaaagccagttttagactatttggacttttcttatacatgcatgagtatgctcagaaattcaaattactctgctgttcctattttatttcactgccctgaaatcctgttgttgaaactacaagacttgaaaataacaggaacatcctgttgacaaaaataaattccttatgataaaatatttttcaactgaagccaattttttttggatggggaaagggccttggtgggagaggggattgtgagtgacagaatgttggtttgggttcattgctctttcctcctagctttgctctctctccttctaacggaattagttgtattattttacatgaatttttgtattatgcaaaaatgttgatgtgtggtgtctttgaaaactgttttatggaaggaatacgtgtgtctgtgctgcccaggtattactagtgagtattatacttaggaatgagcatgtttagtgtgatgttcactaaacacttgatttattcaatagtcccctaacccctgggaatgcatatgcaaagaataaaatgtttcagacatttgcttaacaagggattttagattatttgcagaatatggtccctgaaaacattttaggttatttttccatggagtctgacttacgctgagaagcctcattatagcactgaccaggagtttaaacagtcaggtgctgggcaggcctcagaagtccttgcacttggtttcttcacccatcatgctggagggagggtggcatgacctctactatcccttctagtgctcagattcaatgaaggaacttattttttaaagaaggaagtgctgttatctttctaatgggcagctcagaatggcagggatattaatagtggcctgcattccaatagtcaacactgagatcttccagcagtcaccccatccagaatgcaggctttgaaaggctagaaaccctccctcttccataaaatcgttaggtaattgacctttttttttttttggcatcttttgccctctttttggaagctttgtgggagtgggacagtagtatggaagataagaaaccctaagtttaaatccctagaaaagcccctgaaccaatagtcaatttactgctgctaacaccactggccagactggtttgtcagtcactggtggtgtgatggtgtcatgttgggcttccttattacgtgcctctttttgaatgacccatcattaccttgacttttcaaattggaccaagtttcaacactgattttgcagaaacacacatgagtcatgaggaaaagtagcaaagggaaagttttcctccttcccctcatgcggacgtgctgtggacacaggcagacaatcataattgcatgactgagtcaccttacacacctgctgatcggtaaagaactcaagagagaaagagctgatttcacctgcctcttccacaaagtctcctgactaccccaactgaggcactgttttctttcactgaactcatactgcacagcacttttctctgacacataaataaatgtgatgaatgttcacactttcctctctactatttggtatcttctcttttttaatgcaaattaaatcttgtatactgtatacataggaggatttgggcttagcaatagacgacagtgatcatggttatcttttattgagtacctacggcatgccagcctctgatccaagacctttacatgtattcactcatttggttctcactgcactcttgtaaggtagatgccattgttttccctattttattttttggaaaactgagctgtggagaagctacatactgagtatgtggagaagctacatagttgcaaagtcaataagaggtgtacctgggatccttccaaatatctggcctcagagccttcattattaccagtattttttttgcaagcagaattattctaacccatcagtaaaaggcttctcctcactctgtccttccccctacattataccctcaacagcaagatcattttcttttgagaagcttctttacaaaaatcataaaggagctctcttgacatctgtctatctagctcattagacgtgtctagtttagggcagttcaaattgggacttttaaaatgttgcctctacatatgtatgatctaattcttaccacttcaaagcttcagggaaagtgaaatgtgtcatttccccctcaatattgggaattccccataaagtggataaaattttagcctgtatttccttttagttttactttcctcttctgaaattaattcatgacctctatctcaagttttctccagatttttggcccatatttctttttaacatttatcaaatatcccttgcatattggccttttacatttcttaagtttccagttttaactgtaacattgcaggacacataaaaatgataaataaatactaattaatagtaacatcatagactagcaacaatccaatatgagcatatttagggtttagatatcttagtacatttttatgtactaacccattacacagcaaacaccaacgtccttacatatttattcaattaaaaaattaggataccaggattgaaatgggctctgcaacagagctgagtattggatttgagacataagtcatctacaacttaagataataaccttaaaatgatggacatataacctcatctactcacactgtcactgttttcttgctgtttgtttgtttgttgctggggggcggggcagcagttttggttcttttgcttgtttgtttgtttggttttttgagacactctgttgcccaggctggagtgcagtggcatgattatggctccagccatcctcccacctcagcctcccaagtagctggaactacaggcacactccaccatgcctggcaattttatatgtgtgtgtgtatatatatatatatatatatttttttttttaatagagacgaggtttcaccatgttgtcaaggctggtttcaaactcctagcctcaagaaatcccccaacctcagcctcccgaagtgctgaggttacaagcatgagccaccacaccaagccactgttttcttaataattgaaagttaccttactatttccagaatttcatgattaaaattttaataatagtgcaaagaaatgtatagtgtattttaaacagagtatgactaactttaaccgatgatttcttaatggttttaagttatttaggatcaccagttattgcaatgtgctgcaaatgttaatgtgactaaagatggcaaatatgggtgtgactgaatgttcacccctgcaggggatgctctagaagttttttcttggagcatttgtaactatcacataaagccacatatggggctaatttccaggtcagtgtaatgtggctactgttctctaaaatgtgatgaataattaaacgtttaattatccttctacaaaatgatttttgcccttttgaggaatcaaaccattgctgtgaggatttttttgccagtcagacatctacaacatgaatagtggccaagagtgacactcattgggcatagacccatccagaatgcaggctctgaaaggctagaaactctcccttttctagaaaatcattaggtaaccagccttttctttccaggcaccttttgccctctttttggagcaagaggtaagaacaggacaccttgaatactctaggacaacgatattttccagtaccaaacaattttgttttatgagagaacatagagcattcatacatacaaaaaataacaagtcagcctgaccttattctgatgaaatgctgatggggcttgattcactggaacctacctggaatgaagttggcaagcggtgtccagtggatttatttcagcagttttatcaagttgcttagggaacaggctgctcagacttgagtttcttggaaaaagactttaacctactaatagttggagtccattatttgcctttggaattatatgtaaatatatttaactccttaatgagccagggatgtgggcaattcttccttattaaccaagagctaattatttacaatataaggtggtattttaatgtagccagtatatctgactacttcaaaatcttagtttaatatcaaatgaaatcaaatacctgctcttttcgaattagatgaaataatattgctgtaatgtgtccatttttctttcctcaatcttttcaagcaatataagcatataagtacattttaagcacttaaaaatgagcccaattcttgttccttggtcctttggcattttttgagggatttgtcaatatgtagagttagttagcaattctcaccatggtgtggagtgtgctctaaaacaggtagacatgatagtgatcctgtgcatcttcaagagcaatgttgtttaaagaatagttgtgtgttcactccctttttctctctatcacttgctcactagctatgttttaactatggtcattgtagttgcaggtaaatccacaagagttatttcaagttgaaggggggtgggagtatagcagtataccacaggcattcccgtggatattcaaaagtggtacagttggacctcaggaaacctagaactagcatgctagaaaccagagccacattgttcttcttttagagaccacagagtctctcatttgtgtgttgttacttgcatctgaaccctcttcttcttctctccccttttctcttgcttcctcttcccctttctctgttcatttattctgaagatttgtttgtttgctccaatatggccatttgccctgacatcaactctagtgtccaccaataatgtgcaactgtccctgtcaaattctcaagggcaaaagacagattggctcagctcagcttttagagcagagtcaccaaattataagtcaggggcaagcaagaatcgttgtctctgaggcaggtgctcatctcagaactagtcatctgtggctgggagagtgggggtggaggatgtagcacaggggtccccctttccagaaactttgagtagcacaggtcactgtggaatatgtctgttgcactcacacagaaaccttattccttcaacagctgtttagatgcagcagaactgaatattaacgtcgtagcacacccactgcaccccagcactttccttcccatctcgtttggccagtctgcagatctgcggtatcctctgtcactttactgctagctctccttttctgcaacattcagattgcttctgaacattgcatctgaacagcccaggcttctaaatatcacagatctctgtttttctatcccttttgctttcagctgtttttctttcttgctggttcttcaggctgttgtgaccaccatgtgctgtgaaatctctgtctgattctttttggagttccatagccccttggctccctaccaaagagatgtaaagattaactagttaattaggttaagctactttatgtctaaagagtgtgctagaagagtgtttctcaaactttttttttttttttttttttttgaggcagagtttcactctgttacccaggctggagtgcagtggcacgatcttggctcactgcaacctccacctcctgggctcaagcgatcctcccacttcaccctccgagaaactgggaacacaggcatggtgccaccacacctggctaatttttgtattttttgtagagatggagtttctccatgttgctcaggctggtcttgaactcctgagctcaagcgatctgcccacctcggcctcccaaagtgctgagattataggcatgagccactgcaccaactgtttttctcaaactttaaacccttttcctgtttgctccaagaatgcctggcagcggtgctcgtggctacagtgtttaccccaagataacttcgccacaaaatatctcgcttttattattttcatatctgtctagtatatggattttggaaacaaaagacataattctattcatagcattctatttttagtagtggtattttcatttacaatatatagtaattccctatcgtttaaattgtcaaatcctagaacatgaagcattcctacgcatgatgttaacatcattttggaacagttggcggaagattcatttgatgaatcagatttttccaaaatagaagattctgatgattcagatgattctgatgttagttctgtttagaaataactccaagaacagtttttatgttttcatttcacattgaaaatcagtcaaatttgcttcagcctcaaagaacatgtttatgtaaaattaaatgaggctggcagtgaggtgcactttgttttctaaacaggattaatacacataggaaacacctgggaaacttgtgaaactgcagatgagattcaggagctccataggggagctggtggtggtggtggtggtggtggtggtgatggtggtgatgctgatggaagaacaacacaaattccagtagaagactagattcagaagtgctgtgcatttattgtaaatatattctacctgataggagtgaccatgccttaggcatctttatatgcccttccatgcccagcactgtagctggtatgtgattgatatttaaatgttgattggattatgattgagctgaggacacttgaaatacaggattttctatgccatatttttaagtgagaggttttcaaaaactgctaagaaccagttaaatcaataagcatttcttaaggatctgattgtgcaaagccctgggagaaatgtaaagaaaatgttacagtccctgtcctcaaaagaacactggcatatttaccactaacttgaatatgtctatactggaattgtggaaataattgtcaaattgtagaggtacagtgaaggccagtgagcctgtttatagtcctagcaatttgacgttttataatttaggtgttattttccccatatatacataacaataatgggttctagttatgtttcagtgggataatgcatgtgaggattgggtttcataccctgcacacagtaaatgattgctagcagtagtagtagtggtagtagtaatacttaattagtcttaattatccagccagtccagtttaggaaaaactgttcccctctccctctctttgctttcttaatgttccatttcactttgtagagattatctgtagtttaatcttgatgttgttcaaagtataaacttaaacaaaaatgcattttagaatgtagttgattcccctggatatgaaaattgctgtatgctctacaacagaaagacaggaagaggaatatattttcctaccttacaactgtttaaacccaagctgtatttctccttttctctgatgttttcataaatttattcctttaaaaaaattaatgtgcttaaagtgtttctctaagtctttccagccattttggattgaccaggaaatacgtacacacacaatgcatgcatgcataaattcacaggcgaataaaaatgtatgttaaataagagcgttatctttggaaagaatgtaaattgagtatacaaggaaaggaatattgaaatcataaatagtgtcttagactttataaaggataagcatctacagaattaataacatctgtattcttcaactaataaaaccaataagcagatatactgtactctctatacaaattagaaaccagtttgtgataaatggtgaacaattcttgattgctagatcatcccatgtactccccatataaagtaggtcatcactatgaatttccatgtagagaagaaaaagttgaagtgacaaatgtatcttttaatgtagaggctatcattgaagaaatactcaggagacctctgagggaggctggcacatgagcctgtgaatcatgactattatccttgtcttagaagtactcacaaagaagaccttggaaacatttattgtcctttcactacctgggtccttttcattacctatgtaacccagatgtaacctggctgtccagctgcctggattccttcagattttccagtttgccagggtcaacttgttctttaaaatataatgtaaatggactcaaatcacaatctcatgcacagggagttcccagcatccattccagtatttttagtggttgtaagcggagttcatgtctctcctggacccctctgcctctgagttccttcttacgaatatttcagacaggaataaagaagttgaaatactccatgccgcccacataaaatttttttaaatcaaattgggtaacgcaagtgaaaacatttcagtaagtataaagcattaccgaggagagataataatcttactaaattagaaagtgagttaaagcattgggaatgctccgagggtagactcagaggaggaaaaactgaaggtaatgaaacagcatctacttgtttcatctggcgaaatatagggaaaaggatgaagtcctgacaagactttgaagtgaattagaattgtctgtaggttctaataagaaaatctatccatgaaagtttaaaaaggaacagtaaaagttatgtggttgtaagaccccaaaagactattcaacacccgaagagagagagattcctgaagttctttgaagctggttgagctgcaattacagagaacacattctcctcacctttttaaggaagcaaatccacatggccgttgtctcattttctcttctcatatctgccagatgtgttcttgaagcaatagctgcacgttaatcagctacttccacagccctggtgcgggcattgccttctttctgcttatttcttatgttacattcagtttttccaagaattcattcccagccttatttcaaaagctactctaacatgatattcacagtttcctaacacccctgatcactttatgtgctctaatcctcaaactaactacctgaatatactgtacctctaatttgggtggactggaggaaattctggttggcgaggctactttttttttctctcaagggtagaatatagttcatttatcttgaacatttttaagtatttgggagaaattttattatacagcagtagaaattttattcagacagtattgctcagaaaataatacctatcagctttaaaagaagagttaaaaggtaatttaaaacaagaaggtgttaagtatatgagacataatttggggatgtggaatcatagctggtcccagctcctctccatggaccatcagggagtggcagcccatttgttatctgcaccatgggttaccctgatatccctgcctcctttgcaaatgttaagtgtttcacaacagtgtctgactccctgaaccctaagaggtagtacacaaggcaggcagtttttgtttgaaggagattgggatggagtcctggctggacagcagtgagcaaggggatgggccctgcagttctgcaatgctgtagatagagaagaaggcaagaggagctgccaacgagaacaggcatgctgtgggagcaagccctcctccttaacattctggcccaacattgaccaagtggaggatgaacatggagtaggtactctcaggggcctattacttctgagaagtcatgacttgtggagctctgaataaaaggagaaaaggggatggcttcaggattgggtcattttcctgccccttttctgaaaggatgagccatcaatgtcaagtcatcctataagtagggagaattgcaaaggagatttttttttttttttttttgagacggagtctcgctcttgttgcccaggctggagtgcaatggcgtgatctcagctcaccacaacctctgcctctgggttcgtgtgattctcctgccttagccttccgagtagctgggattaaaagcatgtgccaccacacccagctaattttgtatttttagtagagaaggggtttctccatgttgttcaggctggtcttgaactcccgacctcaggtgatctgcccacctcagcctcccaaagtgctgggattacaggcgtgagccaccgcgcctggccgcaaaggagatttttaagatcattagcgcttagagagttcccttctcttcctgagtggagcagtggatatgtctggttacttccaacctcccaaaggttcacattgcttgtttaattttttagtcaaaatgatgtgtcatcagctggaggtcacctttcaaagtctgctcttatagcactctgtacaaaatctttatattcctagagtaattcaataattgagtcagtaattttccctattttgctgtcccaaattgaattgtgatgacatttttcaagacacaaataaggcagtgaaacctacctgtgtttcttcatcagtatctgaatttgtaaaagcatctttaggctacttgctgtcaatggaattcataattcacatgaaaaaaataagtgaccatttgaagccaatatgcataagaatgagtaaccagcatgaccactgtttttagtgcaggagtgtgttcaatattaagaccattaatgtttgcccattttatttaatcatgtgcccttcatgtggaagaatcaggtcttattgcatacagatgagtgttcaggtaatgattcaggcttcatgctatcaaaattaaattctaaaagccaagaaatttatcatttttatatccctttgcagatacagagtatgtgtagaaatatctcttgaaatatgccttgtttacgtgagaaataaaataagcagattatgttaattagaaatagtatctgagtggccaggtgcagtggctcacgcctataaacccagcactttgggaggccagggcaggtggatcacaagatcaggagatcaagaccatcctggctaacatggtgaaaccccatctctacttaaaaaaaaaaacaaaaaacaaaaaaattagctgggcatggtggtgggcatctgtagtcccagctactcaggaggctgaggcaggagaatggtgtgaacccaggaggcggaacttgcagtgagccgagatcgcaccactgcacttgagcctggatgacagagcgggactccatctcaaaaaaaaaaaagaactagtatctgagttaggcctttaataatatatttctttttaatataaaattgaggcactcacaaaaaaaaaatacctaagaatacctctggccaaggacaagaaacatctctacaaggagaactacaaaacactgctgaaagaaataatacatgacacaaacaattggaaaagcattccagctagtggattagaggaatcaatattgttcaaatggccatactacccaaagcaatctacagagtcaatgctattcctatcaaactaccaacatcatttttcatagaattagaaaaaagctattctaaaattcatatgaaacaaaaaaaaaaaaatagcctgaatagccaaagaaatcctaagcaaaaagaacgaagccagaggcatcacattacctggctttaaaatatactaaaaggctatagtaaccaaaacagcatggtactgatacaaaaacagacacatagaccaatagaataagttagaaaaccgaaaaaaaaggctacacacctacaaacatctgatcttctgcaaagctgacaagaacaaatgacagggaaaggactctctattcaataaatggtgctgggataactggctagccatatggaaaagattgaaattggaccgttccttacaccacatacaaaaattaactcaggatggattaaagacttaactgtataacctacaactataaaactccccaaagaaaacctaggaaataccattctggacataggccctggcacaatgtccatggagatttcataactatgaccccaaaagcaattgcaacaaaaacaaaaattgacaagtatcaacagagtaaacagacaactttcaaaatgggagaaaatattcacaaaccatacatctgacaaaggtctaatatccagaatgtatgaggaacgtatacaattgaacaagcaaaaaacaaataactccaccaaaatgtagacaaaaaacatgaacagatacttctcaaaagaagaattacaagcagccaacaaacatatgataaaatgctctacatcatcaatcatcagggaaatgcaaatcaaaaccacaatgaaacaccatttcacacctgtcagaatggtcattattaaaaagccaaaaaacaacagatattggcaaggtggtggagaaaagtgaatgcatgtgcactattggtgtgaatataaattacttcagaccctgtcaaaagcagtttggagatttctcagcgaacttagaacacagctctttgtcccagcaatcccattactggatatgtacccaaatgaaaataaatcgttctatcaaaaaagacacaagtacttatatgttcatcacagcactattcacaatagcaaagacatgaaatcaacccaggtgcccaacaatgctgggttggatagagaaaatgtggtacatataaaccatagaatacaatgtagccacaaaaaaaaaaaaaaatgaaatcatgtcctttgcgacagcatggatggaggccattattctaggcaaattaacataggaacaaaaaaccaaataccacgtgttttcacttataagtggaagctaagcattgggtactcttggacgtaaagatggcaacagtcactggaaactgatagatgggaaagggatggaggggggcaaggataacaaaactaacttggatattttgttcactatctgggtgatggggtcattcatgtcccaaaccttagcatcatgcaatatactcatgtaacaaacttgcacatggactcccagaacctaaaataaaggttgaagttattaaaaaaaagttaacacactattttcccaaatcagaagaatgagtgtttccctggttacttatattttggattccttctaaacaggctatgcgtgattccccctgagttgtcttcaaagtctagtgtttatggctgtatcataatctaggtttgtagatattatattttggaaaaatagaggaggtggggaaaatacttcaaaagaggcacttcttactattaaggtttcttgtaattgaaagtatagtcttgtaacttggaggtatatcccttataagaatacttcagaagcagttttagatattgagaacctgtttaacgttcctccatttgagattttcatgcaagattttatgtaaagcgcaagtggatgttatgttccataagtaaaaatttctagttatatctctaaaaccattttgccgataatttcagtattaccaaaataaataaataatctaagtttgccttggaccccactatcctatctaaactctggtaataataaatataattgtgcagtatagcttctaaatggaaaaattatcttcattttcaagagagaatagatggctcttggggaaatgtatagttaaggaataagaaaactgtcagtcattcaaaaaacaagattgtggagatgacaagagtggagccctgggaatcctcagatttgcctttaaacaataccatctctcttgtggtttccaaaggattctggagctggaaaagcaaggcaaactcacgctttcttattagctccctaatggtgatatgatccctcatcctttatttcctctgttaggaagaaaactcctcccaggaagaaaactccaaatggagagagagggaaggaaatagaaagggagagaagggagagggggtggaggggagagagcaggtagcttggcctcctcctatgcaggagcaacaatggtctctgtgaccttttaccctgaggggccagagaggtcaagagaggtccctgcagacatgatcagtcattgataggacacagtgactttgtcatcagccccatggccataaatcctgatggcattcttcttcttttgaggttaaatagaggaaggaaatagaaaggaacctggtactctccctggaatccaccaactaatttgaaacataagctgggcatgactagatcagtggttcccaaagtgtgttccagggcacattagtcctatagcatgaccatatgtctgtgtatctgtgtgtgcatgtgtgtgtgaaaaaggagaagggtttaattttcgttgaagtctagaaatgatgggttaaacaaaatttactaaatgctgtatgtgaattatttcggttaatcttgacaactaacttttgttgcagatgctattataatccttattttatttatttatttttattttattaatttttttttgagatggagtctccctctgtcacctgggctggagtgcagtggcatgatcttggatcattgcaacctctgcctcccggtttcaagcaattctccctcctcagcctcccaagtagctgggactacaggcacctgccaccacactcagctaatttttttgtatttttagtagagacggggcttcaccatgttggccaggctagtctcgaactcctgatctcaggggatctgcctgcctcggcctcccaaagtgctgggattacaggcatgaaccactgcaccccgcctataatccttattttaaagatgagagacagttcagagaagttaaaaagtatatctaaagtgactctttttttttaagatgtggtgctggatttaatagcctgatttcagagcccagatctcttgactccatgactttctgtggcctttttaaaatgaacagatatgtacccttaacttctatgagatgtatatagtgtgcatctctcaaatttatttggccataagcttttttgaagttttctgaactttacaagaggtgaatgttccagggaacctactgtgtgaagcagtgggctagatttaatcagatgttgtactcaaacaaaacttcagtttggcaaaccaaaaatctgatgttgccagcatctggatacaaagagctagtataaagtagtgatgtgatacattctgcatttagaaatatttgcgctgaaagtgtctgagttacttcttctcatttctcttccaggtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcaggtttgaaaggaactatatttgtactttggagatggaaacgctttaatggtgggaaaatgtcactgaattttttttatcaaaaagagggaagttcggctcatctttcagctctgaagccacaagttaagctatagctctccagtttctcctgcttcttggtacctctgatgtctccctttcttcagggctctgtaggttttattgttcattccaattttgtccttaagatattgatatccaagtaaatgagtcgcagccttgggagccacttcccaagctttcattaagtgaagcaataataacttgtgttctacctgtgaaatctgttcatttctctccgattctgagacttctgcacagtttaacaaacctccgcagtgctcatgagtgtgcatgcagagctctggttgtgctgacagatgtttaaaaacatgtaatcagacagctacatgagtggctacacatgtctggttacttaagagtgcaagcctttctagttcaaattggctttcactacagctcattttttccctttgaatcatacctaacagaggtttttatgatctgattctttttattattgtttttagactagagtccctcaggaattttcttaactagaagcaatagccacacacctacatacagaaaatgctctgtaaaatgttatgtgagtgactgggatattagggagcagcttaagagctgggagtagaggatccctcttgggccaatgaggaacagaagtcttcttttttctaaagttttacaagtctaaagccaaatgaatgacagtcttagaggaattcctcacgttttaagtgcttgtcaaagtttaagcaagtagcatatataaggtctctagaatagtgtctaatacatttttaggggctcagtagctacagggcgtcactctaatgtaatgcagttctagttcctgaacttgatcagttaatatgcaaaaggattttccttgtagtataaagaaaagacactcgtttgtattactttgtgggatagtttgtagcatagcagtatctagccatctcttttctaattctttctcatttagcatgcaatcattgtgttggcagaattttcttttttttctgagacagggtcttactctgtcacccagcttggagtgcagtggcatgatcttggctcacggcagcctctgcctataagattcaagcaattctccttcctcagcctcttgagtagctgggactacattcatgtgccaccatgcctggccaacttttgtattttcagtggagatggggtttcaccacattgcccaggctggtcttgaactcctgagctcaggcgatccacctgcttcagcctcccaaagtgctaggatgacaggcgtgagccaccacgcccagccgaggaatattgtttaaggttaattaattaatcttaactcctttaataaaaaatattcaatgtataaattctactttttcacgggacacagaagttatctagaagctatgcttgttttttcagttttaatactctttattttttaaattactttttaaaaatgtaacttctttctttttacatttattttaggttgagaggtatatgtgcatgtttattatgtagataaattgcatgtcacctcatgggggtttggtgtacagattatttcaccacccaggtaataagcacagtatccaataggtagtttttaagtcctcaccctcctctttccctctaccctcaagtaggccccagtgtctcttattcccgtctttgtgtctatatgtactcaatatttactcccacttattagtgagaacatgtggtatttggttttctcttcctctgttagttcacttaggataacagcctccagctccatctgtgttgctgcaaaggagatgatctcggttttttatgactgcataatattccatggtgtatatgtaccacattttctttatccagtctaccactgatgggtatttaggttgatttcatgtctttgctattgtgaatagtgctgtgattaacatatgtgtgcatgtgtcttcatggtagaacaatttctattcctttgggtacatacccagcaatgggattcctgagtcaagtagtaattctgctttgagttctttgagagacagccaaactgcatttcacaatggctgaactaatttacattcctaccagtagtgtataagcaagcattcccttttcgctacagccttgccagcatctgttattttttaactttttaatgatagccattctgactggtgtgaagtggtatctcattgtggttttgatttgcatttctctaatgattagcaatgttgggcattttcatatgcttgttggcttcttcatggcacatatgtcttcttttgaaaagtatctgttcatgtattttgcccactttttaatgggcttgtttggtttttgcctgttcatttgtttaggttcctcataggttctggatattagaccattgtgagcgcatagtttgcaaaaattttctcccattctgtaggttgcctttttactgtgttgataatttcttttgctgtgcaggagctctttagtttaattaggtcccatttcagaagctatgcttttaatcaacttgggattcatcttattaaaatgtacattcttttggggggagaatggtggtttgttttttcctctaagtgacaagatttattgttttatatataatgtaaaagtgccaatgtttgcatgttttcaataatgctaacataggggcctaacatagtgacttaattctttgaatgcctaaatcacccctgcacctcttgaatatgcttcattactgatatagtagataaaacagtaccctgattatcagaaaaagatagccctcaagcattgaatataaggcaaaagttccagcacagttgtatcttaatgagggaaccctctcttgcaataaaatgtgaatagaagcattgccctattgttgtgttacaaatttaaaaagtgtgatatttctaattcccctattcccatggcaatttattctaatagtcattatacttggacttccacagcagttttctgattggtatctctggttctactctttttcttctccatttcattatctcagatgtctacattttaaaaatataaagtggattttctcattctccagcatttcagtcaaggtttctctcattgccccaaaaaaaagtccagtccctttagcttacaagagtttccacggtctgacccaggaccatctttccattcccaagttagttactattatcctgcattctgacatgccaatctatttactttttcctaaattttcctgatattgccatctttgcttatgtaaagaaatctttactttgagctcctcctcattagttggtaaaacccacgtgctcaataagtgatatgggaaaatgtagatgagtgagagacagatgcaaggggcttatcaccttcccatattctttattagctctacaaagctttccaaaataacttcagaatctaaacaacagtgatgtgcttgacaatcacaagttaattctcctggacatcactttacttctttacagaaattctagaaactttcaatattctcccccttttgtgaagccttaggaattgcctctttatggaatcacaccaaataagaattactcattcccttctttatgcctttaaagtatttgtccctttagtcattgtagcacttatcttagaatggagtggtcacttgttttggtgtgtgtggttggtggatttccttaataaattattaattccttgagggcaggaaccatttagtattcatctctgtatccccagggccttgcagagtgcttagtggatagcaggagcataattaatgtttattaattaaatgaataaattaataatcatcaatgtaccacaaaattatataactgtaaaaatggatacccaagctaaagatagcattaagaagagaaactgtaatattatcaaagtagaaattaaatgacttaattctctgatctgtttgtaaatattcctcaaaagttattattattaggactatttttataagaaatattttttaaagctttacctctataattcccaaaactacatgttcagctttgccctcaacctgatcttttgtgtttttatattcaacatactataactcacctctacttgaatatgctccacttaactcaaattcaaaatttctttttttttcttttccagataattctttttttatttttaattatactttaagttctagggtacatgtgcacaacgtgcaggtttgttacataggtatatgtgtgccatgttggtttgctgcacccatcaactcatcatttacattaggtatttcttctatttactctaccacggagcacttgacactctctttgaaactttttgctaaaattctcttgtgctgacttgtaaaatatccagttaaggtggtactgtaaattcacgttttgccttctgccttactgtatatacagaatagccaaagaataacgtataacaaaagaatgttaaaaataccgtgggcatctctatagaacagaaatcaagcagaaacaccaaatgtactggtagactaggccaaaaccatagacctgatatctcctggggtccagaagcaggtagatgcaggacattttgttaggctcaaaatcttccatgatttctgtagaactgagctccaagctaatcactctttttgtggattaaatgtgcctgacaacagaagcaactttgcatcacatttgttcactggttataatgaatacaagtaaccatcccttacaccgtgtattttgagtgacttttttgttctcaacatcccttaatttcaaacagagttcaaataaactcagtgaaacccaaaggaatggggagaacaaagaataagcacctcataaatggaatacactcagtgctatagatgcccactgtcaaccccttccctccctgagcatggcctgggacaggacaactcggctttttgtggccctttgactgccatgaaccaaattgttgaaggtcagtggctcctaatgagaatcacttgcctcctcttcccttcagtgggtggatgtgcagtgagaatgagttatgataaaggtatgtacctgaactaaatttcaatatctcaagcagcattttaaacaaagcctgtaattttcgggcttggttttgatctctggcaacgataagcatgtctctctttttaggctcattagaatttactgactcctttctgattcatgatccagttcttatatgaggaatgattcatggatcaggagaggaaaattcatttcaatcaagaaagaaagtagatgattacaaatccccttcttctaaaaatcccacacataggtttcaatatgatatatgaaaatggaaatgtggctggatccagctagtcatgtaatgtgaacctgaggtatttagaatctcctggtactgtaatggccacatctcttacatgggagcattatttgaggatgaatgcttccatttcttcaaccttagagtgaacaacaatagtaatataaatcaatattttattattattataaaaattattgaaaactttttatagtgaatattgtaaatgctcatcccttacatcctaaagttgagtgccttttttactcttgtcgtttttaaaatttcaaatagagcaaaggaaatgaaatccaaaggaaaaagagggaaaggaaagagctcctggtaaataaaataaactgtgtttcagtctccaaagatggctgccatcagttacttttctccttttatgtaggtgctactcctcacatcaaaggatggagactagttctcatccttttacatctggactgtctttggacttgcttagaccaatgtaatgtgatggaagtgatgctttttcataatgggcctagactttaagatgaatggcagttttagattccttcctcttggaagccaccatctaagttcaattacccagagaccaccacggtggtagaaaccccacgctggccatgtgcagcagacatgtgcaaaggcaggctcagccagcctccagttgtgtcaggcaaaccagctctgattccagacatggacatgtgagtgaagaaggcttcttgtaggttccatccccaatggacaccacacagagttgaaaacctgcctagcccagattgcagaattgggagaaatagtacattattttaagtcactaagtttggtgctagcttatttgaagcagtcagtagctgaaacattctggtgtttcaatatcctcattattctcacatcaaacttgtaagtatgtcattgtccttttaaatgttactgcttgcagaaaccttcaggatttataaataaaaatgggaaaacatgatatgattttttttcctaaagcagaattggggcttctgctaaagtaaagtaaaagtgatcttacccagtaacagtatgtacttgaataggatccagaatgaccaacattacaggtttcacatgtccttggcagttagatgcctgtttgcagtctactccaagctccatttctgaaaataacattttaaaaaaacaatgccttggggcctaaggaaaaccccagcttctcactcaaccgtgaacagacactcccactcaagcttgaaaaaatctttgtgaagcacagttcactcttcccacattttgccaatagtggtgggggaaatcccacatgttaaaaacacatacatatggatgcccattctctgcttaggtttttgatctcaatcctcgaagattcatatcagaaatctctctgcctggaagatgatgtgtagtcattcagtgtttgttttcttcattattgtttctgaaaacacttaggatttgatactgctcatgaaaaactcctagaacaataacatcaggagttgcctaaggctttgcacatcatcatgaaaagtaaaaaggaaaatcatatttttgagagaaggtttaaatttctgttgaaacacccctgatttacaatgtagccaagaaggaaaaggggctgaccacttgtggcagaccgggcctttctagaactcaggtttcctggatttcttactttagtgagctgccttttaccagtctcaattggagatggatgaggacaaaggtaatccccaactctggctatttcagtactaaactattatgtttaattgacatcttttttctaggtggacagagggcatagagcatggatatgggacgggggtgagagaaagagtaaagggctggcactgcatgtaagtgcaggtgtgcatctccctttgcaccttggtggtccacatcatggttattgtcatcatcactgccacccattacgattcaccattcatcaggcactgtgttaagaatttcacgtatgttatctcagtttaatatatatatatatgtacataatatctgtacatatttatggggtacatgtgacattttgtaacatacatagaatgtgtaatgatcatgtcagggtatttgggatgtccatcaccttgaatatttatcatttcaatgtgctggggtcatttcaagttatctcttctagctattttgaaatatacaatacatgttgttaactatagtcaactagtttgctatcaaacattttatctcaatttttacatgaagcctattaagcaggtatgatttcctctagtcagacaaggaaatcaaggaaatgagaggcttagaaacgttttcacatttacagggctgctcagttgtgggattagaatcagaggttgattcacaagctctccagagctgccattgttgttcacatcaatacttctgcccttaccattttgttttcaaaactcttcttggtaatagtgacatgtaaacattaaattttaaacttagagaactctaatttcataaaagtagtattagactttacacccagctccgcacaccctgcaaaaaaaaaaaaaaaaaaaaaaacttgaagtgatcagggttggaaaattactccttcatcttctacttaatcttctgatttccaagaaagattgcccctctttatggtaccaaaacatccctagttttcctcactattctcatatgtaatgcaggtgtaataacactatttaatttcgtacagttgtgtgaaagataaaattttaattcatataagtatttagtatagttcctgaaacatactaagtcctcaatatgtgttagtatttttattagtataagaaccctttcaatatgtaattggtacagaatgcagtcagatatgtaactcctttcttctctacacttcatcaatatctctcaaatgttcccctccctttcttcatgattttgcctggtgtattagctcaggctgccatacaaaataccatagactgggtgtcctaaacaacagacatttatttgtcacagttccagagactggaagtccaagatcaaggcgtcagctgattcaggtcctggcgaggcttgcatggacattttgctctctcctctcatggatgagagagaaccctctcatgtctcttcttataaggacactaattccatcatgggggctccaccttcatgagattattacctcctgaaggcctcatctccaaataccattgcattgggagttagggcttcgacatacaaatttgggggatggaggaaacaattcagtccatagcaccttggtgatgtctcccatcatctcatccttagactattacagctgtcttgagaccaatattgttcaattcttgtctatccccattccacactgaagcattctaaaaagcaaaattggccatgtcataaaatcatctaatgacaatcattaggctatagaataaaaggaaaaaatcaggagctgggcatggtgactcacgcccgtaatcccagcactttgagaggccgaggcaggtgaatcatctgaggtcaggagttcgagaccagcctggccaacatagtgtgaaaccccgtctctacaaaaaatacaaaaattagccgggcatggtggcagacgcctgtaatcccagctacttgggaggctgaggcaggaaaatgtcttgaacccgggaggcagaggttgcagtgagccaagatcatgccattgtacttcagcctgagcaacaagagtgaaactctgtctcaaaagtaaataaataaataaaaatttaaaaaataaaataaatattcactacttctccacatagtctttaatgtcctaaccatacttaactagtgctgccacctaaaagtgatatgacttctgataaaacttgacttaaatagcacaactaaattcactgttgcttgctgagttcatcacttatggtgatgagagaggagacggaatagaattgaaactaatttccatcttgatacccatgataaataggcttcagtaaggtgttagtggaagatatgctaatgtgatacacacttaaagctaatatctgagggtaacaaagatgttgttgtttaggtgtgttgcacactctttaacccttaatgtggctggcatctcttattgacatgtgcatatcactgccatgccataccatgtttgacccagagaattaatgaaacattcccattgtttatcagttttgtattcaggctaagtaagtttcctatctatttccttgccattgttctccaaattaataataaattttaattttcctggcagatcctattttttttctgagacagagtcttactgtattgcccaggatggagtgccgtggcacaatcatagctccctgcagcttcaatctcctgggctcaagagatactcccactttgggctcccgagtagccaggactataaacacgtgctaccatgaccagctaatttttaaaattttttttacagagcatttttaaaagagcactttttaaaaaatggatgaccgaagtcttccattctactcttgggtaatgaaaatacagttaccgattttttaaaatgtatctctctaagatttgtattcagaaatagtatgtataaaacttgactagagagtagaaaaaatttttgaggctgttttatcttggaataagtatggcaacgaaagcactgtgtttctctctcaacctcgtctatgagccactttagttggtatcaacatggtgatactgtaacacactatggctctctctcccaggttcttacctgtatttccattcttggtttgcaactttttccatgtattatttgttgttattttcattatttaaagttacctctaatttatgattcagtgcctacatagttctttaaggaaatatatagtctacaatcctttgtatgatcatactttaattacatgaatcaactggtacattattaaagaggagatccggaaataaaggaaaatgggtttaccagtactagagaaacaggaagtagggaaaggtaatttggggaattagcaattgaatcataaatttctttaaaaatgaatggttagccatcattctcagcaaagtgtcgcaaggacagaaaaccaaacaccgcatgttctcactcatagatgggaattgaacaatgagaacacttggacacaggaagggggacatcacacactggggcctgtcatggggtaggggggatgggggagggatagcattaggagatatacctaatgtaaatgacgagttaatgggtgcagcacaccaacatggcacatgtatacatatgtaacaaacctgcatgttgtgcacatgtaccctagaacttaaagtataataataaaaagaaaaaaaattaatggttagcacaatacccatgatctaatgctgtactcaacagtttacatattataaaactcaagtgaatagaagaaagtgacgtttttacaatatgttgttttttgttttttgttttttgttttcagagaaaagtataccatattaaaggtgaagtgtgaatatcactgggccagaggcggtaacaaactttgatcctcacagaagtactctctcagttgctttagcataactgaaatagcctgcctcattaagtatcactttccttgcagtcagttgctaaagatcactcctctaataagatgtcagaaatatttttgttcttcacatattttgtacttcaaggccactatgtccctgcttaataatttcttttgctgggtacagtggcatgcacatatagtcccagctactcaggtggctgaggtgagatgatcactggagcccaggagttcaagactgtagtgcactgtgagtgtgcttgtgaatagccactgcattctggcttgggcaacatgagagaaataaatattgttttacaaaataatttttcctattttcgaatctgtgttttttgcttataccatcattttcctattcatgttactgtggttaccatttcttatgatcttctctcttcccaggccaccattttcctctccacatctctctgaagacaccatctttctgtccccttctgccggtttcttactcctacttgttcttcatcctcattgtaacctcccttccttccacccttagttgttcttgaaaaatacaatctggaacctcagattggaactgttaaggatattttcaccagcccccctgatttcctcactagcttggcttcctccttaagaaattttgccaatcacccaacctacagaataggagaaaaattttgcaatccacccatctgacaaagagctaatatccagaatctacaaagaacttaaacaaatttataagaaaaaaacaaacaaccccatcaaaaagtgggcaaaggatatgaacagacatttctcaaaagaagacatttatgtggccaacaggcacatgaaaaaatgctcatcatcactggtcattagagaaatgcaaatcaaaaccacagtgaaataccatctcacgccagttagaatggcgatcattaaaaagtcaggaaagaacaggtgctggagaggatgtggagaaataggaacgcttttacactgctggtgggagtgtaaattagttcaaccattgtggaagacagtgtggtgattcctcaaggatctaaaactagaaataccatttgacccagcgatcccattactgggtatatacccgaaggattataaatcatgctactatgaagacacatgcacacatatgtttattgaggcactattcacaatagcaaagacttggaaccaacccaaatgtccaacaatgatagactggattaagaaaatgtggcacatatacaccatggaatactatgcagacataaaaaaggatgagttcatgtcctttgtggggacatggatgaagctggaaaccatcattctcagcaaactatcacaaggacagaaaagcaaacaccacatgttctcacttataggtggaagttgaacaacgagaacacttggacacagggtggggaacatcacacaccggggcctgtcatgaaatggggggctgcaggaaggatagcattaggagaaatacctaatgtaaatgatgagttgatgggtgcagcaaaccaacatggcacatgtatacctatgtaacaaacctgcacgttgtgcacatgtaccctagaactttaagtacagttaaaaaatattatatatgtatacacacatatatatagaaaaaaggaaattttgccaatcaccaacccactctatgccacacagttctcttttgtcagccaattagtgctactctgtaacggatacttatttattataagtactcttaactaagccatctctgcttctgagacatcctttggattatttttaattgataagtcttaagcgatctttgaaacagattctactgccctgaagtctgtgttttatacattctatcctcactgtctagtcaagacatgaaaacaacatgctgttatctcacacgactttccttatgttctctgatcatttctctttgccgtctctcttctttgccatttttcgtttcatcttagatgagaaagtaagtagctcattctcaccaaagccagctctcccaattgtgcctttcatctgtttttcctactcttggaacttgtttcattgaattttccacaactgcctcacatcttaaatatttctctctcctgtaggtctttcttgtccatctagaaatatgtatcactttacactgcctagaagagcttactcgtaatgccgctgctttatcaaattactgccctgcctctcttctttctttaaccaacaactactcttgaagagtagttcatacaagttgcctgttctcatcaccttgtgttcacagttaagccttcagagtaccttgcttattctctttctttcatcactcataacgttggacaccaaatccactgaccactcttctcatctgcatatccttcaattcttctgtagaaatcagtactgataaccagccttccttgaaaagtccatctctcttggttttcacgacaccctattcttttacaagtattttcctgctaactcccaggtcatagccctttcttcttatgcctgaaaactctgaagtatatgtattttccagggattgcctttgcattttttatatcatagtgataattttcagatctatcaacttgagcctaacttctctctccaaatataagctcacattttcaaatgtcttttggatacattcacttgggtttctctctgatcgcttgtccttaagatgtacagatattgtcatcaactttgctcctctgccttatcctaattgctctgatctcagtgttattctttcactcctttcttttcttcttcctcttgatactttttctggttttcctaacctaaaagctagggtaatttctttcacttcatactcatactctcagatgagtggctgtcaaactaactgatcatcagaattgcttatgctttcagaaattatggtttgatgagtctcactatagacttactaaattagaatctctggtgatgaagtcccacaatctgtatatttttaagctctcttactcttttctgatttgagggtactactagagattctgtctctaaatttctgtgcctaccccttcattacattgcaggggccactcctatgccattcccctacctcaggccttcattactgagaccacagcaatccttccctaactggtgtccctgcctctagcattctctccaccaacctattttctttcctgtgagtttaagctatgtgaatatgccacacctcttctccgaaatttaaaatggcactccatttttctgtaaagtaattatgtattgtttaacctggccctcaatattccttcatgacctagtgctacaaacatctcgttactcaccttcatgggaacctttaacaccagccaaaaggaacaacttacagtaatttatgcatttgctttttgcctctctttatgctgctctcactgcctttgcctcaatatttgtatgttcaaatatggcccatcttcatggcccagccaaaattctttcttctttccccaaagttccctgataatcatcaataggaagaacctcttgttttccctgaatttttatgtaacttttataaatctctcttataatacttatctcctaccttttcttatagggtatatacaaatatatatgtaatatgcacaactatataatctttttgttgttgttttttgttttttgagacggagtctcactctgtcgcccaggctggagtacagtgcactcgacttgatcttggctcactgcaacctccgcctcccgagttcaagcgattctcctgcctcagcctcccaagtagctgagactgcaggcatgcaccactgtgcccggctaattttttttttttttttatggtagagatgggctttcaccatgttgaccaggctggtcttgcactcctgacctgaggtgatccacctgcctcggcctcccgaagtgaatgtatataatcattgagagcagatccagatgtaattcaacattttatctatcacattttatctaatacattttgatgctgaagaaatatatttcttgaataacaaacagcagccaaagtttatctggaactgttcgaagtgttccacttttcaaccaataaatcctcacaatccacaaaaccttatttgggaggcactaatagtatattcaatttacagatgaggaaattgagcctcagagcagttaagtaactaatacaaggtcacacagctagtgaaggccctcaagtagcctggttccagagtccatgcttttaatcattctgcctttttttgtgaataaattccacccagtcatattttttaacctcagtgcattttttaacatttaattggctgagggcttatattcaaaagagatctttttcttttaattgaatttgacagaggcaagctttaaattttatcataaatagccttcgagaaggcaaataatgtgatttacaattaggattcatcaacttcaaggaagaagtggaaatttgcttataggaaaaatttaaatgtgttgcatagttacataaagctctgttgtacaattttatagagactgtaaaacagaatacttataaattaataagtaattgaaataaacatcatttgattcttatactcattgaattatacaatctccaagacatgtgatttccttctccccatctttttcccccaatgccagagtatttgcaaataaatatttaatccatggttatattaaagctgctttgctaccatgaaaaaaaattttttttacaaacatctttcacagactttgtaactggacaaactccacccggtaaaaaaataagtgcatggaaacaaaacaagaatgtagcaagatctgcctagtttattaaacatgaaattgaatagtggaaatagctccatttgggaagcttaggaagcatagtgaccaaaaaactgtatggctgctcattcattagtcttaaactattaatgtcaaactcatagtacccagagttaaataagattctgatgcttctactcttaaaaagaaaaatggaagcatgtagttatgagcctggggcaaaaagaagctctaatatctaccatatatttgctaataatatcagacacacctgtgaaccagtttaaccattaacaatttaaactctacatttaaaaaagagaaaaaaaatcctagaattaaaatatcacaaaaattaaggtctacatgtaatattgacaagcaaatacagaaatcaaatttgatagtctatcattgggcacaaatcactttgatcactaatatacaagtattagacagcctctttctccctagagtatatacatagcattcaatccaggaattgccttttttttctgaacaccattgtttcccttttttttctctgtaagggcttagtccaatgttgctagtaagaatgagcaataagatattagttcactcccttatgcattaaaatccctgccacacctgtgggtattgtgccattgtttaaaagggtaataataataagcctttatataacacagatatcaaagagctttgtggtcagtcgttgttgtacatgcctaaaaacagctctgcgtgagttttgtatccatttgcttaattaaaaatataattatttaacaacagagagtaagtaatatacatacagctgttgggaaataccattatttctaagaccagacaatactttgataatctgatagctgttgggaaaagagatgcagttaatcacattaatagagagtcaaaggatttaactcaagtagaccttttagaacagtgatatggcaagggaagtaaaaaaaaaatcaaatcaaattttaaatttgtattacagttttgtgtgtgatggttagagaaccaaattaaagaaacaaaggcagctttgaagtatgttggcatttatccagattgagggtctatcagaaaatagttctgggaactgacatttatgataactcattcaaatattttcttgcacaattagggttatctttagggttaattttcctgagacatcatgccatatttgactcaagatttcagcattgaatttgagcctattaactcttaatgagtgctaactgatgtcttatcaaactatctgtaaaagataactggctattcatggccaaatacatagtcatctaatgtccaaaaattatgagaccatttagccagattcaaaatacagacataggcaagtttaaagatgcattgtacattttcattgtattacaaaagttaagtgtgttggaaaattgctgttagctgcctgagcatgcctgtagctgagttttgagctccttaatagctgagtaactggtaatgtagttagaaaactaggttaagccagtcttcagtcattagttggctgacttcatatttgttttagaactctaatcttctaagaacttgttttcataattccaccttatgaaacatttatgaaatgtgtagaaaattactacgacagctgtaaacccaaatgataattccctttcccatagtttcaataatttttttcttcactagaagaaaacagagcacttaaccttttccttaagaatcacagatctatttgatcccccctcagcaaaatattatctggcacttttgaagtacatggttcaaatagaattactctaataatagtttttgcgaggtctgtgtgggtatgtctcatctaacttggttattctccttagattcaaaattatatcctgcaaattgaaaattatatatagcttttgcaaggcaagaccataattctaggcttgtaccatttttttttcaaccccaataaatcacattcaaagtagacctgacactggactgtcttttagcatccaggagagccctaagtcagctcttgacaaagtactgcgttttaagttcccagaaaaccttgagactccactgagaatttgctcacattctcctctttaaccctggaaaatatactctaggccaatactgattcacttctctgcctgcagatctagtgtgtcacctgcacagatctttccaaatcatgcttgtatccttcacatatcagtaagggtcagggtaaatccatgtcagaaggtagtcggtggaagcctccactgtggttatgtttactgttcctacctttacctctaaagtacaagctgcttaaattaccttctaaagcaaaaatttaaaaattgtgggtcacacagtgcattgatgagtcccactgccaacctattttacatggaataggatggcatgggagagagtagagtggatgggataggataggataggataggaatcaaagtgtgtcatacattaacttgggtttcataaaagttttctttcaagattgtgtagttcacatgtaaaatgcatttctcaccgtggtttgtggtcagagtttgaaagtcagtattatacagtaaatttgacttctcaatggccctggaattgacatatgtctatggaaatcttagataaggtggattgtttctgggaagcattcaatgcttgcagcacactttttctccctccctctctttttccctcccattaaaaaacaatcccattgaagtgtctctatgggaatgttactcataggcagctttgtttacaagccacaaactcaaattttttatcaagctcctgcagcccaaaagcaattctctccctgctgtgacatccacatttctctgtgcaccttccctactctttaaagagtgaaggagatagtggggttacaatttcttgtcaattttacttttaactgtagcatgtcttgtcaattttacttttaactgtagcatgtcttcttagccagtcccataggcctttttttaattcattaaactagaatcagaaactgtcttttttaattcattaaactagtgcttgagaattatctcaatgcttctgtgagctcacattctaggagagtattaaacaataaacaactatgtaaattgtgttaggattctccatagaaacagaaccaacaagagatcacctgcagattggagactgaagaagctggtggtgtatttcaaaagcctgagaggcagaggtgaatggtgtagatttcagttttagttcgaaagcctgaaaaccgggaatgctaagggcagaagaaggaatgttccagctcaagcagtcaagcagaagaaaggtgaagctagccttcctccacctttttggttctattgaggcccttaaggtgttgggtcatgcccacttacatcagggagggccatctgcttacccagtctgcgaattaaaatgcaaatctcttttggaaacactctcacagacacactcagaaataatgtctaatcagatatctgggcttcctttaacccagtcaagttgacccataaaagtaaccatcacataaatcatatagtaagttagatgtcagtaagtgctatgaagaaactgagttagaaaagagagagtggcagggaaaatagaagatgctgagatgtccttttttttgagataaagtcttgctctgtcacccaggctggagtgcaatggtgcaatcttggctcactgcaacctctgcctcccaggttcaagcaatttcctgcctcagcctcccgaatagctgggattacaggtgcctgccaccaggctggctaatttttgtaatttttgtagagatggggtttcaccatgttggccaagctggtctcgaactcctgacctcaggtgatccacccgcctcagcctcctaaagtgctgggatcacaggtgtgagccaccatgcctggcccaagaggtccattttaagttggttagtcaggaagtttttggtgacagtttgaatgtgatagaacttcaggtctgcatgctgaaaacaatactcctcaaagtctaggcttgcacctgattacatcaggataaacaaaagggttctatagccaaacaaatatgggagattctggtatatatataaaaaacttaaacatgtttctttactatgtgatactttagaacttcaaacctacaaaggaagaaatagaatgagacaagatgagaagcagcaaggtaatgggaatggagggaaacttaggggcagagtaagaaaaataaagttggaaaactatagaagatgagagatgaagtcaattaaatagggccatggttgctctttgaaaaatactacccatatgagaacaatacaagcaacaattgcagggtatctatagccatgtgctcttttcctaacgtgactaaactgatggtggtgagaattaggatgatagtagctagtgcttattgaacatgtgcctgatgcccggccttgtgctgagtgctttgtgtgcatggtttccctctctggagtgcagatccacacaggtagaggctgcctctgccttggctcatctctttacttccagcgcttagcacagtaggtattcaataggaacatggaatttgtcttatcagcattaactaatacttaccaaattgatgcatgaattattaaaatttctacaattatcctttattttttatcaggacttacggtacagagaagttaaggagtttggctgaggcccacccaacaggctcaaaagtgatagaattggaagccagatgcagatctatctatccctcgagttcatcctcattcagaatattgccacagagcatttattttcctccatggatcatatcttaaacgactagtgtaccttagacccactgctgcaaagcaaattaacttttccctgaaatgcattctcttcattcttgtactttcgaagtccagggcttctctaaaaagaaattcaagctttcagatgaaaagagcagcagtaaaaagcagggtcatatcgacaagtcacatcaacaattcttttattgaacaaacattaagtgacttacttatgccagaccatgtgctaggcactgggaatataaagataagtaagatagactgagttagtgcacttaataaccttggtgaaagagatagacacgtaacaagtaatgacaaagagatacaggcatgaagaaatacagtgtgctcagggtgcctggaagactagagagcattcactgggaagtaggcagggactggtggtgaggtttatcttttatgatatgggaggcagttaaagggtttttagcctttaaatggcctgatcatatatgaaaatacatataaacatgaacttttaaatattcatacgtgtgtatcacgtgtatacatacgtaagttttttttttttttttttgagatagagtctcactgtgtcacccaggctggagtgcagtggtgcgatctctgctcactgcaacctcagcctctggggttcaagcaattctcctgcctcagcctcccgagtagctgggattacaggcatgcgccaccacacccagctaatttttgtatttttagtagagatggggtttcgccatgttcgccaggacagtctcgagctcctggcctccagtgatctgccagcctccacctcccaaagtgctgggattataggcatgagccactgcacccagccataattttttaaaagatgtttctctgggccgggcacagtggctcacgcctataaacccagcactttgggagactgaggcgggcggatcaccgaagtcagtagtttcagaccagcctggccaacatgataaaaccccatctctactaaaaacacaaaaattagctgggcgtggtggtgggcacgtgtcatcccagctactcgggagactgaggcaggagaattgcttgaacccaggaggcagatgttgcagtgagcaaagatcaggccactgcactccagcctaggcaacagagtgagagtccttctatgtaaaaaaaaaaaaaaaagatgtttctctggccataataggagtaggagggatgaattggaacagacagctctacctacgaagctgtcaaaataggttcactaaaagagatgaagtcctcaggaaagacaatgttctaggaaggattgtagaggacaaatttcagagcaacttagaagataaaatagacaaaatatgttgactaatttgatgcagcatatgaaggaaaatggggcatcagggtaaatcggtgcgaatggtgataccagtactcaggaggaggaaaaagtgtgatgagaagagggatactaaattcagctgtggaggaactctgtttgaagtggtttggggatctccaggcctggagcttaagagaagtgaagatgcagattcagaaagagttggccctaatgtgcttggaggaagataacattggagattattaatttaggaaggatatcttaataaaatgaagaacctggcacataataagtgttgatagagtctagcctgctgcaacaaatatttgcaaccgtatctggagacagaggccaaaggacctagagtgagtttcttattatctgaatgggttttcaagagctcttttggaagtgagttggagaactgctgaaaagacaaggaaattctaaaattagatctgagtatagaactaatgactaagggttaggaatgccagctacccaaatgaggtggagggtgtttctttgaacaatttgcaaacccagtattttttttttttttacacggggtctcactctgtcacccaggctggagtgcagtggcacagtcagctcactgaaacctccacctcccaggctcaagagagcctcctacctcagcctcctgagtagctgagactacaggcatgcgcttccacacttggctaatttttgtagtttttgtaaagacagggttttgccatgttgctcaggctgaccccagtctttaactttgttgttcactctcccatgcacagtatcctcatggtgatttggcagttctgtgaaatatgtgccttattgccttcctgtatgaccctcagtttatttgctgagaacagtgggggctgactgctgcggaactggtgttaatccttgtcaggaaacctcaaggacaccaatattttctcaccaagaaaatattcagatcacggaaacatccttgtctctaagtatctgtgaatttcagaataaagacctatgttttagaaataaggctctttgatacccttttgtttcaatctatctttctaatttaaaaataatgtgtgcctactgttggaaatagatccattaatatctttttatttaaattttttttttgaaatagtttcactcttgttgcccaggctggaatgcaatggtgcgatcttggctcaccgcaacctccacctcccaggttcgtgtcatgctcctgcctcagcctcccgagtagccaccatgcctggctaatttttgtattttaatagagatagggtttcacattgaccaggctcatctgaaactcctgacctcaggtgatccccccacctcagcctcccaaagtgctggaattacagacgtgagccactgcacttggctgatatcttaaatccacattttttcacagttgtgttctatgttttacattgatgggtttgttttagtagcacattccaaattgttagtatcagaaggtcagtgaggtaaaattaaaacaagtactttggaaggttgtaaacatagaataaatttcagcttcatgtaaatggagtgtgatttccataataaagccattattgttgtcagtggtgcatagcaataaagccaaggctgcaattacaaagaaaacagataatacaacaccatactttctttaaaaatggcagttaaattcgtggaaataatatttttcactaaaaataaagagatgtgatgtaatctcaatggaatctactaactcccatgagtagactttcttaatgatagtagcactaattgacgtatctacttgctggtttgttgtttgttgttgttgtttgttttgttttctttgcctttccagaagtaatttctttcactaaaaccttttcaaactattttggttttcacattcgtgactccttgttaatttaagtatgtaaattaagtactgtgatgatttgatttttttttctccctgcagtggaacttcatcttgacacagcctgagttacttggcatagtcttttttcttttttgttaattgtagtaaaatatacataacaaaatttagcatcttaaaccattttaagtgtacacttcagtgtcacataagtacactgacaatgttgtgcaactgtcaccactatccatgtttccagaactttttcatcactccaaacagaaactctatatccattaaacaataactcactattctgcactcctcccagcccctggtaacttctgttctactttctgcctctgaatttgcctattctaggcacctcgtgtaaatggaattattatttgtcctttcatgtctggcttgtttcacataacattttcaagggtcatccatggtgtagcatatattataattttattcctttttaagcttcagtatctcagtatgtttaggctattacagaataccctagagcaggtagcttacaaacagcaaaaatgtatttcttacagttctggagacagaaagtccaagatcaaggtgccagcagattcagtgtctggcaagggcccagatttctggtccatagatgatgccttcttggtgtgtcctcacatggtggaaggggcaggacagcaccctggggcctcttttataggtgcactaatcccattcatgagggctctactctcacaacctaatcacctccaagcagtccaaccttctaattttatcattggtgattaggtttcaacatataaagtttggggggacacaaacattcagaacgtggcactgactaatatcacattatatgcaaatagtatattttatttatctattcatctgttgatggacatttgggttgtttccaccttttggctattgtgatactgccatgaatattggtgtgcaaatatccatttgagtacctgtgccttcacttttttgaatatatacctacaagtggaattgttggatcgtatggtaactctgtgtttaacatcttgaggttctaccaaactgttttccacggcagttgtgccattttacatctctatcaggcatgcacaagggttccaattgctaaatatgctcaccaacacttactatttcttgtttttttgataataatcattctagtgggtatgaaatggtatcacggtggttttgatcttcgtttccctaatgactagtgatcctgagcattttttcatgtgattattggccatttgtatatcttctcaaaagaaatgtcctttgtccatgtttcaaatggattgaatgggtattttgttgttaagttgtaggagtcctttattttatatagcacagtcttatatagatactcatttcttgggtgcaacactgtgtttttagggcctccttttattgagaacattgaaatgattctgttttatcttcactaattcactcctaaacacaacttgtttccaatattaccaattacaaatgctttctttggtaaatattgaattatagacagcagagaagttattagtagttcatcaaatgcgaaataacagcttaggaaatataaaaccaaagtgattttcaattgaatggagcactgtttttcagtttgccaaatggaatttatagtcactgtttaacaacaacatgccccccaaccaactttcatcaccatcaccccctcccaatacctctttccttttgacttaggccctaaagagggttaaaggtgcctcctcagaggcagattaaccataaagctaacgtagcttaagtttcaggtcctttcaccagccttggccccttccaagatcctgcacctaattacggttttgtaacttttgttttttaaagaagcctccctaatataagcttcaggcccacaaaatctggatatgcctctggatatgtttcttctatctgaaatcatcatcctaatcattgttgtacttctggaaggcaagcctgggatctattaagtatgctgagttatttatgactagctttttccttacggagtttctagtctggggtgccaaactactatacttttctgcagaattccaggaaaatataagccatggacattctcatgagccccagtatgctcccttagcttctccactaagctctgtcagcacataccactcgctttgctctaagcacttagatgaacatgcaggccaaactttgaaaattggttcctagttgttcatacaaaatgtgcatgtccctttgtactccgcccagagccataaatagaattttgttcttacacagtggaagaaaagaatgcagttgccagacttgatacctaatctttgaaaattttgtgagcacagcttaggggttttctaaatattagggtatcttgtcagaagtaaaaatgagccttctggccctttagcaaattatattatttcattaaataaaaatgaatttttctaaaaattaaataaatcttaatgtatattttcttgtcctgctgcaaagcattagtgacaaagaaattattcatctacgtaaatcttcttgtattagtcttactttccctgtacagttataataataattttgacaatttgtatatattgtgatgaagggcatatatcagcacggtcccttctaaagccttatttctctctcaaaaaaaaaaaaagtgttcgggttccctttctcctcaccacttcctttctccctctttgcctcctctccttgttctttctttttcctccctttcccgaacaattccatctacagccaccaggtagtacagagcaaggtgtgcatctgcaggaaggggcccaagcctcggtgtcagaagccaatcgttgtgaggaaggaatccatgtgaggggtgcagtgctgcccagctggaattgtgggacactgagtgagtttgggaggccacctgagcgagggaatgggtaacagcaataggaagttggttacatgcaggggagtggatcgaatcagtagatatattaagaataataagcaatagcggggtgcggtggctcacgcctgtaatcccagcatttcgagaggccgaggtgggcagatcacctgagtccaggagttcaagaataatgagaagtagatctcttaccaacacagaaaagttacaaatatggaaagggagaaaactggaattaaccccgtgatgttgggttggaattagaagcattgaaatgaactaatgaatttcaatatatagagatagatagagtaaaacagatctaaatgtgtttgtgtgtgcatatgcatgtgtatcctctatctactaagagagcttaggagcagcaacagcagtgaccatacctagccccagatcacagtttctaaataccattctcccctaaaagaaaccaggactggggcagagaatatttgaaacatcttgggccaaaaagcaaacaactgctagtagaatgatgaggatataaccaaagtcacagaaaccatcttgaaagggctcctgctagggacaacttggcatcgaaataaacaatgatagtggccgggtaccatggcttataccagtaatcccagcactttgggaggccaaggcatgcggatcgcttgagcccggaagttcaagaccagccggggcaacatggcgaaaccccatctatacaaaaagtacaaaaattaagtgggcgtggtggcatgcgcctatagtttcagctacttgggaggctgagaggtggcaggatggcttgagcccaggaggtcaagcctgcagtgagctgtgacaacaccaccacactccagtctgggcaatggagaaagactttgtatgaccctatgtgaaagaaaaggagaggaaaaagaaaagagaaagaaaacaaaaaaggaaagaaggaagcagggagggaggaaggaaggatggaaggaaggaaggaaggggaaaagaaagaataatggataatatgctaaataagcaggaatatattagtctacattagaagataaataagtggataaatcaaacatttgataaggaaaaagatatttacatagtttcaaagaaatgccacatataaaacttcttaattacacaggggaaaatgctaactttacagtgaagaatttgtgcagccatcatcttaatcaagtgaccaaaatgaacatcttcagtaacgggaaaaattgagttcttgcgtcaccttatagaatgctgtaagatgaactcagcatcccttctgtgatttctaacggcttataatctaaatctaatcacgagaaaaatcaaataaactcaaatttaaggacactgcaagaaaaactggctggtaatcatcaaaagtgtcagggttacaaaagtcaaggacacacagaagacccatttgggattaagaatctacgaagacgtgtcaactatacacgactggatctctggatctctctgctaaaaaggaaattactggtataataaaatggaatctgagaatgatagtactatatcagtgttaatttcctaatttgatggcatcatgtttatgtaggaaaatgtctttgtagaaaatacacattattcagagggtaatgggggatcagattcacaattttcaattaattcagggaaaaaaaaactttctcattgtactctacttgcacgtcttctgtatgtttgagattgtttccaagtaaaattaaatttgaaaattgctaaagttgtaagcaactgtttaaatttccatagtggacgaggattttaggtgttaattgatgatagtgggtaaagaagggctttgaggtctgtcatgaaagttgtcagtggtgtggtctaccctgatgtctttcaacagcttgaaaatgtgtttatttgtggctgcaaagatccgattcactttctaaatcttatataacttgtcacttaaatattaagatcgcctctatatggttattattctaaaactcagatagcaaagaaaactcaaaatagacaagtggaaagggtaataaagtcccttggccctgagaaaatctattctgaaaacgtctgaaacaaactgcattagaacatgtgtagaataagtttagttgatcattatgaatcagtcacttcatctttgctcttaaacttaccaataaattttggtgtcttctcagtcagaaaaaagatgtgagtacaggtttttccaacacacacacacgtgcgcatgcacacacacacacacgcacacacgcacgatgttatataatttctgttcttaagtgcctggttggaatatgctaatttcgggagcacactactgcctgccattttctggtggaacagtcttttaaggagatttctacaaatccattgttgctttgtggtacttactgaacagtccagcaggtggtagtctaggagaggaacagttctcatcctcccccagccatccctgggcctaccagcagccccatttgcaaaacagaatgtggactcagcaatgtgccttctcccctctggcataagaatgggatttccaaggttgttctctcaaaatgggcactagaataccacagaaagaagccaaaaataactgtgtatacatgtgactgtgcagtattctgaagctcaaaaattcttttttttttatttctagaaattccactgattttatatctctttgctctgatttccgtgacatggctttggggaggactacacatggcctacagacacttctggatgttggttctctttgtcattttcaacagtctgcaggtaagccttacaatttggttagtgacaacatacatttatcttaatgaacacaaggcatagaatttcaatattaaagagtcaagcatccacacacaggtgaatttgtgtacataataacatcatatagagttgtaaaataaaatgataggaacctaaatccttaacatttgaaatatgactgggattctaacttgctcattatacaattagggaagacaaaatatttattctccttcattttgaacatcgaagtaactacacaaacatatttctttttcagtaggattgatgtttatcaactttgcaaatggcagtcatgtaagatcaatgcacatatttggattgtggctgggtctagaaattagatcaattgaggagtgaaatagtgatgttcaagcagtcccctcttaagtgtgatgcttagtgaaatgagagtgtttggttcactaaaacatgactgacatcccctaagtccagcagtgcccagcttaaattagttttataagcatgcttggataactagaaattatataactgcagcaaaaatgaaagctgagatttttagtacttttgttaaatggaaaaatgttgcaccctgatattaacaaatggaacaaatgaacacattttccttgttttccaaagtgaaacgatctgtcctagactaaaagaatttcttaaatttattaaattatctctaaatagtccttcttttggctaccatcttgcaaggatcatgtgtggcaaacacacagacatatacacaccttcagaattgtagcatacaattgaaatgtgactccagtcattttttaggtttgcacctgagcagacaaactcttcagttagatcatagcttacatgatggtgcctaatcaaggacattatcaacttaggaaggggaaaatacaaaacaattaaaagtttagaaccaagttgctacaagtttctatatagacaactgtctgtggttatagttacaggtgagcacttactattgccaggtggtaaagaagacagtccggcctctctgggatctgatgattcaaagagtgaacaatcagctctaagaatctagtatggcaggtgccatgtaaagagagcattttgagagtgagtaggggcctgttgaccatcagggcagagccatcagggcagaggctcagtcttggtcacctttagatccctagggcctagtggaactaagaacaaggtccaaactgacagcctgcaggtgtgttttgcttggcagacacacagtgttatatgaaagattgttttagattttcaaatagttgcttcaaacttttaaaattgagaattttcacattaaaaacctgaattgctggctttttttgaaggcagtatttgcatggcagcaatttccaagccctgagcagacctgatatacttcattcattttacttgcccctgagattatgacacatttaatgcttattaaataataaatgagtgtatggttagagatgggaatttcaggcagagaaaactgttagccaaggctgcaagaagggaaaatgactaatctcgcctagattaagcaacgtgttgagaaggaaaaagaaaggtcttgcaattagagaagaagttgtaggagaggagacagaaagggtagattggtttaaacgccggctttccatgcttgggatgctgagcttcaatctttaagcaaggggaagccatcgaagttgtgatttttctttgtattgttctaatttttttaattttgtcaattaatttttttttcattttgaatgggatgacatgtttgtactggaaagataactggaaatgtttaggagaggatattgaaaaaaagagcagctctaagtaggtaggttattgttatatttcagactgtagatgttctggcagtgtgcctgggaataaaaagtaggtgacaggtttgacagttgttacagagataaacacttttcattttattgtttaattgacacataataattgtatatttatgggtacatagtgacgtattgatacatataacatgtagtgatcagattaaaagaattagcatatctatcatctcaaacattcatcattactttgtgttgggaagtttcaatatcctccttctagcactttgaaactataaaatattgttaactatagtcatcctgtagtgctatagaacacaagaacttacttcttctatctagctgtaattttatatcttttaacaaatctctccctatcccctttttccccctacccttcccagcttctagtaccctctgttctactttttacttctatgagatcaacattttttagcttccacacatgagtgagagcatgcaatgtctaactttctgttcttgggttatttcacttaccataatgtcctccagttccatctatgttgccataaataatattgggttgatgcaaaaataattgtgatttttgtcattaaaagtaatggcaaaaactgcagttacatttgcaccaaccttttcttttctttcttttcttttctttttttttttttttttgagacagagtctcactctgtcacccaggctggaatgcagtggcgcgaactcagctcactgcaacctccacttcaggctcaagtgatcctcccaccttagcctcccacgtagctgggactacaggcacatgccaccatgcctggctaattttgtttgtttgtttgtttgttttgtagagacagggtttcgccatgtttcccaggctgctcttgaactcctgaactcaagcaatccactcatcttggcctcccaaagtgctgggattataggcatgagccaccgcacccagctgtcattcttttttatggctgaatagtattccattgtgtgaatttaccattttccctgtccattcattggttgttggacacctaggttgattccacatcttggctattgcaaatagtgcagcaacaaacatgggtgtgcagatgtctcttcaatacactgattttctttccttaggataaatgctcagtagtgggatggctggatcatatgtagttctattggcaattttttttacgaacctccatactgttctccatagtggttgtactagtttatattcccaccagcggtgtagaagagttctgttttctccgcatcatcactagcatttattttttgtctttttgatgatagtcatcctaactggggtgagatgataattcactgtggttttgttttgcatttccctgatgattagtgatgctgagcatttgttcatatatttgttggtcatttgtataactgttcagatcatttgcctgttttattcagattgcttttgctgttgaaatgtttgagttccttgtatgttctgcatattaattatctgtcagatgaatagtttacagatattttctctcatcttctaggttgtgttttttactttgttaattgtttcctgctgtgcagaggctttttagtttgacataatcccatttgtttatgaaataagcattttataaatgctttagaacattggtctagggaaagattttataaataagaatctttagatttttataattttataaatagattcttattatatttataaaccttttatttatatttaatagcctgtaaaatcttttatttatatttaatatccttttatatttataaaccttttataaatatgaatctatttataaaattataaagtgaagcatttcaccttgttttcttccagtaattttatagttttgggtcttacatttaggtctttgatccattttgagttggtttttgtatagggtgagagttgggggtctagattttttcttttgcatgtggacatccaggtttcctagcgacctttattgaagagactttcctttccccaattaatgttctagctgccttctgtcaaaaatcagttggctgtagataatgtggattaattttgtgcttctctattctgttccattggtccatgtgtctttgtttatgccaataccatgctgttttggttactatagctttgtagtatattttgaattctgatagtacaatgccttcagctttgttcttttgcttaggattgctttagttatttgaggtcttttgtgattccacacaaattttaagattttattttatatttctatttctgagaagaatgtcattggtattttgataggaattgcatcaactctgtagattgctttggctagtatggttcttttaacaatattaattcttctgacccatgaggagcatgagataactattaatgaaatttggttaaccaattaaatataggaaggtaaagtgtgacagaggaacatcacttagaaattcctggtttgaatgaatggctgggcactgacatctttagtccaaatggagatcacataaatagcaaggtctagggaataagcagtgaagttggtgaaatttaggagacgttgctaaatactgtataccaatgttttagcaactgggtacagagataaggctaatgaaagaaattgttaatgagtgatcagagagctaggaagagaacctggatagggtttgcagttgcgggtagaaaagaaagctcaagaggacgcaatgcctaactctggctagtgtagcagagaagttaaataggatgagaactgaggagcaatgcggtctacagctgtggttcccaaaccgttatgtgtagcagaattccatggggagcttgttaaaacacagatgataggccccacacccagagtttctgatacagtaggtctgggtggaatctgatcatttgcatttctaataagtttccaggtggtactgattcggctggtctgggaactacagtttgagaaaaaaaagtgaaatagagactgcaaagagagaaagaaatagcttaggaagggaggttggttggttcaaaggagattttttggttttgttttctcgtgacaagaaccaacaaaggagaaattgacatctggaggaaagatttgttgccatggcaagatcatggacgaggcaggaagaacagaagagatagagggcttctctgagggaggagtaggaatgtttcgttttgttttgtttttgtttttgtttttgtttttgtttttgtttttctctgaggctggggaaagaaaaaatgattggtgaacatgaaaaactactctggagctgaaagtgtggaatgttggcatttgcatgtaatgccctctcttttctcttaaaggcaagaggcaaggtcatttgttgagaggaatgggttcaaagcatgagataaaaattttaaaaaggtatggagcagtttctagacagaacagaaataacttaaactatgttgaaagatcatcaagaaatggattgcttagagagaaatcagtgggatccaatggagattagacaacttaaatctgtaattgagccagtcagcagtaattaaataaatataagccttaggattataatgatagcctgggtaacctatcaaatcacataaacaggaaaagtttattgagctcttatggaggtttgtaaagaaaggaggactgtgacacataatagtatatgtcactggtacatataagaaaaaattttggtctctttctttgaagaacttattagaagctaagaataagtaaaaactaaaaatattttaaactcatgtttaatgagcttaattcaatccaggtgacattactgaagcagcaatgattatttgtactactgttggttgttacctggcgcactggcacattcctggtaccagatgcttagtgaatcagtcctaaaagtaatgcctattaagaaacacttggaaaatatcctttctctggagtttattttggttcatttaacttaaaaatcgcttgaggtattcagtttaggcatttccatggaatatggctacatagtattaacagtaagattttttaagtatgttccataaacacttgtttgtttttttaccccccgaatggctttcatatttctctactgattttatcaacacctgtgaccataaaagcatattatgtatcttatacttgcttactacattttgctcagaggagattactgacttactttttatctagattattatgatgtcataggtgctctaaaactatgattgaaagggatggtatttgtatagtattctgatcattttaagttttttaaaaaatatttttaaacacacattctagaatctgagatctcaggatctctagccacctctgtcctctttctctacagtcttttttttcctttgagacagggtctcgttgtttctcccaagctggagggcaacgacgtgatcatagctcattgcagccttgaactcctgggctcaagcaatcctgcctcatccccacaagtagctgaactacaggcacataccaccatgcctggctatttttttatttttatttttttgtagagacaaggtttcactatgttgcctggactggtcttgaactcctggcctcgagtgatcctcccacctcagcctcccaaagtgctgggattataggcatgagccactatgtgtagcctgattttttgatatttagtgtctgatgcactttaagtaagaaaatcttgatcacttaaaatattatctaaaatatttacctaaaatttatcacttcctaaaatttcaaaggtgaactaccaaacttacaatacatttgcacatttaggaaaatgtatgtgtaatattttgcaaagcattatggatacaaatgcaaatgtaaggtttaaaaatcatcattctaaatgtttactgttaatttttattgttgaatactcttctttaaacgataaggacttcttctcgcccaagaactgaacttttactcaaattcttattggtctatccttattatttacattttcttgatagtttaaaaaattaaactgttggatatcaagagtgagcagaacatagagaatgaaggtgaaaatgccctttcagtttattcaatcagaattgtttcctaattccagtagctactatataacatgtgagcatgatcatgataattgtgtttttgccacttccccatgatgtgaggttaacaaatcctgattttcactgtgctttattttatgtcaaaagagggactctgacttcaagagagaagaaaagtacttttgtacttacatgcctactgagcccagattccaaaggccttggggttctatgtttccttaacactgaatgggctttccaagtgcattgatcatggtggctgccacggtgcaagactcacctcctgccagctttccagccccagcaggaaaaagcttattcctagataacaaaatcctatggaagaccagatggtaccatcctgggtcacatcccatgcaggaacaaatcacagggtaacagatactctggccaggcctgggtcatgaacagcatccaataatggaaagagtcaagttggtttcataaaaaaccacatggagtggaattcctgccagaagaaaggattctctgaccaacagaagggggcaacagtgcttggcaggccaaagtaacagacgtccactatacttactttctaaatttgcttgttcattgatataagtttgaacaaggccaatgacagcttctgtcacaaaactaggaaactttatcagtgtgatttcagtttattagaatagtacttgtgatctatcatataaccaaatgtctctatattgtccacaagaaattcataagaaactatgtttaatattttttattttcccgttccattaatccaataacctctattttaaaaaaattgagttgagtttgtcatttctaaggggattcatgctaatacttataggtcataagtttcttaaactattcaggccaaggtatatccaaatttatatcatcatttattggtaataatcacctggggtttatactcagctggtaggccctggcagaaccctatcagttaaaatattgaaaatagctactgtccaaaccttgcaggtgttccaggcttccatccactgaggttagaagcatctctaggcttcctgacagggatcctccaggatgctagtgcagcgctagacctgcagccattctgattgggcaatgcttatgccacactcattattaaatattttgcatatcactcctagctctaattatgtgctgaaatattctttttaacctgaaccagtcagattcaggctgaaatacagcatttatttcaggttttcttctaggagttctctcacacttactgtgttagaattttactgacaattttctcacatgtagagagaatcccatgtaagataatgagagtagccagcagtaatagacatgagctgcttggagatgctagaaaatacgtttgtggagaaggttcatatgcatagaagctttccaaaatctgaaacgcattcttcttggaatgcttaacctggcaagtgagcagagctttgcacagtgttgggatatgacacttctcagtatgtcagttatgagactgcattctccagagtactgtttgactgtttctctgtgactgacttgtacatgttcgtttgtacaagcatctggtctcgagatgttccctggcacgttttgaatcattccctatttcagagaggggagttacaacatggaatttgtagctaaaaatatatagtccatcttcagacttaaagagccagttggttaaaatcattttcattcctatccccatgtcttaagctgctaaatggttgggaaataagtgattgaaagatagcaacagtttcttccacctgttttttaaaaattgtcctttggtggtcactagagtgtcttaaacacataaaacatttctcttatttaaaataacaaacagttctctctctctcactcgctctcttactctccaccccaccctgccttttaccctttcttttcttgttttctatgtgtctctcgttgctatatgttgaatttcagttttaaaattaaagccatcttttatgaagagattttcccaaatgaaaatagtttttgaggtatcgtaagaaatggaacgtatttctttgctcatagaaaatatagattccatcccaaatggaatattggatcaaattaataatcccccttcaattcccacttagtatccagaagggttcagtgcaggtgtctgcttagatacagtacatatttagtcttggctgcttccttttgaggataaacagctcttgggaaatacacattgttaaataatcagttacagaggactaattgtttcaaggcactccctttgcagttgctttccaacagccaacagtaataagaaatgtcactttgtttccattggagactagcacatgaactattcatgaagagcggaaaagcagtcttcccagaaaaccctggaataaacatgtagaagccaagggaggctgggactctatcattgatttgtcccagagccatgtcaaattcagtgaaaaaaaaatcactacatttgttttctagagtgagaattcagagagactaatgaatgcctcatgcacctttcaaaacatccccaaaggtttctataacttcacaaataaatatatagaagctgagacaaggaggtgtacttaaattttcttaatcaggttatgcctctctgccccgtgttcagtagcatctgggctggtgaaacacctctgtgtttttgagcaacaagctaactccatttcacaatgagtgacagtgtctgacattgcctgctcattagcctgttgattgaccaggcatagttctttagatagactgcaggattttcacttttgtttcatctggattctctaaataaaagtgtcaaggtctgatctgccagtaaacatcttccacaaatatagttttagtaatgaggggcttgaacagactataccttttcatacctggctccctccttccaaacaggtgcctccatttcttctgctctaattcgtgctatcttttaatcttttaggtttttttcctgtgatttttccattttctgagcattctatgatcacatttattgcatcttaaacaatgtgttaataacatgcttttcctgggctctgtgagcctttactttgcctgcaaaaagatctagcacactccaatacttgaaagagcaaacctacaagatttaaactaaacaagatgcgtacgtcctctttaagagagtttgggagagcaaagcaaatgacatttgggactcgtttttacctggtcattcagattctttgtcttcatgttaactgataattttttccaggatctaaaactttattcttctctctcatattactcaaatgttggggtggggagaatacattttttaaaaaaaaactttatatgaatattttacaccaacattttgtaacgttcagccatcagatttagtagaaggtgcatgcagttaagtgtcaagcaacctctattttaccaagcaacgtgagttatccgcttttcagaggtgctgattttgcctctaaattttgtcctaaggattgtgtaaaaatatatgtgtataaataaaatctgtaaactatgcaatattttacaaatgcaaatcattatagatgaataaatgagcaaaaagaagtgtttatctcaggatatatataaagaaaactgagaggccaaagagctgagactgtaaacctagtctttgactcttctcctatggcataggctctccccatgaatgttcgcattcacccacaggtatttccttcgtgcagatcctgtagctcctctgtaactaccatcacattccttggtttgcagtatagatctgttgtatgtcattcacctgctttcagatatgtaccaaatgcctttaggctcaagcaggtaacttctatggctgaaatatgcttattgtgagactatagggatcagtggggactgcaaaagaactggagaactcacactcctcctaaaagcactcaaatgcaaatgaaaaaagcaaacactgtgcaggccaagcaaaagctgttgcaggcgaaatttccatggatggcagtcagtgtgcaatctcaggataagttcaaatttttccctcttaagagaatttaatttcttttggaaggcaaattgaatataggcagaccaccttgatccagtagaaaatgggtgtccacagctcaaagattaccttcccattgaggccttcctttacctcctctaagagagtcagttgttccataattatagtccctcagtatattctgtatatattcctaataaatcctagcatattgtatgattagaaaaagaaataggctgggtgcagtggctcatgcctataatcccagcactttgggaggccgaggtgggtggattccctgaggtcaggaactcgagaccaacctggccaacatggtgaaaccccatctctactagaaatataaaaattaactaggcatgctggcatgtgcctttagtcccagctactcaggaggctgaggcaggagaattgcttgaacccgggaggcagaggttgcagtgagccgagatcacgtcactttactccagcctgggcaacagagcgagactgcatctcaaaaaaagagaaaaaaaatgccaggtgcagtggctcacgcctgtaatcccagcactttgggaagccaaggcaggcagatcatgtggtcaggagtttgagaccagcctggccgacatagtgaaaccccatctctactaaaaatacaaaaaaattagctgagcatggtggcaggaggctgtaatcccagctacttgagaggctgaggcaggagaatcacttgaacttgggaggcagaggttgcagtgagctgagattgcaccactgcactccagcctaggcaacagtgagagacttcgtctcaaaaacacacaaccacacagaaagatggctgggtgcagtgggtcaagcctgtaatcccagcactttgggaagctgaggtgggtggatcacctgaggtcaggagttcgagaccagcttggccaacatggtgaaaccccatctctaccaaaaatacaaaaattagctgggtgtggtggcacacgcctgtaattgcagctactcagaaggctgaggcaggagaatttcttgaacccaggaagcggaggttgcagtgagccaagatcacaccactgcactccagcctcggcaacagagcaactctgtcaaaagaaagaaagggaaggagggagggagggaggaagggaaggaaatgggtttcaggccatgtgaaggttaaccaatctatttatagttttctctctcttgagacaaagtggaaatttgttgaggggacccaggactccagtgaaagcctattgtgttttgtagaaacctcccctccttgtctctgaactccattttttcattccccaatactatgagactcttgaattcattactgagcttcttagcttctgagcagctgctttctgcttagtccccatagcctttcctctcatgcacaggcagcttcagaagtggaacatgctgtcatttcctttttctttggaatcgtggcccctcaagtcttggctgccttggaggacttgaactctgttgtttgtctccccaaccctgtcagattcctgcaaatcccaggctgcaattttctgttcagcttctaggcatctcactgtaaactagaaagtccctcagaagaaaaaacaacgctgaatatagggctccccaataaatgggttttgcttctctccaggatcttggcccttcaactactggctgttttgaatactctctgatgcctttcaactcattttgttattgttcttgttcttgtgttattggttttgttcatgctcctatttttgttattgtgtaagtgtgtgtaaaaacatttttctccagtttacatagttgtactcaatgaggttaatctgatatacactactccatcagagccagcaacaaaaatctcaatacatttatttcaacaaattatatctaataattgttaacatatactgattgcctactaataaatgaagatacttagaggtgctgaaattcatcagatatttagtggataccttttaaggcatatactcctgggccggcatcctaagaacatcatgatgaggaagcctgtgcatgcaacatcttatggtcagctgatgaactgtactttttctcatatatcaccaaaactaaaacaataaatatggaagttgagtaagatcttagaatctgtaatccatcaattgaagattgagcttcagaaatgatatttcagcttcagaatgaccacacctatctcacaaaactgaaataaaacaatagggaaaacagactggccaggtgcagtggcttatgcccataatcccagcactttgggaggccaaggtgggcagatcacttgaggtcaggagctcgaggccagtctggctaacatggtgaaaccccatggctactaaaaatacaaaaattagctggacatggtggtgggcacctgtaatcccagctacttgggaggctgaggcagaagaatcgcttgaacactggaggcggaggtggcagtgagctgagatcatgccattgtactccagcctgggtgacagagtgagcttccatctaaaacaacaacaacaacaacaacaacagactaataacacaaagggcaactacaactaaaggtacttgcgccaaatggatagcactccaggaaacagatctgccttctcagaatatggatagaaaaatgtcaactacagttctactgaaaaaaatataaagagcatgaattcaaatataaactgaactttcttcttaaactctttagatagataggtctgggaagttttattttcagtcctgcagaataaaccaattccatgtcaccattttcctctgcaaatattttaaataatgttctctttactttgagaaatggcatgaaatagcaaattgaaaataccttgaaatacaaatcctgtcttattaatttttagttttgtgattgtaggcaaattatgtaatttctctgaaatgaggatagcactacttactttacaaggcacctatggaaatcaaccaaagaatgtgaaatttccagcacttaactggtgtgtattaacattaactgcctttctcttgtccctaatatgataccatacatgcatatgtgtttcatgtaagattacttcacatagtgtatcattgaaatcagttagcagtgttttctctaattcccttcagttagtctgattattcggtctcttcagaagcccaatgatgtcacaggctgcatttactaagctaccaactcagtgatcttatttgtaaataagacctcaatgtatgggtgctatataaatgtgaagtagacataaaatctgcctgttatatttgtcctttgttccataattaatgttttgggacatgttgggccagtaccatactgtcagtcttggaaactctcagttataaagtggtaatatagtcaagcattgcaaaaagggggccactaccctaggtggataatatttaatttggcatgtgatacttaggaagaaaattggtaaaatcaggattggctcattaccttcataaagaattttcaggaagttttgtttgcatgttgattgctagaatagggagtacgcagaggagtactatgcagagtcacctatcaggaatacaattattagctaagactaaataatagtaggtaagaagtaggtgaagtggaatgttaagatggtcatttaaaaaggtttgcaagaaaaatctaatatgtaagcatttgaggaaaacaaaagaatttgaattcatcagagtattcctcatagcacaattgattatcaaattttatagtaaaatttttatttggaaaatttgtaatgtcaaaaatataaagtaaattatacatagtttattgtttgaaccaatatcataacactggaaatcttatatttatttatttattcattcattcagaaacattaatctatccagactatgttcatgtatgtatttgtagactggttattctatgccctcaatatatattataataaaaatcagaacaagaacaataatattgattaagtgtttattatgtggaattgtacttatttcattaaatctttgcgacaacctgaatggtagggacttttattcctgccattttacacatggagaaacaaagtcttagagacttttaggcaaggtcacatacccaataacatatgagcagggattctataatcagtttcttcatcatgcactgcaacgctgaaagaagagtaccttttgtattatattggaaacctcagttttgccttttactaaaaccatttactcaaatactacactgaaaataattgaataactgtacaataaatagcaactcaagagacacaaataatcacttcatagttaaatgctaaactgatgatactgacaataattccctatcacttactctgggtatcattgggaaagttactcagtttctgtaagcctcaggttccctcttcaaaaagtgagaataataatagaacccaccttaggactaggactgttgagaggactgagtagtataaataatacatgtgaagcatggccatgtgtgcaaagcaggaacagtgctcagaaaatattagctactcttattgtcagggtggtggttgctatctagtgttatttgtaattattcttagcaataataataatttgataagttcacaggaatatctagaaaagtcagagatggctttaggaaagatgtggtccttagccaggctgtaaatgttaccaaatttggatgagtctagaggcaaaggaagtctcttcaggttcttcatatagaagtcatgaatgggaaaatgtacaaggtggggagagcatagttatccttgtctggctggaatgaagcttatgataggagaataaagggaaatactgttgaaaaggccttgggggagggggatggtcacatgagcaaagtctttgtgccacgctattatgggatctatttaaacagtttaaagtaattggcaaaaaaaaaaacttccaaaaaaattattttttgtaaataccataaccactgcaattattgaattctggccttttgcattctatctataaagacaagtccaaagacagccaccagggagtttattccgctggaggacagaaccattatcacggatgcttttgctccttccactgatactgactctgagaatgagctcagagcagcatgaaaggaatttaacataaataaataatacataaatgcataaaacacaaactgtaatccagagtgtgatcttcttgagatcaggggccatgatttaaaaatctcccatgcctctcatagttgtaacacctcttacagtgctaagaacctactgaattgaattcctcgagcactttttttttaagacactgaacaaatgagcactgaagtgaaagaactttatctaatccttaaggcatagagaatggcaccagtcaggggccctctgaacttggcactgcttgtatctctgtgaactcataggggattctctttttcttttcctgtctccatctctgtttcatcaactagaacttatcattttcttctcctttcaacatctgttttctattgcatcccattgttttcatttttcatctatcttgatcattctcatacattcacagctctgttagtaatcccacagataactatgtatgacttgttctctgagagagcaagcctttagcatacaaggactcaactctgctttgaaaaatcaaacaagtttttaaatccacctaatagtattcatcagggaattttttttatttttagagacatggtgaattttccaattcagtaagagcaaaaagaaataataaaacacccagatttgtgccatttcagaatgccagtgcacattcctagtggcagttaatactggcaggtgctgtgaggaatcatacataggcaactgggttcctgaagtcagccaagagttgattgcttatgtttttagagctgtgcgaagaagaaaaatgtaggcacaccactgctgtgcagtccacgggagtcttacagctgcaggccctgaagcactttgaaaatcgtccctaattgtcttttgcctctgtgttaccaacttatcgcctacccccatggtggctttcatgctgtgtgtcaccaaaagctagcctctgctattttctaaggaaggaactggcagctgttccaaagatgaaatctaaatgtaatctccatagttgcaggtagaagcaaagtaaatgttttagaacttttcttatcttgacttcaggcatcatacctcatatttatcaactttgtagccaactttagggcaaacattaagaaataaaaaaccacacacatccacttctcctttggccctcaaaagtctctccattggcatgactttgtatctttatattggcaaatacttggctcaattatagaagttatagatcttcctcactagcacaagtcttttccagcccaaacagctattggatttgcagacagaaggacagcagagactgcagcactttggctttgcttggcctttcggacccttttggcaaaggaaaatggttcttactagtgagtgcctatccagccttaggcagctcacaggcaagtagaaaaagtgtagaaaaggtgagactagtaagaacaaaatcttgctagagagctactgacaagaacatagcacttacaccaggtgatcacttggatactcagggtgattacaccagacgctgcaaactcctttgtctacaaaggctggaagcagactcgcctggagcacgtggtcaagtgggactgtgtcttgtaaagagggatgaagggagataaaggggcaacagctatgtggcttcggttaaacatttgctggacaggaagcagatccagtgtcagccagatcttctgatttttctagagaagccagaaaccagattttttatgtgaaacctcctaatttgtgaatggtggcaagtatttaagacaacttttaaacactatgtgggccagtcacaaactgtcggcaggcagtattcaagctgccagtttgtggcctctggcttacctaataggcattccctcatagtccatgtggatcaggaaaaagaaatttttccagctttgtctatcttttacaaattttctacactgaacattttttttttctaatcagagttgttttcagagcttttggaccccttttctgaacatagtctggaacaaaccccagctcccagggtggcctcaggatgatccatccccttgagtgacctcaagtccatagctgatctgagaagagaggagggagagtctggacattcggggcctgttctagactagtacaaaacactgggctccacctggctcagtactacagatgcaggggaggcaaaaagtcactcattctaagtcaggccagaacctctttagctgtgcttggcaatgtggagtatagctgtacagaagggaatgagatgctgtgggagacagaagagatatgaaagtatagaatggggccaggcactatggctcacgcctgtaatcccagcactttgggaggccaaggtgggcgggtcacttgaggttaggagttcgagaccagcctggccaacatggtaaaaccccatttctactaaaaatacaaaaattagcctggcatggtagcagacacctgtaatcccagctactcgggaggctgaggtaggagaatcgcttcaaccctggaagaggaggctgcagtgagccaagatcatgccattgcactctaggccgggcaacagaataagactctggctcaaaaaataaataaaaaaggaaagtacagagtagaatggggagtataggggaacactatttatttctagtcctcaactataagtaagaaaaataaatcaaaagtagaggtgctaaatcatgagaccatgggagatgctcattgctcctttctaacttgttccatgaatgcacccgtccttgtaccacactattggaaatcttcaccacaaccagaagccgtgccaggggtgcagtggctaggatggagacaacaggctatttttgttccaagtgaaacagtaggccaagtgaacaggtaaatacatggggcaactcaaaagggatgtcaacccccggagctgatgggtgtgtttcttctttatggtgtgagagtcgggccagaagtctgggtaaccaagtcaggacctgcagtttgggcaagattcgagctgcggttcagaaccacagcattggagacaaaagcaagtcctgcatgtccagtgtcatctgggccttgtggttttttcctttcttcctttttataatggattttttttttcccagagagaagatgacatcagccaaatatgagatacaggctcaagtaattaaatattttttggtttatttacttgtgattttaaaagaatatgaagcatgcttgggagacatttgtgtctggaaagagttgagcaactctaaagccgtagcatgcagcaattggtgaaaaattgctaaattatgtttcttttttttccgtgaaatgtcaaatgttgttcttttgcttctataaaggtcagtatggtttaaagagaagaaaaaaaaaacaaacttggaccattaacttgttattgaacttcaaaagtgttgtatttaccagtaaaaataaatctaaaaatgttttggtggctctgaaacaagaaagactagattgtaatcaaattagtgaatttctggtactttcctcttctttctgggtctttccgtgaaaaacaacaaggagaaaactaattcaacagcaaaagttgtttataaatactctatatgttgcttatttgtggagtatgagttaccacactaggtgagtggggtgtcataattttcccctcatgcttttctgccctttgatgttcttgaacaagaatatagctgtggaaatataattcttttaacgaatacatttcacagtggcatttcccaaatggtaacaagggacttactccttcagcagaaaagtcatctcctttttataactgatgatgtacttgtatacacacaaacacacataaagaaaagcagaaagtcctatttgttcaagtttattttctaatagccattgttatttattagcactctctgctctagtcatagcacattactacttcatacctctttttgggaaaattattttgggggaaaaaataaaatagcattacttaacagtgtgaagccataagtttttattggattgtatcttataatcttatttcaaaggcagagggtaggctggcaaaatgtaggccaggaaatgattattgttgtccctgacagaacacatactagtgacattttcaaaatagaatatgcaaaagtttatctttagtagctctgcacccaactgccaatgtttttctctttctcttgccccctctccgctactctctagcttgtgttcttttgctgagcttggcttactctcagttaatccctgctaaagatttcacactgctagtgtcagatgtgcttcctgccaggatactggcattttaaagagggactcctagacttcctgcctgtttctcctactcctggagcgaaagtgaacatacaaaaatcaatttcccctggtcatcctttttccatggcattaggaagcacagcctctccaccatgctcctggattcaaatcctggctctgctacttgctagtcctatgatcatgggccagttacttaacatccttgtgtctcagtttccttatctgtaaagtgaaaaagatgattatctcacagggttgttgggagactgaatgagataatatatgtaaaacatgtaaaagagtggctatacgtaataaatacccagtaactgttcattattatgttattattctgtcttagtccattcaggttgctctagcaaatataagggtaatttataaacaatagaaacttatagctcatagttctggaggctgggacgtccaagatcaaagtgccagcagatttggtatctagtgagggcctgtttctcgtagatggtgccttctctgtgtcctcacatggcagaagagcaaagggaaaagggggctaacaagctccctcaggccattttatatcagcactaatcccattgatgagggtagagccctcatgacctaatcacctcctaaggccccaccttttaataccaccacaatggggattaggtttcaacatgaattttggaggcaattgccaaaccatggcaattcccaacattaccatccttgttttataaatctcgttttctgaattgacttataattacttctccattccctgagctaagtatttattgtattagagccagaagatgcttcatttaaatcagttaattaatttatctattctgttgcaggaactgttgtatgtgctttggctaaatcacaaaatagacaaaatatctgtctgttagcaaaacatgcaaaaatgcctgcccttgagaaatgtatatcctagcagggagtggagggtgggtgaggtagagacaatagatagataattcaaataaacatgactagattatgtagcatgttagaagatgataaattccaagtccaggagagcgaagggcaggccagtgggatgcattttaaataggtggccaaggagaaggccttgaaacgtttgagaaggccattaatgagcacgggtagaaggaagccagggagagtctcagtgtccgtcttcagttgcttttacttcctttcatgattcacatagttatttttaaacttttttactgagtagaatttttttgtgtgtattaattctgagtaccattattcattacagtgagttccatcacattactagtaccacaaagataatatctttgagactaaaccttttgggctattttttgtcctttatcctaaaattttctattgtgtttattatctggtatatttgaatttatctctccaaaatcaccacaaaataaaatttttaaatgtttgtcttgtttttctctcaccattaagtggggttaatattaggttcattaggtaaggtttaattttaaattgtggccatctgatattgctacatcaaaaggaagttaaaatttgcttgcctaacatcacttaccaatgtagttgtactgtgagcaaaaatagaacaaaaatagtttatctggagattgaaaattcccagtattgactttagcatgactgcaaaaaactcataaccctctagtgaagacccctgaagttaacataatgaaggatagaaaaaaatgacagatgggacaaaagcaaacttcctggtaaaatgtggaagtattcctcaaaaaaggctgttcataataaacttgggtattttagttacggggtcagaaagaaaaattttagattgatttatttagttcagagaaattacatgaaaatataaaactgtaaacttttctataatgctctcttttatttgagcttgtatgattttttctaattaatttctaaagacattttaactattgaatactaaaatgaactatcacttcaaaagtgagatttaagagtctctagaactatactgtttgtatttataagacagaggagaagggataagagagagagccaaagacagtcccttggagacttggggtttcagcaactgtgccacggggcagtgcagacctccgagtgaccaggttttcagtccaggatcttcaagactatctgcagtaaagccagcagagtggacagaggggaagtcacacactgcctttctttcgtcttcctattgcatgtattctcaacactcaggacttgcctcccctgaatggatgagagtggagaagcacagaggttgacatcccctaaacttgtacgagagtcttttaaactctgctgctgacatggcgtacaaacagtggtctctaaaagtgcatttcattcactttgggtaggtcatgcattataatatcatttccccccaaaagtagctattactattacttccttgaaagggccaggaatatacttggaagatacagtgagagctacagtctggagcatcacagcacagagctgttgcctgatccctgaaagtacattgacaatccctaaggtccatagagaatccaggcgacactagtcttgggcaaatcacagcatagagttagacttggaatcagacaggcctaagtttgaattccagttagagtgccatccctaaatcccagtaaatgaaataacacataatatgcttagcccagtgcttgccacacagtaaacactcagtaaagggtagctttattatttttttcaaaggaataaaggagaagagttgcacggccttaaataattctccaaatttattttgagtgaatgcattttgtgctagagcttttcattggtaaccagatcaacagagcttagaaagcactattttgaggtatatcagatgaaatgaacacatgcagtgattatgttcatatttgatacagagggatcttatttcattgtcgtcttccttctaccatgctatatccatctgtagttctgttttcctttttaaatgtttcaaaccttacctttctttggaatccagctttaaatggactacttccttgaagctttccatgcccactctagtttatagtaacatcttctgatgcaacccccacctcattgcattccatattttcactcatttggcacctcatcatacattgcctggggcagttccctaaccagttccctgaagacccactctcttggttcttttgtactgcctgtaaagcttaattacagagctggcacagagttcccagtaaattcttgttgaattaaatctcttatttgaaatttccaatgcctccactccccttccacaaattctctcaatgtagggaaatctctttagatgactaaccggtgttaacacctcaacccaaactgacattttcaaattatttagatgcttcataattttccagtgtgttctaccaaaacaatgtttacatgaaaagaatataattattcaacatttttcctaagactatggtaaaagccagcagcattgccccacttagaggagctaaaatagctaaaggttacatgctttgcctcaaataatagacttagtgaagagggtagaagtagaaatgaggtcagccccccagagcagtctggtggccttgagcaaccaggaaggtaaagccggtacctcagttaaatcaccaagtttactggaagtgcatatttttcatgtgccaaattcagtaagtcatggagcaaatgtttattttgctatgctttaaaaagttgctttgcttcttgtaagttttctcagtggaagggttccaagttatgacttaatctatgtttgcagcattgcactggaaacaggatttgtctgtgaaatggctctgtcatttgtggaccacttctgtagggagattgtggatttaggaagggcagaagcaacagcagatatgcctggtgtttgaatggatgtgcctctctcggaggcagcaagcagcatacccatattataaagtttttgattttctaacatctgaagacaggcatccagccttgcagaacagccaggtgtctgttctatagactacagttccttgtttccagaattacggtaaccaaataatacacaaggtcacctgattgcacttcccaacaacctgaacaaagagcacctttgcgcttgctggtaggtgctgtaccagactctttgtaatctgccttaggtcagagaagaacaagccattaccagtatgggagtccatccctagtcagggctagttgctattatcccttgaatactctgcaggcatcccacaagacatttgagacttcatatttgtcaaataatagaaatctggctggcctagtggctcatgcctgtaatcctaaccctttgggaggctgatgtgggcagattgcttgaggccaggagtttgagacccacctgggcaacacagtgacatgttgtctctacaaaaaatttaaaaattaactaggcatggtagtgtgcctatagtcccagctactccagaggctgaggcaggaagatcccttgagcccagtaattcaaggctacagttagctctgatcctgccactgcactcctgtcttggtaaaggagctaaacccagtctcaccaaaaaaaaaaaaaaaaaatcttactagagatttgggttattacaaaagggatcacttaaagactttatgtcttagagacatatttcttcagctggataaacagtccatataatcatacagtagacaaagcaaaaggaagatcttagtgacagcttaaatccaggataagaaattaggaagctgcctttatagagacaccagtacttgccctgaaccattttaattctcctctgttttcataatacaaatttgggatgttttcaaattcaacagaccagcagtgctgttgattcataacctaaacaagcttgttaaccctttccaaaataaagtcactctgcttcttgaactcactagaggtgtgctagttttacaagtcttcagagtttattatgttccctggaagtgtgcctctttgtgttaaatctaatcgctctggttagtattttaattttaaacaatcaacagccttgtcctcaaaagcaaaatgaaagaaagcaagcctttggacatgttgtctgatctgcttgcaacctgtctcccaatgccctcccctccctctctctgcctcctgcctagctttctgcttgtctttttaaactctccaaagtcaaatctttcaagggagcttctctcttgggccccaattacccctagatttattgtctctgaactcctgcaatataatattttccccttatcgcagcatttatgtatagacagtccctgacttagaatgacttaagatttttcaactttatgatgggtttatcagagtagcaaatgcatttggatttacaatattttcaactaaaaatgggtttattgagatgtagccccatcataagtctagaaacatctgtaatgtaattatttttgtctttccctcactgaactagccacttgaagacaggtgctatgcgtttaacctctgtgttccaaccctaacaatgcttgttctcagtaaatgtttaatgattgaatggatccctggatgaataaatacttggatgaatgctaagaaaaatgaaaggcttattgtacctttccaacatgttgacttatgttggcacatcctaaattcaaatgacttctctaccaccaccatccccatacacaccctggaaaaaatagtaatagcatgggtggcagggggagggggcaggtaattctactgtccttgcagcaagctaataatggccacattaattccagaatggtctatcctgtgttcccaatacttagcacttgaatcatcatcattgttcactctcaggcaaatcaggcaggacaggattcactgggaaataaatgctctttttaagttcctggaggattattatagaatacagtgaggcaaagattctttaatgttggaaaaatgaaacagtacctctgtaattaaagccaaaagccgtagtgtaaatgaggaaaaatggtaatcagcctaagctaggaaaaacctcggttcaaaatacttaattttctctgttctaagaaatcaatgcatacttgtgggtgttttaagatcaaaatgatttagaatgttttcctatggcatttatgagttagaacagagagttagaactatctctgaaattcatttcctttctttgtaaacaaatatggttaacatttactagaggtgttcattcttctctaacacatatgattttgatgtatgttgcgagaacagcaaaaatcattattaaacatctacttttaaattttctccccactgtgattatcatgcaggccatgagcaggctaaattagaaagcattttggaaaaggaagagttctcccctgcctgtgagttctataattacttgcccttattgtattcaccactagtttaatgatgggtagggtatagtactgtttgttggttttctctcaagtatattttaaagtctgcctttattttgggcgacatcatagatcaaagtttgatcctcagttttacaggctcaaaaacaacttcatttcaacaatactgtgcagaaaactgaccactattcaagtattcatgatgtattaatttacgatggaatttatgcttggctgaagaaatggattagttgtctacagaaaagtaaaattcaaaggttgaagcttctttgtgatatactccaagaggagacagaatataagttctgcaactatgttgttcttttcaactattaaaaaaaatcaaattttaatgctagaaatactttatttgacatgatccagtctacggcacaccttgattctgcagaagaggaaattggaaccctgagtttttaacactatttagtgtcagagctgagactggagttcaactgagactagagtctgagagaacacagatctccattcaagaaatacccttcttatgtagtcataattgtaataagaaaagaaaaaaatttttaagaaatactcttcttagacattggcctgtttgagagatctgtgtacttctcataacccttgctgcctccctgattttggagtgggattggtggtcagaagttggaactacagataatccaaattttttagtgactgtaaaacaaaatatgaaaaaaatgctctgtaaaattggagaaaaattaaataggaaaaaagggatatttccattcagctaaagtcatctgataacatccctttctctccactttgggagagaaactggtatatttctaaattgaaaaaaaaaaaagaggccaggcacggtggctcatgcctgtaatcccagcactttgggaagctgaggtgggtggatcacttgaggtcaggagttcaagactagcctggccaacttggtgaaaccctgtctctactaaaaatataaaaattagccgggcgtggtggtgggcagctctacttgggaggctgaggcaggagaattgcttgagcccgggaggcagaggttgcagtgagccgagattgtgccattgcactccagcctgggtgacaagagtgaaactccatctcaaaaaaaaaaaaaaaaaaaaagtcttgatgtcttgaataggagacatcaaaacataaagtatctgggttactggttactgaaaaggaatctgaatgacagactcttttcattttttaaattttagattcagtgggtacatgtgcaggtttgttgcatggatttattgcatgatgctggggtttgggcttctaattatcctgtccctcaagtagtgaacatagtgccctataagtagtttttcaactttaccccttcatccttcccccttttgggatcaccagtgtttatccccatccttgtgtccatgtgtagtcaaagttagttccacttataagcgaggacatgcggtatttgattctgtttctctattaatttggttaagatagtggcctccagctgcacctgtgttgccacaaaggatgtgatttccattttttatggctgcatagtattccgtggtatatatgtaccacatttttcttatccaatccaccattgatgggaacctgtgttgattccatgtctttggcattgtgaatagtgctgtgataataatatgaatgcagatgtctttttggtagaacaatttattttcctttgggcttatacccagtaatgggatggctggatagaataataattctatttttggttatttgagaaatctccaaactgctttccacagggactgaactaatttgcattctcgccaacgtatataaaaattcccttttctctacaaccttaccaacagctgttattttctgacattttaagattggtatgagatgatatctcattatggtttttatttgtgtctctgatgagtaatgatgttgagcattgtttcatatgtttgttgactgcttgtatgtcttcttttgaagtgtctgtttgggttttttttttttttttggtttttctttttgttgttgttgctgttttgagatggagtctcactctgttgcccaagctggagtacagtggcatgatctcggctcactgtaacctctgccttctgggttcaggggattctccctccacaaccttgccagtagctgggattacaggcatgagccaccatgcccggcctttgtgcaatttttaatggggttgtctgtttgtttttctgttgatttgtttaagttacttatagattctggacattagtcctttgtcagatggatagtttgcaaatattttctcccattctgtaggttgtctgtttcctctgttgatagattcttttgctatataaaagccctttagtttaattaggtcccaattgtcgatttttgtttttgttacgtttgcttttgaggacttagtcataaattccttgagtagcccaatgtctaagaagggtatttcctaagttttcttctaggatttttgtagtttgggagttttacatgtaaatctttaatccactttgagttaacttttgtatatggtgagagttaggagtccagtttcattctcctggatatggctatccaattttcctagcaccatttattgaatagatatgcttccccattgtttatttttgtcaactttgtcaaaggtcagttgattgtaggtgtgcaactttattttgggggtctctgttctgttccattggcatgacagattcttgactctcactggctacctaaatgatcatttgtcattagtttactggatttttttctgtatagaacaaattgttgaatttattttaactatttatattaaaaatcaaaaatcaatgtggctttaattagaaggtccttggaatttttttataaatttgatttttattgttatcctcatcactaatacatttacaaatcacattttaggtatttctgaaaagatttcaacaagtatcttctctcatcatttattcattcgaaggtattcattacatagatgactgcattaagttctgagggtacaatggagaaccaaacaggaatggtcccaaacagaatgcataaaatcacagaggttgcattttactgtgggaggaagatttgaataaaataatcacacaaatattgttataaactgtgataagttctacaagagaacagtatggggtgttgtgaatgcgtaatcagaagaatgccgtctaattgggggaattcctgaggaagtgaaatcagatggctgatgaggtggcaccaggcccaggagggactctccattcaagaatagtgttccagccaaagggagcagcatgtaagggggagagggcagcacctgcaagataaatattcatggaatgactgagttaatgaatgtgcaaaggcactgaggtggagactggaaatcagatgagtggagctagatatggacagtgaaggaggggtaatgatgaccttgaaaaagtgggcagaattcaggtcatgcagaggcctgtaagacaagctaagatttaggtctttatcttgaaagtagtggtaatcattaaagtgttataggtagtgaagttgcatcttctattatggagaattattataggagaggaggggaagagactagggagtgagctgatagtgagatttttgtccaagtgaaggtgtgatatcatggtgttttctttttcttaacttttattttaggtttaggggtacgtgtgcaggtttgttatataggtagcaaagacttaaatgattattgtgttttcaactaacatattagcaatgtacttgaagagaagttggaggttcaagagataattctgaggtgatattgactagacttggtgatagattggacttggggccaggggaggagagagaaggggtcaccctaggtggcctgggccatcctggtgactcagtatctatagatgattcatctggcactctcctgctccagtaatgccacctctagtactcacatctctggtcccaccctggactttgccactgtcctaagctactcactgctgaaatagaagggaactacaaatatccttgtgcttccagccacctcacatccaggtttctgagcttgctaaggagaaccatgtacttgaagaagttactgaccctctctgaaggctcctaggatgaaggatggtaattcctaccttattagactgttggaagatgtggacgacaatgttacaaagactctgatatagtgtgtggcacatacataaacgcaatgagatagaaatcacctttcctctttcatgtgctggttcttatatcttaaacttttgcgaatcccactaactttgatttgctactgccataagtatgtttttaattcaggacttaatttgtcaggattttatacagaagttgccccatcacacagtgtattaaagaaatgtatttatcattaattaggcaataactgtgcttttagtaccaagagggtgcccttttcaaaaagtgtagctatgcttttaaaaaaaaaggtaaatcctcagtatgccactgacttcagttccataaactaataatttaataaaatgaaaatgacccaactactactatatcaagcctattaatttcacacatgtgtaaaatctgtaaggaagaggaaatagcatgtaaactggaaagataagtgtcttgattcttcaagggaagaaaagtaggcaagtacagagaactctgtttcttctgggtcatatgttttaaaggaatgacctgctgtttctttcttttttttttttttaaagacagagtcacattctgtcacctcggctggagtgcagtggcctgatcatcgctcactgcagcctcaacctcccacgctcaagcaatcatctcacctcagcatcccaggtagctgggattataggcatgcaccactacgcctggctaactttttgtatgttttgtaaagacagggtttcaccatgttgcccatgctggcctcactacaaggctgaagtgatccccaccctgccagcctggacctcccaaagtgctcagattatagacgtgagccactgcgcccaactgcctactgcttctttgtgctcagactttgctattattgacaaatcatataaaggatcacaatcatccttttgccatggggaggaatatatagattcactatttttcactaaagatctgtaaataaatattaatgaattatttttattaattgtacaaacatttcctcatacaaacctagaatgtttccttatgttaagattactttttcagagaatatgaagattttatttctttgtcttataaatcccaaagttttatttgttctaaaaattacaatctatattagactaattttataaaaatatgttctcttataagagtggtgaaatttaaagtcaaggtataaataactctctgcatgaaagacatgcaaaactacctaaaggaaaccaaaattggaaatttgggatttaattttttaattttagaaaattttctttttcttgggaggccaaggtgggcagatcacttgaggtcaggagtttgagactagcctggccaacatggtgaaaccccgtctctacaagaaaaacaaaaattagctgggcatttggcacacacctgtaattccagctacttgggaggctgaggcaggagaatcgcttgaaccagaaggagaggttgcagtgaaccaagatcgtgccactgcactccagcctgggagacagagtgagactccatctcaaaaaaaaaaaaaaaaggaaaatttaatttttctacatagacatttccttgtgtactaaaattaaaattattttaacccaataaagtagtaaaatttggcatgcttttacatacattcccgggggctttaaacatgcacacgcatacatacatacacacagaattcagcttttgttgcctttcctataacatgcctttcatcccttccaactataggtgtttttaggcccagcctataaaatctgattacataccttcataccctcacttacttgggatctgagtcataggagcagcttgcaaagaaagcatcccaatttaagtatttcaaaatttctggaaagatgtattaatggcatagatgatacatttcgacccatttcttagttaagagtgagcttttaattcatagaagctgttcctgtagggaatctggtttttcctgcccttgttttctaggccccaggcaatacaggcttttctggagttcatatattcactcatctacccaacaactatttatgaaaaacttgctatttgcagggcaccatgctgggctacgacattgcagaaatccagttttcttgcttagagaagttgatggatgatgatgtgacattagggtagagcataataaggactgtgaacagggattgtgcagggtatagtattgggttacctaacccagtatggggtggtggggaggccagagaagcatctccacaccgtggaggaagttgatacttaactgataagtaggattagcaggtagtcagggaagagcagcagagggaaccacaagtccacggggcaaacctgaggagaagcacagcacatcttgaggaattgaaagtatggctggttcagtatgcttggagtggggaatctgaggcagcgggtggccttgttcagtatgcctgtagtggagaatctgaggcagggagtggtggcagatgaagcccaaactacagaggtcttattagccaaattacaaaattctgttctctattctgaaggtattagggaaccactgaaacattaacacctcccccattgccccctaccattttctgaaatgactcaataaagaataaaccttattggtgaatcaaaagaggtgccagtgccttaaggaaggtggtcaagaattgtatttagacctacacttaaggcagaacagcaccttggttcacattctctaccagttctgggaaagaagtggttcttagccaggtaaaatattcaaccacgaagatcctgcttggccttgtaatgttatgttatttctcagaagacagccttgtggcaggccacctcaactggtaggaatgtgctgtacaaagaaatcaatcaaccaggttaaggatgagatcaactttgtgcaaattcttttagtagtaaaaacaacaatatcacctttctttataaatttgatctacagcttacaaatatatatagtacattttatttgagatgcataaaaatccatggaagtaattggtattgaaattcctatttcccagatttaaaaaactgaggttcatataaataaaatgtagttacacataatgataattagcaagcagcagagctgagattcattccaagatatcagactttaaaccaccctgttctttacaagagactggctattttcaatgaagaaaattaagcttggggctggactaaaatctttatttggatttttttttgtcaaattaccgattacaagaattgatcactccatttcctttagaagtagaaataatagtcattttgctgattttctttattatagtctaagaaaaagaaatgctctgtttaaaaatgtactttttaaaacaaggttgatttgaggtcatggcaattaaaagtggcactaccagaaactgagctatgaaaaattggctatgcaataaatatgtatatgaaattcttgttttcccttttcttttatccttttttcttttctttttttttcactgtgaccttgaactcctgggctcaaacgatcctcctgcctcagcctcccaaagtactgagaatacaagcttgagccactgtacccagccctttgttttccattcgactttcatcacaagatgggtgacacaggacctcacctaaaacttacttgctcttgataaagttgaaaattttctgttgggaaagtaattcgggagtgtggacccacatcatggcaggcattctaggccacaggacttaactgtgttcatatgcctcatatttttaactgcctcatattgtaactgagttaggcttcatatgcctcgtattttaactgagtgtagctctatgaagcaggtaccatatattttacatccttttatgtgttcacagagtttccaatatagtagacactcaaaaacttttaaagaatagtatacaacattattttgttgaggaaagattaaaatatttggaaggacttccctaaatttaggcaaagccttcacttggacccatcttccactttactgttttcctgttcaagcagtggtctgagattcagggatcagaggaactcctggtagaattccaatcattagactacatgagtggccatgaaacactttggaggcaagaccaagcctgttctgttcactgcctgcatggagcctacagtgcattaccaggtggacacttagctattagtatttactcagtgaatgaaccaaagatgattaagagagaacttaaattgctggctggttagaatctggatttacgtaaggataaagttgctagtcctgctgtatcaaataggatggcttctacaatgctggtcccttggcaagcaattactagtttgccatataattcactgtcgttgccggttgagtgaaatggggtgatgctaataaaaatgctgagacaacaggctaacccaagaatcccactcaaaccaggactgtcacaagcaaaccaggatctgaggttaccctagtgattgcccaaccataaatccaacttcagctcttattccaaaaaagtgcttacatgtgaaagcatctcgttacataattaatgggttggagaaaaaaaaaaaaccttctgtagaaattgtaattttacaaaagtttatatccaagctggagtggttatttctgagtgctaaaatttgatatcaattttggggggcttctctgtattttctttctttcttgtttctccttctgcaataaatacgaacttggtttccttttcaatttttatttttttaagttaaaacatctattgagtcttagtgttttgctaataaatcaatgattctatagaacatccttagagaactcctaggtcccttgtttcactgataagaaaatagcaacaaaaagatattgaatgatttgtctctactaaaccgtcatcagaaaagagtattcgaaaataataacataatcttttgacagtatatatgctggaattattacaatatttatttctgtttagatgctatattatctcaaagccataaatgcaaaaattccaagaagtatgatacctcaaggaatatttatctgctagtgagacttcccagaattcgtcattttgccaattttattggtaaacttttttttttttttttttaaatggagactcactctgttacctgggctggaatgcagtggcaccatctcggctcactgcaacctccacctcctgggttcaagcaattcttgtgcctcagcttcccgagtaactgggattacaggtgtgtgccaccacacccagctaattttgtgtttttagtagagacagggtttcaccatgttggccaggctggtcacgaactcctgacctcaagtgatccaccccccttggcctcccaaagtgctgggattacaggcgtgagccaccgcgcccactgtattggtaaacttcttatctcttcagggcatagtttacacctatgtctttcggtaccgcaaagcatagcacgagaagttgcacatttctgtaagagtctacgtggactatatcattgtcttagaatggagtcacatgagaatgtttctaaaacaagaccatttaggtcacctttgatacgaagttccattataatgaagtcaataatatatttaaagtttttgagtttttttcctgttatttgcagcataaaagatttagaagcccagtatatatgtatctttggcaaactgactcccttcagccacttgtgggacaagaataagtcaggaatacaaaaatcgggtatctctagaagggacattggtgtgagataaggcatctcatttgcaggaaagcacaccaccctagtcttgcattgcagagaatgtgaagtttgcagtgtgcattcagtatttctcttcaaatggaacacctgattcagtttgtagtttaaagagatttaattgtgtgctatatagtcttttgctctgaataaggaaaataatgattgaagtggatgggttagaaggagtaacatgtagttatcatgtagttatcaaactggctgatttaatggaccaagtcagattattcccctaacctgacacctttttttgacactagtacatgttacatagttcagcctgttctcaccactctctctattgtaattgtggtttttttccagagacatcagttacttctgaaatgaacaaatgcctctttctctttctccttgatgtctgttttgacaatgtggaccacctcattctctgggaacaaaatcttcccttggcttccctgatatagttgtggctgtccttaatctgacttgcctgaccagtcagttgttccttgtttacttcactggttcttcttcctgttcatgtcctccagctgtgtttaatcctgagcactcagctttttttctctataaagtgtcttctttaaaaagtcatacacccatgtggcttcagctttcaccactacacagctattttctacactcacattctaaccttgccttctctcttcatcttcagtggggtacttaacacatctcacatattttcacctcaaacatgtatgaaatttaatttagcttctacagcaaagtgatcccttctcctcccttattattattggaatggggtcatcaaattttcccctttcatcatcatcaatactgttctttggtcacctatcactggccaattaaacttatccatacaatgagaaagatatctgaatgctaaactcttaaggccttgttttcaaaaaggtaattaaaggacactgaccaaaactatgtttaagactacttataacaagatttaaataaataatcttatttattacagcacaatttggtatttttgtaattttttaaaaaaattcctattgaaagacaataccaactcaattcttttctccagtttttattaaaactttttaaaaaattatccttggatgccaaaccttttctatattattaagtcccacctcaataccatttgaccacctccaatcttctctacccctcaatccaaccacccagatttgtacttcggaaagtttttaaatctgggaaactatccaagcagggttagtggggtgagggagtttggattcttgtaatctgttaaaaacttacttttcagttccttctttcttgtcagaaatagtctggctcctgataagtcctatcatgactgattagcgttccatgctttgaaacttaacagaatcatgaagaacactgagagtctcagagacaaagcactgtaaaataggctcaaaaggaaaggctgaagaacagggatcagattatctggaaatgagattactgaagcatgtcctaatacttaccttttcacttatgggtatttaccactaagagactctaacctaatgtttcttatgtccataagtgacacacagagaaatatgttcttaaattccagatagaaaccttggtgtataaaaagaagaataccttgatgtatactggatatttataatttaaaaactacaaaattgttgttcctaggaattgcaaaatttagaatagacatctgtccaaaccttaaaagtgaaggcctgctgcctagatatttaatgatagacatgtctgaatcctgcagacttcttttattatctctactagttttgaatagtgtcccctaaattattaagtaattatagaagaatttgacaaacccatggtgaatactagttaattacttaaaccatgcaaatattttaaaaagcatttgagcaataattgcttacacagatttccaagtatttcagttgtactaacctatagctatcaagatgaactcacttgtttcctttttccatatatttaatacacagttagattgtggattcttattataaataagaccatcaacaaaagcaatattgtaaataagaccatcaacaaaagcaattttaaatgaaaaaaactaagagtagtttttaaagatgaagcaattagagattaaatgcctactcttcacatacctgaaaaatatacaaatgcagaaatactgtatatatttgttttttcaattctgtcactggcacaatatccgttatctttgctgctaagtcattggtgatgcaaaacagcagtaggtcagcagcccaagagctgtttgaagccagaaacaagagatcacaaagacttcccaggggtgtctgccaaggggacagcaaaagcaacaagccctctaaggagatgtagccacaggaaggagcatggcagtatgcaaacccggtttcagcagaaaagccagagacagccaggatgtcacctgagggctcagcacaaagtgaccataccgccaggaagacaccaacccagaaaagcattgacctggccaggaagggatgcttcattctgccatgaagccgtggcacatgttacatgttgcaacagaaagactaagctgaaacaaaagtagtattgaacaactactgaaatacctagctatagtggtgatagaattagaggactgaaaccaacacatccctcagacccatgactgtctctaccccttcctactctgtccctctgatgaaattaaaagctataattccttatttaacaaatatttcctaagctcctcctgcatgccagggaccatactataaacaaaaataaataaataaaacagtgaactggacatggtctcttactttctaggaggttacagcttaaaggaaggtcttccttttttaattccaaatttgtaatttttgagatgaagagagcataatttgaatggagatttcattcctctgagtccctcataccacattgtctcaggaatccacactgatttcgagaactcatctgaaacctgaagatgtccctcaactaggagttgttgaaccttggagaacttgtaaaaaggtctcaaaagagtgtaaagcccagcttaatcactttcctgttttaaccacttcttcccaccccaccccacttcctggttaaatttgtgcaatggtaatattgagtctttcctatctcatacggaactgataaaaatttttgagataattgtccagaatctcctgtacttattttactccttgatgacgtcaagaacatttattaactcctttagactattacgatttcatttgtgtctcactgaatgtttgctaataagtttaaattcttgaatcaaaagaaatacagaattggtcatagtgttacgggatccttggggtttcgctttgccagctggaaatctctgtggccagtgatgcctttgcctgagttttgctcaggcccactgggcctgctcagcctggcagactacgcttggctcatgctactggcctggatcccatgcctgccaagggcgagtggagtggcgaggggtgtgtgaatgagcaagtatggggtccggccactgcacacagtggtggagctggcagctccagacaccgccacaggcactggctgtctgtgaggctgtggctggactaggcatcccgcaagtagcttccatggctggcaccaggggacacagtcatgcccagaagcttggaaatgccaggacctgcagagccccaaagagggtgtcactgccctggcttggggcactcctaggtctgggctccccaaggagccacagctcttctctccttgttgcctgcaatatggcaaggaaggggtgtgtttcagccctgtttgtgttacagctctttcagccctgccattaggcaggttccaagttcttgtcccatgcccaggtagaaggaggtatgcagacaagtgggagatgagaaaggtgaagaggagctttattgagtgatagagctcagaggagactcgcagtgctcctctccgcagctggtcgtccctacgtctgctcagctctcagcagagaggagacaccagagtaggtagcttgtctccacaggcaggtcgtcccatcaagtgctcaaggctggctgaatctggagtttttatgggcttcagagggaggaagtgcatgctgattggttcatgggtggccataggtgggcctagaaaaagcaccataagttcccactccagtttgcaggactgacagcctggcccccaggcttcaggccttccccagcttgaaggtggggcctcaacaggggccttccccctctactccagagccagtctgcctcatgccactgttcatgatgcccaggccattcatatggaggggtgcctgcaggccagtgctgagctgccctcagcccccctcagcctccctcccatgttcattggcattctaagtctggagggggtcaaggcagcagagggctagtatgtcagtgcttccctgagtgtgtgcatgcctggctgggttgcaacagtgcccaggcttggcctcaactttgctgtgagattggagcaggcactgggagtgtggagaggccaggcagtgggagcgggcctgcaggggcagtggggggcttcctgggcccttgagagtgcagagatgcccaggtctgcagctgcagcttgggtggctgcagtggcacctgcctgctgccagccccccaccagctctatggagttcaaagcccagccatacctccccttctgcagccagcatctccgcagtagccactccagatgggccatcgctaccatcaatagtgggtatggtcaatccaaatattactgaggacactttcttgtttgtttttagaggcagggtctggctctgttacccaggctgcagtgcagtgatgcaaacatggctcactgcagcctcaacctcttgggctcaagcaatcctcctgcttagcatcctgagtagctgggatggcaggtgtgtgctaccatgcctggctaatttcttttttattttttgtagagatggggtctctaggttgcccaggctagtctcaaactcctggtctcaagtgatcttcccaccttggtctcccaagccactgggattacaggcatgagccaccacgcccaatctaacaaaagacttttgaaagcattttttatgattatagtaggagagccaacaaaataatcaaaatggtaatgcatagaaagaattcccttccctgtaagctttcactaggtaaagaataggaagaacagatggattatataggtccagcttctaaaacagttaagctgttatattgtaaggtattgttgtatttgtgagtaacttgagattaggagccaaatattttatccttacgtctcagtgcttgccaatgcacgtagtgggtgatcagcaatattggattaaataattgagaatccagattctctcttataattctttcacagactggcatacaaaagggagcctgagatttaacatgcagtgtttggaacggggacttgtttttatcctgaggtcagaaacctccacagctgagtactttggataatgaaagtccattttctatatttgcccagcttgggctggacacaggcaaatgtcatacaatctgcgtttaaacattcttttctttccattttaagcatttgtgtttcctgcagcacatctaaaagattcacaatatttactgtatatttctatgcttttaagaaaaaaaaacatgcagctttcacatgcaagttattttcagcaggcagttcctttcctgaaacacaaaaggctagatataaaaacaaacaagagggagaatacactgttttaacaaatgggtcctcagagatggattttaaagcatggattttgtttcccgatctagcttttaccctatcacttcacaacactgagagaaatcctgaaataaatcagtaacgtttgcacaatttttaaggctgacagttttatttttttcctgttttgtctattgctgtagccaatttaattaggtcatacccatgtgaaaagtttgttgtacaagaaaaattttggatgtgtgtgagtattttcaggaagatttgtttctgctaatgttcatgatgtcctttgcacatgaaactaattcacttattatcatacacaatttagaatattattattgtttccaaaaaaaaaaacaactctaattcaaggggaaatacatgtttgtttacttttagatcatggttagagcaattacactttatttttagcagataaaccactgattttaaaacatatttttttaacaatacagattagatgccaacccaagaagggatcatttgagtagaaaggggagaaaggactaaattataatagtattccagaagtggcagcagaaatcaaacactagcctacatacctagagcattgccctctaatttcacttttataaaagttgtttgtaattcttaggtcctgggtattttctaatagactttttatgattataccaacagaggtaagtttcaggcccacaagaaagttattgcttctacactcccagaaatgttaagaaccacgggagaatgccatttttcgcaaaatgaagatacttattcatgttttctgaaaaatcttgatgttaactccttttcctctttaatgagctgaatgccttgcttttatttttatgtatttaataattttagtaactatttaattgagattcttacttgcttccgaaacatcaggataaatagatacaagaggcacaatttaacatattttattggctgaacataaaggtcacaattaccaagctttatagacacaccattagaagtatacagtagatcctttgtagagaccatgaatgagagccagtgtaggcgatgtcaggaacagcaatacaaattttgagttgctgtctgtgacgaaagcccagcaattgtcaagagtttgactgggtcgcaaaagaatttaaagggccagcagctctttaagaatgcatgcgttagctttatccttatgtaacatttactgtgaggcaaggcatgccaaatattaagcaatctactgaattctgctgagtccctacccagtgattctattttcaaatgagataagtaggtgagatatacaaatgaaatcagaggcttgattaatgctgcccatccagaaatctacaatgtgaatggatcactattagtaccccagtttcagcattttcctaagaaaaaatggaaataagtgaaatagatgggaaaatatggtacttttttggaagttaagaagtttgctttctaaaacaaaatgtacatagctaatcagatatacttctgcaattctgttttcatgtattaataaagctagatttcagcatcacttaagtttttaccaagaaaagaatttgaagctgggcatggtggcttgcacctgtaatcccagccctatgggaggccaaggtgggcatatctcttgagctcagggattcaagaccagcctgggcaacatggcaaaaccccatctgtacaaaaaataaaaataaaaaactagccaaacatggtgaaacacgcctgtggtaccagctactgagcaggctaaggtgggagtatcgcttgagcctgggaggcaggttgcaccactgctgtgattgcaccactgcactccaactgaactccagtctgggtgacacagcaagaccttgtcttaaaaaaaaaaaaaaaaaaaaaaagatttgttagtgagatgtcagttttcctaaattacattgactaaattttttgtgacattcaaaatttgccatggtctcttgctagattcctaacatgttctgtaaattctcagcttttagtagaatttgaagaatgcttgtggaaaatcaacaatgctttcaaccattggtatggtttggttctatgtccccacccaaatctcgccttggattgtaataatccccatgtgtcaagggcaggaccagatggaagcagttggatcatgggggcagtttatcccatgctgttctcatgataatgagtgcatctcattagatctgatggtttcataagcatctagcatttctcctgcttgcacgcattctctctcctgcctccctgtgaagaggtgccttctgccataattgtaagttttctgaggcctccccagctgtgtggaactgagtcaattaaacctcttttctttataaattacccagtctcgggtatttctttatagcagtgtgagaacagactaatacagtaaatgggtacctcagagagtggggtgctgctataaagctatccaaaaatgtggaagcgccgttggaactaggtaacaggcagaggttggaacagtttggagggctcagaagaagacaggaaaatgtggaaaagtgtggaacttcctagagatttgttgaatagctttaaccaaaatgctgatagtgatgtggacaatgaaatccaggcagaagtggtctcagatagagacaaggaacttgttgggaactggagtaaaggtgacccttgctatgctttaacaaaaagactggtgtcattttaccccctccctagaaatctgtggaacttttgaacttgagagagataatttaggttatctggcggaagaaatttctaagcagcaaagcattcaagaggtgacaaagcataaacgtttggaaaatttgcagcctgacgatgcagtagaaaagaaaaacccattttctggggagaaatttgagctggctgcagaaatttgcataagtaatgaggagccaaatgttaatcgccaagacaatggggaaaatatctccaggccatgctagagaccttcaccgcagcccctcccatcacaggcccggaggcctatgagagaaagatggtatcctagacctggtccagggccccgctgctgtgtgccatgtgtgcagtcatgactctaaggggctaaggtacagctcaggccattgcaccagagggtgcaagcccccacccagccttggcagcttccacatggtgctggtcctgtgggtacacagaagacaagaattgagtttggggacctctgcctatatttcagagggtatatggaaatgcctggacacccgggcagaagttttctgcaggggtggagccctcataaagaacctctggtagggcaatgcagaagggaaattggggttggagcccccacacagagtccccactggggcactgcctcagtgagaagaggcccaccatcttctagaccccagaatggtttatccacaaacagcatgcactgtgtgcctggaaaagccacagacactcaaagccagcttgtgaaagcagctgggagggggtctgtaatgtgcaaagccacaggggtggagctgtccaaggccgcgggaacccacctcttgcatcagcgtgaacctggatgtaagatatagagtcaaagatcattttttgactttaaggattaatgactgccctattggattttggacttgcatggagtctgttgcccctctgttttgaccaattactcacatttggaatgggtgtatttacccaatgtctgtatccccatcatatctaggaagcaactaacttgcttttgattttacaggctcagaggtggaagggacttgccttgtcccagatgagactttggagttggacttttgggttaatgctggaatgagttaagactttgggagactgttggaaggacatgattgtgttttgaaatgtgaggacatgagatttgggagtgcccaggggcggaatgatatggtttggctctgtgttctccacaactcaccttgaattataataatccccatgtgtcaagggcaggaccaggtggaaataattggatcatggaggcagttttctctgtgctgttctcatgataattagtgagtctcatgagatctgatggttttataagcgtctggcatttcccctccttgcactcattgtttctcctgccaccctgtgaagaggtgccttccaccatgatgttaagtttcttgaggcctccccagccatgtggaactgtgagtcaattaaacctcttttctttataaattacccagtcttggctgggcacggtggctcacacctgtaatcccagcactttgtgaggctgaggtgggtggctcacttgaggtcaggagttcgagaccagcctggccaacatgatgaaacccccgtctctactaaaaatataaaaattagccaggtgtggtggcacacgcccatagtcccagctactcgggagactgaggcaggagaatcacttgagtctgagaggcagaagtgcagtgagccaagatcatgccactgcactccagcctcggtgacagaataaaactccagctcaaaaaaaaaaaaaaaaaagagaaagaaaaaaagaaagaaagaaaaacaaattacccagtcttgggtatttcttcatagcagcatgagaatggaccaatacaaccatgtttattcttcagctacggtagcaggactgactttgacatgctgatgttctttttctttttcttttcttttcttttttttttttttttgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgtctgcccttgccctttcattctctgtctctctgtctctgtctctctctctctctctgtctgtctctctctctgtgtctgtctgtctcattgacaggctctccacctcataaagagtacaagatgaatcacactaggtgacttttaaatcaagatgaatcacaccaggtgacaacttctgacctatggtacttggtttccttactatagcgtcacacccattatctaattctttttcttcctcaccctgtgagctagactgaccagcagtttgtgttgggaaatcagatggagtataatttgacatttctttcttcagaatctttctaatttgacatgtcagtgactgggtctgccaaggaaatggttcttaagatgctatttttcctaaaaatactttcatagctctcttcctccacccattccaactcactacttcaatcccagcaaacagagaaaagaaattaagccaaacctcttttcaatttacataccagaaaatattttagaaaacaagctcagaagagtgcttctgcagcactattggaaaatctagccaggatttcctctgtacaaatctacctcccattgctctctgcattctgtccacatcatttttatttcctgtgtgtgaatcccattgccaccagcttgtcagtaatgctgcccctagcagtggggccactgctcacattttaaaacatccctgaattcctttggccaggaggagatagtaacaaaggcctctaaaaatttctgcagtgtccaagatgtgcttggttaccatttttttataagctcatattgccctctttatattaaggagccaaggaaaacagtatttgtgtttacttcctgaaaaatggcaggaaatcaaggtacatctgtctgaaaaggaaacagtttatattaatagatggatggagagattggtagatagataaatcaatagactgataacttacctgtccagagataacttttgtccttcatagcaatatggaaaggtattttatttatgttaggttaaaattaaggtaaatattcacaattcaagtactatatatatttttagtttgaatgagaaatttttatatacagaattattaactagtaacagaaacagagtagaaaggtggttgtcaggtgctgggggtgaaagaaatgaaggattttgatcaaagggtacaaaatttgagttataaaatgaataagttcaagtacagtctttaaaaatcaacctatatctttagtatccttaattttttggaaatctagtacgatttctctatccccaaagttcttaaaatagacttatttcatcacagcaggcccaatggaaacagggacttttttaggatcaagaattcagaaatgaatcttaaaattttttttgaatggttgctcagtccagcatttgtttacatctgaactgttcaatacaataaccattagctgcatgtggctatttaaatttaaactaaagttaggcaacattaaagagtcagtttatcattcaccctcaccacattttaagtgctcaacagccacatgtgtttggtagctgccatattggagaacacagatataacacatttgtatcagtgcagaaagttttattggacactgctggtctagatgttcaacttcctagtgaaattttttaaggttcatcttttcctctcaagttcatttctaaagttctcagatcgccattttcagaaacgaagtgtctttgctgtttctcagaacaccctgtgttgataggcagtagctgtaacctgtctctcagaacaccctatgttggtaggcagtagctgtaacagtccaattcttggtccagagccaccacttgggtgctcacttgggtgttgtgcaacaggagagcctgaagtatgctctgcattcctcagaggcatagaattggccttgattcagctgtcagtgaagtgccgtcagagacattctaaaaaaccatgcagagaagggaaagtacaggaaggaaggattaaggggttgtttaccagtaacctagagggatgtaaatacatttaatcattccaggatagagctatctttttaatcattcaatcaaaaacaaggaggaatgctatgaaagtatttttctcaatttagtatatccttatagatacctactatatttaaaatcctatgtggcattttagataaaggattaggaggattcttctccatttcttatattttttaacagaattttctttgcatacatcttaccaaaaaaaagtatttattgggttaaaaattagttttcgttccccacacatgacaacatagaaatctacaagtaattcaaatagagacatggtttagaatcacagattaaattgtctcagggagagacataattttctaaagaatgaagataaaattaaagttgttttattttgttttgttttgtttttgtttttgtttttttagtagagacaggatgtctctctgtcacccaggctggagcacagtggcatgatcatagcccactgcagcctcaaacttctgagctcaagtgagtctcccacctcagcctcctgagtagctgggaatacaggtgcacaccaccatacccagctaattttttacattgtaaaaattttcgtagagatgggggtcttacagtcttgtccaggtgggtctctaactcctgggctcaagcaatcctcccaccgaaatttaaggccaggcatggtggttcacacccataatcacggcactttgagaggctgaggcaggatctcttgagcccaggtgtttgagaccagcctgagcaatgtagtgagactccatctctagaaaaaataaatttataaataagtaaaggtctagtttcaaaacaatgccactgccgtttagcaaggtctttgtacggagaggcagagatcaattgtccatttgggtttcatagtgaatgtgtatgcattcatattatggtttctttttccccccatcccaatctaaaaaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtatgtatgaacccatgaacgacattagaagtaggcactcttgctatgttacaatttatattttctttccatgaagttgcaaagtactatcagtcacccttagcacatcctgattctcatgacccattcctaatcccaggaaaactctaggatattttgttcttggcaccaaatgtaagacaacctaaaaataatttataacttgttttcaaaaaagacatactctaactaaatgtaaatatccctgtcctggaatcttgctagaacaccaagatactattaagtttgctatagacagtcgatagggatctcactgagggagttttgcctctggcctgccaaagagaccttcttatgcagtgcctttgaagcagaaactttccaaggcaacataatgagcatggtatagttctataatttccaagtgctatcacatacaataattctttgaccctcctatttactcagtcccactcaactttgaccccagtggatagttcttacagaatgagaggaaaacagtccaagaggtcccaactcatcagcatatgatactagaaacatgctaaggcaataaaagaccatgaaaccgcctgattaagggtcacacgctcctgggtgaaacagttagtggatatcattctttccagtgtgtctaaatgatatctgcattcataatataaacatagtggatattttattggtcagaaattctattttgaacattaaaagaaaaccgtaaactaatttgagttttcaaatcaaatatgcagtttaaaaattttttcctcagaaaaatgttgaactgacacttataaaaattccagtgaattttaatttctagataaccacataagcaagaaaatgtgtccatgcccagttgaagttattgaaatatttattcagaagtgcattttactttcttatagttttattgtttggctatgaagtatattgctttgctaaaacatttttctttattattttgaagttaaaattttattatatcttgaaaaatactccaaaattcctaagaataacagcatattttcatgtatcatattttacaaccttcccaaggttacatagttaagcggcggcgcaaagcagatgcaggccgcctggccttgagaccgtgctctcagccgctgtggcacaaccgcctctcgagtgctttgttaagaatggcacatcctatctgtattagtccattctcacactgctatgaagaaatactggaaactgggtaatttataaaggaaagaggtttaattgactcacagtaccacatggctggggaagcttcaggaaatgtacaatcatggcggaaggcaaaggagaagcaggcaccttcttcacagggtggcaggacagagtgagggcaagcaggggaaatgccagacacttgtaaaaccatcagatctcgtgagactcactcactatcataagaatagcatagggtaaactgcccccatgatccagttgcctccacgtggtcctgcccaccacacgtggagaatgtggggctagaattacaattataattgaattatacaattacaattgactcttacaattcaagatgagattttgggtggggacacagccaaatcatatcactatggaaaggaataagaactcaaccctatactcagattagtgcttagaataacctttgctagatattgctgaatcctgagtgaggggatgaatttgaacaatgaagcttagagtttgctaggaaaaatagacattcacataaacatgacataagaaagaataaagtaatggagagagttaaaaaatgacagaggagatgaaaaagtaacaaaaaattctctattaattcttgaaggatgtataggttttgaacaagtaaagaatggaggaaagggcattagggactgagggaatagaattagcaggagcccagaggcttaatggtgtgtggcctgttttagaaccagtgctgcagtgtggcaggggcagagagtgagagaagccgggcagcagaaggcaggcctgacaggtagcttgccggcaccatcaataatctactagagttccccagctgggtttcagcaaacaccctcccttagctattcatagtcattccgcaatgggaggatccctgacccagtatatttgggcaattgcagagattcacaattcacattagcattttagcagctctaaaatgttctagaccaaggaaacccattttgcttaatttaacctggtctttccagaacactagcaatacaatcattgtgggggagcagaacactcactgatactttgcataatattaaaatgctattcggatgccatggtaaggagtgagatttttatagaacatagtgagccatgtaggttttggaggaaagaaatggcatgttcctatttgttttgaggcaaaataactcttatgaaagtatgaagaaataaatttagaagcaatatcagaaaggctgggaggttattacagtgttccaaaagaatgagattaaggcctcaaatctggagagtggaaataaaaatgggaaatgagcttcccaacaagaggaatgccgaggaaagactgagggacaatcttccaaagctcatgcttctcaccacaatggctgactaaaagaaaagtatatagagcatttgtttgtttatttgtttgcaggaggaaactgatgagttcagatgtaggcctggtggctcctaaatattcaggtttggatcttaggtgagggaccaggataaaaggtaatgatttgaaatgcatcagcacagagatgatatttgaagctatggagatgaaaaaaggttgatctgggagactggaaggagagagaagaaaggaaaagagatgaggaagtcaggggagaagaaggaagggaaacaggaatgttatagataataccaacatttaaagagtgaattagaagacagtctcaccaagaaactgtagcaagttcagaaagaaaaacaaagaggaaggagtttcaggaaggaagaaatgattagctgcacaaaactttccttaaagtcagggctgaaaagaggctatcagactacaagtaattctcagggcagattatgtcctcagtgctacagtgtcatcagttgttgaagttatgacaccggaaacataaagtgaattcttggaacataattaaattagatctatattacattacatcttatatttatgtaactatgaagtgcatttggttctagaatgtaaggaatgtcttccttacttatagatttgtagagttccctgaactcactaggaaataaatactttaaaagaccaaaataacaatctctaatacttggttccctatatttttagaaaaagtaatgtagtaatcatgtatcagccactggacactttccctcctagaatatggtcaaataaaggtcagtctacatgccattttgtctacagcagttataactgacccataaggccagattcagcccaacaaagtgctttgtttgatccatataacatcttaacattttttgagccaatatgaaaaatacagagctattttctaaaaatatagaatttctagaaaaatctagcaacagagtctttgaagtcgagcacagcgctgcttgcttggaactgagtaatagcagcccctttggacatgagctcttccactgtctagtgcctactaggcccatgtcactggtttatgcaaacctccttggccactaggacatttgagtttgcaaaccttggtccctctcaggtccaccttcactatggcccattccaagtcaagtactaaaacagtgggccttccatgtctctttcatttgaacccctaaacaacttgtcaaagctatgtagccttttgcatgtgtttaaaaagtttttcataatcagtttaaatggtatcaaataatgtaatttccactatatcatacattttggtgtttgaaaataaaacttttacattattgtttgaaactaacccaaaggctctttgctaactaccttagcaatgcaatacctagttattcattttttaaatatgtgaacaggcttttttttataattggaaatttgacatcactttcttttctccttgaacttatatttccattctactttctccacagaattttatcctactataatatattttatacttaaaattcattttactcatatttctttccaacagaacatgtttttaaattagaacttaatttttttctgtggccataagactctaaggtgttcaacatttcttttatactgttaccattacaattattcctagtgtacagttcaacaaatcaacatgagtaacaaaaacatctgttttgataaatgattgtcaaaaatgaaaaagactcatcagaataatagatatggaaattcaagatctgggaatgtattcccttaaagctgtccttcccatactatcttgtactccttgaaaaggcatcatgtaccacaagttaaaggaatcccagcctgaagacttctacttcaggtgctttacatcctgcagaggcactgacctggagcgatgtgcaacattagattatgaggaggggcagccagctcccacattgaccactgacgttagccaaatcgttaaccacctcttctcacctataataactgggctagcacactcctattttcccttctacttcaaaaatcctacattgcaaagatttccttattctcaaataacagtttctaccatgtatctgataattttctacttgagattatgtgacaatgagccaccaatttctgcccatgtcctaggctttctggcaggcctccaatctctccttacatctgcagccaaccttagagaacactggaaatttaaggcaaaaatgggcctttggcattcaacagccattctttttaacctcctcctttcttagctatagcatcattcataatgaagttttctataaacaggtagaagataaaagctttttctgtggtttttacatcttaatagaaaacccttaaaaaccaaaacctacaaggtggaaaaaagttcatttttacttgtgggacttcagggactgtggtagcatcagatgaaagatcaaatttgaaaatccttctcaaattgtaccacctgttaatcaggtttgttctatgtacttcccttcccctaagatcctgcactaaaatatgtgtcagagagtatgtaataatcaagacagaggttaataagtctcaaatgagcaagtaggtcacaagaataggaagcatggtccatccaatgcaaattccacatagaagcaggaagggtggccaggtgaacatgtagaaataagaatctggcctagtcctgggccagagtttatgttctgaaaaaccaggattcatctcagtatccctggaaatgtagcagtgctgagtatctcagttgatgctccatattggatggatacatggatgggtggatggatggatggatggatggatggatggatggatggatggatggatggatagatgcatgggattcaggaagagtgactaggcctttcaatagccactgatactatctcctgtgcccttttaatctcccttacaattcatcatctttcagttaggaataatgttcagatattcaagcacatactaaaatgcttgcattaattcagtaggtagaatgcctttactgagtgcaatagagagaatttaatgtcagaatgccattgctctaaggggcaaggaggagacctaacactctttagctaagacattctctttttaattatgttaagattaaccatgagaaagactatatctctaagacagaaagcttaagtagtcagtttccagattaaaaaaatcatcacttctttacaagcatttacaaatgcttgtcagcaggctccaaattcatgtttgacagctacaaatgaattctgatgtgggcaagacagtgtttttgaagccactgtgttagtgcatactttgttgcatacttcaaacttatattaaaggcaagtatattaaaattgtttgatctaaaatagaagccctggcccataaaacagtcatggacttctttttcaatctaattttaaccatattacatttttaaaaatttagaaaaagaaaacactattgacgttttaagtttttaagttaaaatattcgactttctatgagaaatccacatttcactctcaaaaaagatgacataatgtccttcaattatttgttcttgaagtacatcggcacttccacaggcaaatgagacactgagttctagactagtggtatcctgattattattagttttttttttttattttaaatagagctgtctaatgtatcatcagtgtccccaaccaggactttaggagaatgggaacagtcaccctgggacagcctccattttagggaagaggagaaagttcagagcaaactagaacaaagactcaggatgagggtaggatggaaaggaatgtctccatttacatgcttaacaaggtgtgccttgagtactggcatttctgtgttgatcccaagttgacaagattcctgaaaatgtcaagcttggaacatattgggcttagaaaggagtctttcttcagcgagggcttctcccagaatgactaacctgattccccaccatccccagccccctagcctcctggtgttatcccaggccaatgacatcaatgtcatggtaaacatttccatatgggaaacctagaaatgatttatttttcagttagaagaaaatagatgacaagtccttgaacacaaatgaaaacattcagaatcaaggcccaaaatactcaaacttctccaagaactcatcaataaatttctctttgcaagatatcccatcaaaccacaatgacttatttaacttcaagaacttatgcagcccagtgtagtaaacaaagttaggtaagaatcaaaatggaaaggtggaattttgaaagattttgaattttttcctcagaaaaagatggaaggggtatggtctttggatcattgtcacattgatgtgggccactcagctagcacctctcatcctcactcagtccgtgcatctgtaaaacaggactgatactcaccctatcctaaccaaagtatattaaaatgttaagaaaagatgaagctcatgatgaatgtaaattattacttttagttcctttataattgcctgttctattgaccaaaggaaagtgtccctgttatcacagtcgctggatttttcttaaacttttggtttgaaatttaagcatggaaacacctttcagaaaatcaggatacttactgcaaactacccgcctataccatttaatgaattgcaaagggatgggagacctggtttgtgctcccaggtctcggcatgttatacttgtgtgtaatatatgccttttctgagtctcagtgagggatgagtatctggatatttgtgcatttctttgaacttggaagaaattgcaaaggaggatgatgagatgggtcagtagatgtggtgactcaagacgagtctagaacttgcttacatatcttgagttgctaaacaagctcagcatgctttcaataaggcagagcttgtctttctagtgtgccttgtcccagttgtcatcacatgctttatgatgatattcctagtgggatttagagtaggcagacactgaaatcactgggagttggtactagttaagtcattcggcctcagtcttccctgaggctaatcatggggtcctctctgttcctccctagtgcttccatatttagctcttccttgctacaggccccagggccttagtcacctccttatagaatggccactgtctcgccagttcactgaggttcttccacataacacggttctcctgttcccagcagagaagcatgggccatttgtccttcgaaggcctggaagtagacacaaatgttaccttcgggggccaagcattatttatggtagtccataaatgattgaagagggctgggtgaaaacagagacaaactgaaggactgcctggtccatgggttttttgttgttgttttttgttttgttttgtaatgcggaaatgcaggcccaatgttgcctgatcttctggttgttgtttttgttagtttttttttttttttttcaagagaaaccagaaatctgatttttttgatgtgaaatgtattaattggtaaattttagcaacttagtaaatttttaaaaatacattgtcactggcaatattctggttcttgaagaaaggagtttatgagtgtttgttaagcattttgctttatggcttatgtatacattgtagataggagtattattaaatttatcatcaaaacctgggcagtgtgagagaataaaggggaggtgattaatgattttgtcagggatgagaacttttcacattttatgtcctccagctccctattttgaggagatggaaaaataagtatctgtaaaaaggtatagagatgggccctgatgggcaggcaggaagacattcaggctggaattaacatggtgcattcagggcatcaggagacctgatcagtttcagagaaagcgctccaaaaggcaatggttgggatacatctatttgataggctagagacagattaaagactgatatgaaagccaaagcagagggttcccaactcagtgtaactggcaataggaactaacactcgttcttgagaaggagagggcagtggaatacagaacagaccagaggaacagaacaggagatgagatggagcaggcaggttcacgacttaggatgcagagcacagtttaatactacattcagcacacatttgctgaacacctgcagtgtactgagcactgtcctatgagctaggagacagaaagataggaaggacataatccagtgggggggtcagaaattttaaaagagaatcatcatgtttcaagggatagcagagttgatattggtaggaagagtggaggcagccagatgaaggaggtgggaagtgagaagagcaccccaggcagaggtgccagcataagaacgtcgtgtgaaaaggcagtgacctgctgctccgtgtcctgagcttggaaaccctagtgagacattaggagagagtgcaggcaagaggatcctgcaggccttgagacagggcagaaaacaaggcctccagaaatgaggcagcaggaggaagtgtatgagaaagcagaatagatctagaaagagccagcagatcagaggataagatgggcaagtaccatgtcacagaagcaaagagaggaagtggagtttcaacagcggcctttaacagagagagtgcgaaggtcagagacccagaagaaggagggcttggctagaaggtcactagtaggctctggcttccatctccagataggctaagattaagccaattcaccattttcccacaactgtcaactctgcagaattgccttttcttcctctcagacagaaagggaaatcccagctgcctgagcaaccggtttttcactttcctccttgtttgcagagtctagtggggctggccctggtaacctctggtgattcatccagcacaccctatgaccacatccccattgtgtgtgtgtagagaggatgagagtttatgtgttcctctgaacgttattacaaaagaaaagaacattgttctctagaaatatgaaagaaaaagaaaagaacaaggtgttactctagcatagttttttctcaattatctgagttgtgaaaaaaaaagtaatgaatagtggagcttcctcaaaacagattctgagcgctgtcagtagttaacagtaactactgtggtggaattcctgtgtggatctattttggcactgtgttacgtaattatttttatcttaggatcagatctgaatcattcaaagccaatgtcttcagggcactggtgtgactccaggtgttctcacatgcctgtctttcttctcagatcactgcccaacactgaatctcaagtgatggacctcagtgcatatgaattcggggcctatatgttttgtaacagcaaatcctaccccactggtgaaaaagtctaataacctgactgattttctattttgatgagccctcaattgagagattatattgtggtagtaggttacacctgcccaccatgtgaaaaacaaacagtaaagattgagaacccaaatgtgtgtctttagaaattaatccgtacaatttaaaaaactgccaaaggaaatgtaaaagatagtttcataattgttaggtattaataatatctattctaaatgtatggcttattttttactaatataatagaaataaacaggcttggacctaatgtaaattgattcttaagaattcactgcactaatagtttggatttttgtgttcattctatttctgtggcaggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatcta

SEQ ID NO: 1438 - DNA, 605418 bp, Homo sapiens; identical to SEQ ID NO: 1437

SEQ ID NO: 1439 - DNA, 101038 bp, Homo sapiens
gtccatgactggtgagtttcaataatttattaaaatagcatatttaaccatggttaaccaagaatatgttaactttgtgccccccaacctgcccccgccccagatacgcagcaaaacacagtagtgatttcaaatatccttgatcatgaccaacaggaatatttcaaagtcaagtttgcaactcaaaagtagaccttggaaaaactctgaattaaaagagaaacataaagctctcacacagaattcttttatctgccctaaaatcaatgccggcgcaccaccacctgacaatactgctaggatttttctttatgcatagtataacgactcatttattaagtacccactttcataaataaaatcggcattttttgtcccgcttaatgttccttttcagcttcacaaagaaaccagtaaataaaactgtcaacgacagtcacaacatatgctctcacagcaagataaaaaaacttgaaaatacgcagagatgcatctacgctattttacataaaaagagagattcaaaaagtgcaaggcaaaatctgcagttttttgaggggagcttttaggcacatccatttcattaaagcaagcttcagaatgaaattccagtttgttcttcatgacacctgttaaagtctttctttaaacgacaacaaaaaaaagccaaaaatacatcccatcaagtgtacaatggtagtcttgtgtcctaaaagtgaggagttcagctgtggcgagtccgtcctttctttattctggcaggctttggtttggggatgtactgattatttgcctggtactcgagttctttacggaagtagtgaattgctttgtttaaaccttcctccagcgggacctgtttaaagggaaagcaagaaagggagacaaggtcacattgacagaagggcatcgcaggaaggaagtgccaccttgcaggaaggaagtgccaccttgcagccagtcaggcctccttcagaggaacactcacagaaccatgctttggttgtgacagcatccagcatcacggcccaccgagagaagccagaagtccttcagggccgctttcagaatgtactgtggagctgacaagtgtcactcttactgacgtaaagtgagctccacctcacaaaagaccccgactacctcttgctggtataatgtctactccagtttgaatcggctggcaagattgtttttcagataatgcccatgtgccccattctttcagaagaaatccaccttggagtggcgggaagatgctttgggaaggtgatctgcatctgatcaacacgcctgattctcccacgtgacatcaaccctttgcactgcctagcggatcatggcccacttgcacccccaccatactaagaggctgagtctgagaggggacccacggcagcccacaccacagaaagcaaccttcatctgaagctgctttgcagccaacaggaaaccagccagatcaactgctgattaacagcagaaagagaaaaggtgaagggaggcactgctaaggggtgctggggcaccactgggggagaaggtctgtcagcttgactgcagcgatggtttcacaggtgtcaaaatagatgaaaacttatcaaattgtatcttctaaatatgggcagtgtgcagtttgccaattatatctcaacaagctgttaaacacacacacttgggacaattaagatggataatgcctgtaagtttctttggatcatatccctcaaaaatttattataaattaaaactactactagaagagaaaccagtggtagatggctcacattccaagaatgttagaatattataggtctaaattccagaaagataaagatactgagcatacacacacctcacataaaaagcaatagttaatacatagtgaatgtatatttaaatcttcaaaaaatattttgtttaaaaatataggctctccttacaaagggaccaatggccccttacaaagcttcaaaaaaacaagaaacctaggctgctataacctgttttgcacagcttgggattattcgattttgtgaagtctgggtgtaattgtatttttatttcactcaacaaatttctgcagtttttagcagattacgtagacttgtacatgacagaatgaaataaggatcaggctggaactctcatgtccctttgaagttcaatattctaggattctactcactcagctctgactatgcacattttaaaaaggtaaactgagctctcaactgcgtccctgactctctgactgcgccacaacccaagggccatgccaagatgctcctacatttgttgagcacccagtgtgtgtcaggtctgacaggtgccgggctcctgctggacacagggctacactacacgcctctgcccgaggggagcccgaatttcagtggggcacatgagggtgggcaaagagggaacagccaggcagaggtgacagtaaatgaggtgggcttgcttctatagatggggccaacccagccaacctccctacacaggtggtctctgaaggacacaggcagccctgaggacgagcgttctctggcggggaggagcctgcagtcacccaaggcaggaagggcacagcaggcggcagagcagaagcaggcggggttcaggctcagccccagggaggcagcagccgccccaccctgcccccttcagtagacacactgaagacaacaggaaggcatgcagttccccttcctccacacccttcagtctcgcacgcttccaaccaggggctccactgcggggctgatggggaccacttgcccctgacctggccccgcacactcaataggcaggcaactggggctacgcagggctctgagcgtgtgctgccagcgcccttggcacagcgttcacagtcaggggtgtgtgtgtgtgtgtgtgtgtatgtatgtgggagagggagtgtatgtgtgaatgtgagtgtggatcagtgagtgtgcgcatgtgagtgaatgtgagaatgtgtatgatagtgtgaatgtatatgtatgtgtgaaaatgagtgtgtgtgagtatacttgtattaagtgtgtttgtatgacagtgtatatatgacagtgtgagtgtgtgggagacagtgtgagtatatgtgtgtacaagtgtttgtatggcagtgtatgtgtatgagagaatgtaagaatgtgtgtgtgcatgagagattttacgaaaacagagcccagagcaggggcttccagccgcttcccaggtaacattctctgagactcctgatacaggagaggctgtttaccacttggagaaaaccctctatctgcctggatgccgagcccaccttgctcctccgggggctgtctgacaagggtcagtgcctacaggacagcagacacaggacacgggaggcccctccccacaaggcagcattaactccctgcacttaccacgggctcccaccccagcatcagctttgcttttttgatgtctggttttcttttctgtgggtcatcctgggcttcggagagaaactgaatttcacttccgctacctgagatgtttaaagaaaaaaaaggtaggagagaatcacaaagcatgggtaagcacagccttaccatccacatcaaaggcaaaccccatatgtggtgtgaatagggtgcaggcggtggaaatgcagttctctgagaagccccggagctcccgagggactgttctgcgtggaagtccagggagtgctcctgcaactgctgtggccaagctgactgtgtgcaggcgcccagcaagagctcggtggggggcaggttattctgtctcaacaggcctgagttaccgcccactacaagagggttgctccaaggcagaccacccacaccaggtaacaagtgcagacgtgcccaccgagcatgaccccggtgtgagaccacaaacgtggtgtggggccatccctgaggtggatgccccaagtgggccatacctgggtgctcggagcctagacagccctgagacccaagatgtgcagccacccagctggagggacctctcggaggacggcaaaggctggcctgttccacatccttgctgggcccaggccccactggccagcagtacacagccccaccagtgactgtgggccagacctgcagaagaaagcctgtggaggctttccctgcctccgtgtcatggaggccacattgcagactctgcagcgaatcaccaccacaggtggttcaggatggtctgtcacaaagctatatacagaagcacagcagggaagctgcacgcccctccccccagccttaggtttcaaatagtgtttctcaagcgtcagcacgcacggatcacctgaagagcctgtcaacaggcagatcctgatctgggggcctgggctagggcatgagagtctgaatttctaacacacatctgatgatgctgctgctgcgttggcccacgggcctcactctgtgcagtgagggtgtgaaggagtggatggcacagagctgtgatctgagcctgccccttcctcacgcaggaggaacacacagattcaggatggaaaagctgggaagtgcatcggagcagctgtgggagccacagatgatgcaggctatgtctgaggaagaccgctgcttctactgccacgagcaacgggaggattccagccatccgggtcgattagaccaatgccgatgaatggcagcctgatgccaggaagggcacactggaggaattaacccagccaagcggggtctgaatggtcacctcaggacacactgtggcatactcctccttggcctacctgccagtctagtctggttgtgacttcactcaaatttcaggatcaaccccagacaacagacaccctccaagagtctgactcctcagagctccaggaagtctgaagatgaggccaagggctcatccactctatgtctgcaatccagggctggtctggaagacctgaccttctcatggcctaagagtccaccttgatggggtgctcccaatgctacactgcccccagtgggtggcagccaggataaccagaattgcaaacagaatttcaaacctgcctgaagcacgcagctggtggttgctgtctcttgctgtctgaaattctatgcttgacatgaccagttcggaaatccaatagttgtcacccatgtaggatgatctaatacaatcgtgcctcaaacactgggagcaaatctcctcctccctcccacttcatgcaaacctgcaacgaaaactgaggagaaaccaatcctgccctcctttatctttctattccttaaaaattagaaaacacttaagtattcctgataaaaagttctgctttgatccaattcaattagcttgtattaattacccactttctagtcaaggtgttattaacagatagggcaggcacagtcgattttactcaggaaatgacttatcctacttaccaacaaggtttttaattaactgagcaaattctaggattgtgtgttcttctgggttcccctaagaaagaaacggtttccagttataagcgtcatgacaacagcagcaatccaccacccagaccacaggcgtgtctgcagagacgtctactggccgagtctgacctccctgcgctgcttcagcagagctccgtgtgccagagggtactccgcttccaagatgacagttactcacctggcagtgctaaactgcaccatctataccttcagcctctaggctgctgtgtacaaggctgggctttggataggtcaagagtttctgatgaaggcacacactcactgagtatcagacaatttccatatctaacataacttcaatgtcacttttataaaagcttgggtttacaaaattagctctcctaacactatctattcccgtctgggtgagctgtgttaaccatgtcagtgatgaaggacttgtaatctcacacccaaaagctaaggcagaaatgagtaggctcacaggcgagtgtccccggcaagccagaggacaaactccatgcatttcatgaagagagaatacttgtgtgggggctttaaggaaaaccatttgctctttttctccctcccatcacacatcagagcacctgttactcttactctgccaccactgccctcatcataagagaccaccataaagtctgataattctataccctaaagcctcttcatgcccaggtcctcggttagcctgaagctagatggtaaatgtggagggagagaccctgggcctcaatggagcacagaggggatgactagcgaagtggagtgacggaaatttgcaagaaagtgattctgcctttctcctggcagacacacgattccaattttaggaattgtccctgtgcaaaggccctccccaaagagggaaggaggaacatggtatctacagagaagagcctggctgcccagggaagtcactgacaacacccttgctaaagaacctgcaacaaaaacgcagagcaggggcgcctcgggcctctccagtgtacacaggcaaatgctgcaagcaaaatgaggcttacagtgtgaggcacgttctggtctgttttaagtgaatttttttcaaaagtggcacactgtacccatgaatcagcaacagtcccagaatggagtcagcactccagggcaattctttcctacgtgatgagaattccctttcacctcagggaaaaatgcatggtctgcaatgtatttgagatggctggttacaaagacatgcataagcaaaggtgacatggtttgcaagaaataggtcacatggccaacattttagagttccctgaactttagagtgttgtgtaggaaccaggagaggtaatttgggagaagcacctgaaatgaccccaaggtagggttaagggggaggtctctgtgagctaagaggttcttgtgtccactgccatcaacagaagcagaacatcttgaatgctggacagtccacattggaaaccttgcattttaaatgagatggaacaaaactgctcagaaaatcactcagtgacagaaagggtaagaggtcctaccatgaccttggctgatgcaccaaggaggaggcagcttagggggtaggaccatctccttcaaatccttggagagttaccacactgtagaggcatcacactagccatgaatggccccaggtggagaagtgaggtcagtggacaggtgtgcagaaagtgagatttctggtccaatatgaggaagagctttctgccggccagaactgtccaaagacagggtgaatttctctgagcagaagcaagttcaccagcactgaaactgctcaaggctggatgatccctccaacagggaggttctggggctgtgggcaggcatgcagggaaggcgagaagccatgaaggtggtctgtccggctaaatgacagacatcatcagcaaccggaaaattttccctctgaacaacctccatcttctaaaaatgcaatcaggccttataatgatgacccgcctgttaaatagagaacgagatgcacacacacgtccacctactaccaccaaaaggcttcacacaatcttagacccaggcccttcagaaggtggagggactgattacatcactcacccgtgccttgcagatgttttacttctttgtatactcttactttgtgtttgtttgtttttcctctagtatttagcaagcaacaaacacaaatgtcctaagtgtgccgatggcaaatgaagcaaagcctggtgctgctcatggtttcacaaatgaacgaaagtctgagctgtcctgcagagtggagggagaggagcactcaccaggttgaccgggctgctgacgttgctgttcatgagagccacgaggccattcactagatcgctggaaaaaaaggggaggcaggtgaggctctgcctgctggaatatgctagtgccacgcaccacatagaagccctcccagaagaaaaattaccacccccaggagaaaacaaaaacccaaatggaaaattgaatgtcgaaacaaaatcctacaaactaagatggtgtttacaatgcgaaagtatttatggatgaaatgatatatttgatgtctgggatttgctttttttgggtgtggtggagatagttaaataggatggaagctgagtgatggggctgagttcgccactgcatttctgaagtcctttaacaattaaaaactaagcataagttaaaacaggcatacactcaaaaaagatggagtttacataagtttccaaagaaaattcatgtttaatgtgaacccagtagttgacctgtacgaaagcacatgattacttttaaaaacaagatccacggaaatgaacgaactccagtatgtgatccccatactggcaaatcacagataaaggcaaacaatactgagggttgaaataaacagaaacgtcactccctactcccccaaccttaaagtcgccaccccccaaaacacctcgtatgaaacggtcagggatatttggatgtttcaaatggattgtgatcaactaggccatgaaggtgaagataagtaagcaaactttcgcttaccaaggtttggttcttattttcagaagctttaaagtgtggctctgttaaaacaaagttacttcgtaaaaatgacacctcactgctaagcacaagcactttttctacgccaattttccatgagctacaattcttagaagacttttaaagctctgacccttctccttctcctcctccatcgttaccagtgaggagcaggtcactctgggtcaggataaacttccaaaagaaaaccgcagataggttttgctttcaattgaaaaaacctattggggtatttcgtaaatcagatatttctgcgttttcctttacgacaaatgcgtatttcatatgaacatgcttaaaatgttctattctcaaggatcaagcacaaatgcaaatccctgctaaccttggatgatttctcctttatagaaactagcaaaaagtcacttcatcactatggcagtattgctacattacaatagtgcactcatgacatacatctgtgcaggtttataaaaagacattaaaagctgccattccattgcatccacaatatgatttaatattgaaactggggggtggggtttatctgagttggaagaagggtgactctcaggcagtcatcctcagtggggcagacgggagagccatgggccttttacatgacaaactggcaacttttaaggtcaaaattgcatagatcacattctttaacctgaagctctttacaagtgtcattttgacaaagtgacttttaaaaaatatagcatgcctttgttatgtaaatgaggacaaaaccggccatgagaatattaaacagagtcatgccaaaatgccgatgcggatggccacctagacctcagactccctgcactgttgtttcgaggcaatcatgggtttggggaatggttaatttagtacagtaactatatggacccagacatcgtgcattactaaaagacgctcagttcctaaaaaattgcttgtgaaaaacatcaaaactttggtcagttaatgaactcatctgagtcctcaataactaaaaagtttaagtcaggaaacccttgcccaagtatggcaaagtccctgaagcctcatcatctcagactctgctaatgtgaaaccagagaggatcaccagagtggggagtaaataaatactactgaagtgttatgaaatgggttttctaaaagggttaacaaccatgtgtctagggaaactgctcatgccctcttttcaagtagtcaagtggtgtgggagaggacgatgcatgtgatggcagctaggagcatgagccacgaccatcaaagcaggcacaggacagtgaccaggccatcagagcgggccagggtgcattttgtcctgagctgggacagcacatagcacaggcatcactgaatgctcaaaatattttagtcctagcaaaaagaaaagtctctgaggctattttaaatgaattttgcacacaatgcccttgagataatgagagcagaaagaagaatgggtcctgactggtttccttttaccgcacaacatctcattgatattccatgtggtgtgggggctggagaagcctgggcgccactggtgaggcagcccgaggcaggcacacataaccgaggacagcaagactccctcagaaaagggcacagctgggtgagtggaggaggatgggataagaacgcgtcactatggaaagacggtactcaatccaagggaggcccacaatttggtccccatacagaagtgtgccatgatagtttcctccagggacatagtgcctacgttaagtgctttgaaatgaacacagtcccaaagcgggggcagctgccatttccctgttaaatcgctttttagaatatgcatgcctatttgggccacaaagttggttatagtacacttctgggcttttgccccttgaggcaagatattaatgggtggggaggaaaaaactactggctgtgtaaatgtttactcacagctttcttttggagtaaatggaaattcacaaatactttcagcaaaaatctacagtggttattttgatttctttttaaaattttattttactaccagttccatttctccacgggactcctacccaggacccctacctaagggtcctgggtaggtacaattttatgtggttgctttggctgaggtgggacttgggggctgccccgacctgcacaacagccaccatctcaccctagtgcccctgggatggccctaagacagcaggaataacacttcctgattgacaggcatactggggtatttgcaatgaagagtgaaaatatgtgggttcaaaatatagaactgggttttacaacaattcaggataccagaaactttcacagaatttacaatagccacatactggtggatgcactttggcatacacaactgcttctatcctaactactctgagaatccacactgccttctaaaattaatcaccaacggaatggaacaacagaacagtgggtttataagggctgccaagaaagcaataaaaatcaccacgtgaatctattcaaaaaatatatttttatctgcatttagtttcagcgtgaaattcaacataagaacactatctaccttgtgccctccacaaggactatctcctccaccccgcgagccatgtttgcaatgggtcagattctggcattcacaggtctgctggatgcaaaaggccatctcttaactccacctgcgctgaaatcacccaagtcaccctcagagctgggcaacttcacccacacaccgctaggtggcagtaaaagattagcacatgagtcacgatagtcatggagatgaatgcaaattttaacttttaaacagagaacagcaagttttcccatcataaaattaaaaatttttaatcaatatatagtgttagcgttgtggaaatggttaacatatacaagacactgaactgtctgtcaagttggcatgacccctgctccaaagcactgctaaggctggggcagggcaggacagtcttacctgacgtactggaacgcccttgtctgagacccggatccgtatacctggaaggaaaccaacagttaggcctcctgataaaaccacacccgtcctgcgtaggtgtccttgaaactccaggggacacagtccgaccttgaaactgatcccagggggcagtgatgctgactcaaagcatctagcaccacatcccgcactctacttcgagaccatgccttgacagtgagatggtggcagcaatacctaaagtgtgcacctggtatagctgtgtaaagttttccctcaaaagacagtgcctgaaggaattcgcttctgctggagtcttacgatgtgtcaggcatcatgtgaggctctggggggctgtgacctcagagtccagctaggtgacagatctacacacaaacattaatacatgcatttaactggggttcctcacactgactgcccaacagcagagctggggatgccgcccaggctggttcacagactgtttgggatgaggccggcatctcctggtattgttacagctagctccccaggagattctaatataaggccaaggtggagaggcatgcaggagactctgaaagtgatgcggaggtggcaggaggagggtcacattcccctttgtttccactgcacatttgctccacacttccatagcttggcttgtgttctttgctctgccagctgagaccgtcttgtctactttccacctggcagagtgctactcatcctttagggacaagctctgatgccacctcctggagaagcttctctggctcattgcccagggaaagccctttgccaactgcccccaactgtgaactccccagaaggactggtgtccgaaccccctttgccctgctggagcccagcacgatgtgaggtgcgataccagcatgggatgagcatctgctgaatgacctgcggagcgccacggatcacgccactcactgaggcggagacggcaacagaggtgcttggggagatctcctaagcgcggcatcacaggaacaagagtgccctcgggggttttgtttgcttgtgtacctccctgtggtggaaagcaggcagctgggaagaagggactgcctttgggaacaagcttgattataacaaccctggggtctcttcccgcctgacagcaaaaaagagcccctgccagcagctctgtgaacagcaccagccccctcagcaccagacactcagcctggctttcccagagctccccgctccagctctgagaaggaaaaggggaaggatcaggtggagaagaaaagcacacgcatggcctggcgcggtggctcaagcctgtaatcccagcaccttgggaggccgagatgggcagatcaccggaggtcgggagttcgacaccagcctgaccaacatggagaaaccctgtctctgctaaaattacaaaattagctgggtgtggtggtgggcgcctgtaatcccagctactagggaggctgaggcaggagaattgcttgaacctgggaggcggaggttgcagtgagccgagatcgtgccattgcactccagcctgggcaacaagagtgaaactccgtctcaaaaaaaaaaaaaaaaagcacatgcatcaaaccccctgaaagccttatttatttatttaaaaagcaggttcaaaggctatctctgttttcttaataaacatttatatgccaattccacaggtgtatcagttctatctatgtaggttctgttcttggggggaaggccttacactgagaaaaggctggggatactgaggaatggggattcctgtcaacacagaaactacagctgcaacaaatctcagtaaaggaacattgaggaaggatgggcatgggcctcttggaagcagaggggaattccttgacagttctgcctgaacctgattctctggcctggctgatacttctgatacatgtgaggaaggtaggaagcagtgggcctgagttggtaggacaggaggtccacccactgccagctccctcagcctggaaactcccctctacaccagtgccgtaggtgtaactctttttgttttttacaaccttattttggagatgaggtaatggaaggtcaaagcgctggagtgacctgcattcagcagagtgaaatttatcttgactccaagttcagaattctttttcctgccctattgtgttcataatttcagaactacctgtagatttttttttcttttttcaaactgtggctctcaggctggcaccaggccattctccaacctcactgtagtgagtatcggatttaggcaactcccgcgtcacaggctcctccacaggtgggtttggggctgtgctgctgtcctgcccattgcctctgtctgcatccggggctctgctctcaaagctgagcgcacagatgcacctctgctgcttgttttgcaccttcccaccacactcagtcagggccactgtgatggtgggctcaccagtctgctagtgcattccagccacattcacagaaagcccacctttgtccagagcggcagtggccttcaacaagccagccgaggccagtcttcagtctgatctaaagcccaggctcactcatcagagcagcggtgtccactcacacaccgtctctcagagaggagccatggaagagcacagtggcagctttccattccaccgaaacatgctgaccccaagccctggaggaacacaatccagggcaatacatgctgggtaagccccccgaccgggatgggttaactaggctgccagggtcaggatgtgaagaaccacgccaggtacctgctcaaccaaacaagggacttgtggtggagacattcagcagcttgaatatcacttaatcccaaagggctgcagcctgggaagtccaaaaggctcccaaaataacctgcagtctgctgggtatttcccaccgttgactcattcataagtgcactggaaggagagttacgactgtgggtgcatttccctgcgtgactcgccaggggcagctccccacccagccagcaccgacacaaggttcatctgcaggcaccacggtcaccgggtaagctatgctgccttcaggtacggtgacaaaaggtgctcagcagcactccctctgaggtcccacctgaggcccaactgggcctcaaggaaatagtccctagtacaagaggaggctgttctgcctgggctgcagtggaaaggcgtggatcccgtgggacgcccactgcatacccccacagaccttgctgacacagtcctgaaagtttgtatgctccagtgtgtgcattaggctaagatgcaatgtcagtggcagcctggaatacttccttcctcatgtccttaagagtcctgctggatttcagtttctatagcatatcacatccatcatctgtactttggtttaaattagcctacctatttcactaacacagtactttgcaacatgaggatttgtaattcatgtgtgaaatattcactgtgtgcgctaatgtgaaaatgtaaagtaaaagaaaggggtgtgtgtgcaagagagaagatgctatgcaattatgccccatccaaaatatctgtcttccctgggctctagaatgcaactgcagaccctgtgtacagccctcccagcatggtctgaggccttccatctcccccacttcaagataaggcctgcagggacttggcacaaattgagtgtgcagcaaaatccagggcatgagtatcacagggatctggtgtggacagctgatggcagcagagctccctcagccttctcattgttcttctaacagaagacagtgtgagattcggtccctctggcttcatttcacagaacaggagagatgccaggagattcgtgcaagagtcaaggctgctactgggggccggggaacgaagggctgtgtgcaggtcaaagcagcatgatgatcaaggagtaaccaacaggggagaggaccggccgggggtgaggggcagcgaggagctctcatgatcacttagcaatgtccccagccgctgtgctttatgtgtttaagatgtaacaaagattctttgcttggccaaacttcgttcagcctcgagtaccttctcctaggcccatttgtgcacttccttgtaaaatgtagttttgacaagaaccctgctaagtcagtttcacaagaaacccttaccctcgatatctgatcaccctcgacatctgacattcctcaccccccatatcccctagagtgtgtccgaccaccctggcctgttgtcagcaagaatcctgttaggttggtttagctagaatccgccttacctctgatgcttcctcttaataattttccatccactcacctcctccctgctccttggctgtaaattctgcttgcctgtgctgtatttggagttgatcccagtctttcccccccgaaaaatcccactgcagtgatccgtattcctgtcatgatggtcctgaataaagtcttcctcaccatactttagtaccattgaataactgtttaacaaatcctatggctttccgccacaaacgaaggcccaatgtaagaatcacttaacataccacagtatcaataaaaaggctaaacatcataccagctttgaattggtcttagaagtatgatttttccacaatttccctttggaagaatagcaaggcttttaaaatgatatagcactggattcaaaccccaattctaccacatctgacctgtcctgggcaaatccaaacctgggataaatcacataaggtggaaagcagaatgacccctcctgtgaaggtgagtgccataactgaactgtggaccaaagcctcttcgaaaataaacttaggacaatagctctacctgaaccatactcatctattttctaatctgagatgcaaactttgctgaacatgattccacttaaaatatagctttgatgtatgatgcacttaacccagcgacatactccctgagtcctcatcacaggcatctggtacagcaacgagtgagatgctaagacaggcatgaggaatctgctcaaaaacacggctgcaaggtaagcaatcatacccatccagcttggaaagggagaacgagacgctgagctgtttctggccaccctcaaagaggtcttcacctcagaagtgacttgtcggaaatgtagcagaaaaggaaataggtggacacacctccttatttcccttcctcagtaagccgagtgtttctaaagacaggctggctcaggcaggcctgcgagtctctccctagactgctccacagagccatctgacaagagcaaggcatgatatctcaattggacagaaaagaatgaagtcagtgacttcatcaaattcttgctgggaaatagaattctgtgtgacaaaggaaacaaaacacattctgaaaggcctccctcgggacttctgcctcctgccaccagaagctgcctacagagactgaagcccaccacgttctcgattaactgcagtcatggacggctccagagatcttctcccttttgtctctggcacaaaagcttgctcggtgtgaagacaacacatgagttatcacctctgccaacaatgcatgcattcttggggaggctaggggacactgggagccctggctgtggccaaggaggcactaaatcaagctgcttcttggaggctttcatggtttcctctaaacaaagcagctctcatctcacagcatgaaggagtttctgaacacagttgctaaaaaggcaccaggctgtcctcgagatgtggaattctcaactgagcaggtggactaaggggttcgcaggtcacggcacgagctcctaggaaccccaagtagcagcaagagggttacatgagatgatagtaagtttcaccactttcacttaccataaaggaaagcggccactacaaatccaataattagtccactcaacatttctctcctgcgcccacgtacctggtggtcttctggaagctggggacgcaaccatgaatgaaacaaagtccctggttttgaagagcatacactgtactaacagagattggggctgaaaaattcgtatttcagttggttacaagggcactgaagacaactaacatggttatggtaactagcctggtgccataatgcagagaagcatcaagaaggttcccttaaggagaggatgaatgaacaagaatgcctggaagaaaagcaagacgctgctgggacaggcaggagcaagggagcaaggaagcccggcctgagggaaggtgcggaggcaacagggctgtgtcccgtgctctgctggagctgcagagccacttgagcttccgacccctctttacaaggctccctccagctgcggggttgagagtacacaggacagggagaatgagagtggctccaaggctacggcaataaataggggtggggcggcagcagtgtagaccagggactggagtctggatctacctagggagggcacggccattaggatgtgctggtggatctgtgcagtgaaggaaggagaagagccatgtgtagtcacagagcctccatttaggggcaccaagataccacttagtgacagggggaggtgggagagctggcatgggctgttgggagcctaaagctgagtttggactcacctctccccaggaatgcactcagcgaaactcagctatacaatgcagttgcccttggagagtcatcccactgtgtaacaggctaggcttttggttctacgttggtagcggagcagccaacacagacaaggagacacacaccacggagaatgctcatgaagagcgggggctctggcttcaaaacccaggctaccactgtgtggccacctaagcttgggcaactcatataacctctgcgctccagcatccttgcctgaaaaaggaggggaataatgtcacctgcagatcataggacagaagagtgagctaacgtgatcaaccaatcaatgggtagatgcatatgtactacacagaaatacacagagctataattcttccccctggaatacactcaattgataacaaaccatgccacaggattttcagagtaacaggatgcaaatcgactcgagtcccacaaaatgccatgctggaaagtgctctaggaggctacagatcagaagagcaaagcagcctgggcagacaaccacgaagaggagtgaccggggagctgggggtgggagggaggattagcaaaaccaaagatgccggcagagcctctcaccaggcaggcctggggtgctcctcccaagggaggccagagggctgtgggaacaggtgtggaatcagcaaacccaccctgaccccagatggtatctgagggtaccaagcagtcagtgtcggcacagacatctttgccacacacttggaccaccgaccacagatcactgggacctctgctggctccagaagtctccctgggttgagggtggccagtggaggatggtaccgagggcctgccggcattgtcaaggtgacggcccagcctgaccagatgtggctcacctccccaccctacctgtccaggcttctcagccatccgaggacacccagtacaggcacacccctggctacagccagcaggccaaaagtatgtcggagaaggtcttcacaggccggctggtacaggcaggcagacctggaggcatgggcagggaccccagtggccatggagggcaaggtgactctagtttcgtggagcagccatgcatctgggttatgtccccgtgcctgccttccccttagtggagggtagcgggtatacatggcagcttcagaagtgtcactccctgaaccaagatgcacttatccctcatcctttgtgagctgacttcgatttgggttgcaaggtgctccctgagccgaggccagcacctaccgtgagtggctccccctggagcgcctgcaggatgaagttgctgactactcgcccatcgttcatgtgcatgcgtggcccaaaggtgttgaagattctggccactcgcacttccacgccttcctggaacagagagaagaggaggtcaggtgtgctcccctgtgtggtccacgcatccactttgcatttccagtgccctgcatgcaatgcagaatggaaacgttctgctttccattccaaaatggaaatggcttttttgttctgattccataatgtgctcattatagaccaatcgggagactacacagggctataccaaagagagtcaaagctgtcccagatctcgccactgaaaggccaccagcattaatattttggtagaaaaccagccaaacagtacaaggaggaaaaacgtgtatttatataattttttttcccagttaaatatatattttccaaaatgggatcatgttatgaatatgcttttctaatctttttcacataatatattgtgcaaattaatcactcaatagagatttagatgtcaatgaatatttaatagctagggagaaatacaagaaagctctctatcttaggaaaaggggacacagaaacgttcttactgagtgagcttgcatctacactcccaatctattttactaaaaaacatctgttttagtgagaaactaaatacaacttagtgcccagtataggttattagctaatggcctggaaagagaaacatactgacactgtttaaatagtcatccctcctgttcattttcacctctatgttcattttcaagtatttttaatgcttctatttttactacaatgaacatgtattacttttgtaatccagaaaagcctgttttcaaatatgcaatcatggaagtgcatacttgaataacaaaagcctgctctaagtgatcgtgttaattattaacttcacagactgctttgccatggatggaaaaattaaatgtttttatcacaaactctgaattagtgggcttttacagtgtatacgtatctaatgtttgatccactgcagaacaaacgtgcactttctgggcacctgagggcagggagcctggggcgtgaggacctgggctctgcttctcactgcgcccatgtgtccgccgttcccgctccaccgctcactgcccaggcctgccactgactcggtcgcagcaagactgggaaagaagcagtactcacctgaccgcctcagtgttctaagactgaagcacaggcccagtggctgtatttggtgccagttatcactaccagctgaaacagttcttttttcaatttcggccaacaccttaggctggcatgggttgggaatgggaatccaatgaacccttagctaacaaggcttacttagcacagaatttctccaccagtatagcgagttaaagggcatgaaccacgagccccagaggccccatcagccctctcagtggctggagtgacacggccgccacctcggcccacagcaggcttgtcaatttccctagggtgttccacaaacccaggcgggtttttaagtgtgctgtgatatgaaaaagggtgagaggcatggaagcacacagttaacttttagaagccagagtgctttatttgtgctaattcttcctagtaatacactgtaatacttcacgtgagccactcagatactcaggacaaagatatgagctaagtccaagaataaatcaacccttttctccaccgaactaatgagtgtattaaaaagggtggggagcagagatgctgctctcaacagaaaatgactcagaagtacccacttgcatttaattgataagatgaggaaagaaagtgaatggatgtggctttattctaggaaaagactggaaaaacctcagcaaatttacaataatcaacgcaatgtgcctggcaggggaaaagctcaatgggttaggcaaaatttgcagcaaatcaaatgcttttatcttcttgacgttccctttccacaaaacaatattccggaacatggcctcattaggatcagcagacattaagtgtccaacccataaacaggcttgcttgctgtggcttttctatttgggcctgtaatggttcagcaacagagggcagcccttctatacaggtgcaacagccgttgagtgcaacaacacttccaagaacacgagctctcaaggctggtctacaccaataagacaagctactcatgaagcctaaactccttacatgaaatagacaggaacccgaggctcactccagttaagccctgctctcctctgggatgatggtgtcttctggagtttgtatgcccatctatccctttctaggtagcatcagggaacccttggccttcacacaaaggcgacccccagtcaatatgtatagtccacttgctgctgaatcctcattctcactggtcctcacggtgggaccatgtgggcaggcagggggacagtcgatggatgctgacaccactgttgatggtggcagttcagttgccacccacatgcatggattggagaaaggtattcctcatctcagatctgaggcaaggtccagggtctgacccaaagccaccttcctaagaagggaagaaccaggctgaaaacccaggaagtacacaccaggcaacgctgtctcatttaaggaagagcccacctctgaaggaccaagaagcaaacacattcatgaacccctgactcccacacaatgttctgcctgcgagtggtcaggccctgctgacactgagctggtgcctttgagcatagacaaagctgtcagtcagaaagctaactgctgattcatcctaggcatggctggatttcactttatgctctgtggttttgtcccctatggtggcccatgagtcatggacagctccaagcatcaggaaggtcaagacaactcctacaagcctgagctgcaccaacatagaaccaatggaaacttaggatggatgctgagggacctgcaaagggtggaggctggaatgcctggatggcctcgtctcatcctgggattcattatcccaaggaagtcacttcagtttctaagacttaagatcctaatctttgagatgaggacaataatatccattccacctacaacacaggggttaaaacactgaaactattttgaaaactgccatcattattatctacctccaagggatggttctcaacccagtaattgcccttgacctctgtccccagttttctgatgacactaatttactttgaagtgacagtgaccacgtgtggaatagctcacaaacattgccacaaggacactaggattgcaaggaacaggctgaggctcccaaaggccctttggaaacacgaactaggctggaacagtgtaactggcatcaaacgcctccttgcctcattcgtagcagctgagagaggggtgagggcttgggtatgcaggtcctgagacgtggagccaactaacagcaggcctgacaggcaagaggtgacccaagaggagtaatgaaggtacagggattcctccctccccagatatctcccaaggacagaaatgttaccagcagggattacacggtgtacagagcacctctgacagaagtgattttatcttagaaaatgactccatttcacatttcaaaaggcatccagccaacacggtccagatatttgcataatcaacagagacaacacccaaccagattaagggcataaccctttactgtcagtcctcaccaaaggactcaagggcggtaatgagcaggacttctacaactcgagatggccatcttgacagactccatcttgctgtcactcatgatcagcacccagcatctgccgccaaagactgcccaaatcaagggctcttccatgcaagatgatgctgcctgtccagataagcccaggaccctctctttgtccatgtcactgtccttggactagttcattaaccccttttcctctccccgtgtctcttgatgttaaatgttactctgtttgatgtggactgcttaatctaaacatttatatattaagtacactactaggtatggtttgcagtactgactgagctgtggagtggcttgagcctgtgtgaccacagctctgattaccgagtgaatggaaaacactaagaagttccttctgggaaactgcatggagcacatggattttatgatggaaatagtatcaataaaagcctgaccttgtggaaagacacaaacgttcatggacctggttatgtctgaccttgccctgctcacgacacatgggttctccctcaaaatttcttttaaaatgcaaccattcagtggagagtacaacaggtccccaaataatatcatttcatgataatactgatgagaaaaaaaatcacctcctggctggggctactgtctgcacgcagctggcatgttctcctctccccacgtctgtgtgggttttctccaggtattctggtctcctctcacatcccaaagctgtgcatgtcagacaagtgggctgttccagtggtcccagtgtgagtgagtacgccctgtgagaggttggcatactgtccagggcaggctgctgcctggaacctggagctgctgcgataggctctggccacctgagagcctgtcaataattatcttgcttttattaatcttccttaggtggatagctcacatttatttcaaatccttaatattagaagtgttttagtctttatttagaattttggtgatgtttttgtgaccagaaatatgcctgggaacttaactcttgttatagcaattagcctgtggtactgctgattttgttctatgtccttctgcttaaagtagcagtttccaagaacctgctgatggtgttaagtgatgacttactgtgctatatcaagccaccgaacactgtaacgtgatcactatattcgctgacggaaggttctattgatagaaggtggaacagagccctgcatagtgggagcaggtcctgaaggaggtgcctgggcatattcacctgtagggaatggaatggagaaatgccaggaagtgcaccaaggtacagcagcccaggctctctctgacgcttctctcagagaagtatatgcacatccctaaagcaacggagtcaggctgtgagggctgaaccccctaactcccctagggcctgtcatgcatacatctcgatgggttctgctccctacctgtggataaaactaaggcgactgcagaatgcacagctcactgtgctgaagcacgattctcaaaggtgctaaaaggttcaagttgactcgaggggttggctgaggaagggggtccaggaggggtgtgtctgcatctgtttggccatcttcctcagcactcctgcttcagcatcaacaatcagctgaccttcctgaggtttgctctgcagcaggccaggaggggtggatatcactctgccagtgtctaggtgggacacctgggatgtggccagcaggcacccagtgagtcacagggccaggaagccaagctgctactgggcaggtccagaggacaggacgggcctcctggggtgtgagtcctagccatggaacactgcacctggtttggctgcttactttttttttttttttccaactcaggtagaatatatataccaactccgactttttcaaaagtactttgatgccaggaactaaaacaaaaccataccttcagggccattagactaggtgatttctgagtttgctttctttccactctgccatttgctggttttatgaatggaggcttgttttgcagatccagcccagtgggtgggccacagacctcagagtcagactcatgagggggcgaactcaaatgcacactaagcactgaccgcagcctacgggagaggcccccacatttatcaagccactgagtccaaatgcacacagaggcggcaatttaattcctccctggcaagttctaactattcgggaaaggctctgccctttgatctcaacctccatctcactccatcccacgaaaaaaaattccagggagcttctctttttctaaggggtgtgtggtagatttttctggaaagtaaaattctattttgactacattaggacatttcattcattaaagaaactcagaagagaatccttaggaaaagagaaatttttctataaaaaaattattcctacatctatcttgtttatattttcaatctttacatattattcagagtaagacatatccacatactatataggatcttgacaataaaatcacaatttatacttaagggggatatgttattatgtataaggaattaattaaagttgttaaaataatgaattaaaaatatgccagacgtactattccacctggttcatcctccttgattttatttgtctccagatagcataaatcctaacacacaaagttttaaattttctccccaaactatctcaaaagatcacacatttagaactataaactgacaaggtcacagtgcagctcctgttgctgaatctcccagctgagaggtgcaggggtgatgctactgcaggcgcatgaaccactcattctgggcactgtcccacaactgtgcgagctgcaaaggagccttggcgcctttggacttggagctgcatggtctcctcttgctcactcacgcttctttacctgcttcagcctgcagggacagccagggagtgtggggaggagcaggccccacaggtagccagctgaaggttccaaccccacttatgggctagggacctggaaaccagttttggagcccatcctcccatctgtgagatgggctgaccactcccacctgagggggctgcggggaattaactgagattaaacggactgagccctaacagaggctgagcacgcagcaggcattccagcccccagttcctgctctctcgcaacacccacagcaggcacgcagagcatcctcaaacaatgtcacctccagacagtgacacatccagaaaggcacaacatcctgcaggccgctgtgctcagaacacagtcatagtcccagaaaataacaatcactttggagttgttgccccaaagaggtccagtgatttgccccagatcaagccacaggtagagggcagacccaatgtggcaggaggtgcttggacccacccttgctgccagctgtcacaaaatcctgggttaaagaatcatctcaacgtcttcatttcaacgttttatatctctcacaatctttatatagtggtgtttgttttattttatttttcccccttatgtttgtctctagatgggattatgcatagcaatttttcttttttcttgcttaatcagtattgtcttatttttctatacctggcaaaatatcctgccatagcaggaactgaaacctgtctcagctgtgaggtgtctgctcctttgcgcagagaggaaaggcaccattttcctccctcctcagcacccattcagaaaaaagtgggaatgagtattcaggtaccaattttagggcccagaggggcttgtggccttggacccatggctcttcctacaagggagcacaatatttacaacatgaataacgggacggaaggtgggaagaacacactgcaccttcttcacaggcctcctggagctcaggcaataccacagtgaccctcacaggctcactgctcttagtcacgtcattccttcctcatcaggaaactacaacctcctcctgtctgcctcgcagccaccagaattggacagggccccaggacccctagggtcaagggcacggtcctccctgacataatgactgcacagtgggaacgggtagggtccgtgggaaagggtggcaatatcacacctgcttacatgcctccctcaacgtgcccccagaggtgggccttcctcggtgccatttctcacctgggcagatgcaaaccctcagcacatgtgctaagtagagtgtgagccccaatgaaactacagtttactgacctgttggccaagagcccaagttccacactctccttcctagaaagtgctgcacctgtcttccatgggccaattctcaagcctcccagtgtgacggaaagcagcaagcgtggttcccacatgaagaacccacgacacccctgtgtgaagtacactgtgaacctggccacagaagtgactcttgcagccattctgcaactgtctgttagggactccagggtggaaggcacatgcctggtgactccatagaaggcgtatcatgccaacggagtgacagggacaccttcccgacagggttcacgtcagggatgctaccttgagcaggaggaaccagctgaccacacggggggcttctaacaggtatattactcacagttttcagggcaacgctgcccacgccattaagctcccgagacctatgtgagcaggaatttaaatgctgatgttccagagttactaggtgctaccttccggaacccccaggcacagatgacacgaacgggtccaatgttagcatttgtgtgaaatgcagatcctggctggagcccaggcccctagaacagtacctagcatacagtcggtgctcaagaagtgctgcttctattattgccaaatacctagaacagtacctagcatacagtcggtgctcaagaagtgctgcttctattattgccaaataccataattatcgcaagcttatacttaaggcaataggtatacccataaagttatcaactacattagccgaataatcatttaatgaaaactaaaagctcaatcaaaatgtcccatttgtccaccagctttacctatataaaaattcactaggtaagaaatacaatcataggactgaaagcaaaagaaaacagttgagaatcatatcactcctggaacacattctagaataaaatgcaatgatgtacccctgacactctagtcagtactcctaagtacccatgcacacagagtggtcctgtgtgtctggaagatcatctgaaacttttgagtcaagatattctgggccccaaaatgatgaaagtatgttcctactaaaactgatcggcatttcatagaggaagtggataatgtaagccaacagactaaagtcgcttagaaggcaattagttctgcttctggccaagaaataaagcagaaaagtttaaatataaacaatagcataaggttaatttatgcatctttaatgctggcatttcattaaacacatgatgagaaagagagtcctcgacattctctcctacccctcagagagcctacctggctttacattgccctgtcctctgtggtaccacgggaagggaagtcgattaaactctcatcccaaggtcaggaacaggagacctggcccttggcacatgcttgactggggctctgccggggcctgagacagacagtcaggaaaactcctggatgctggccatgctgatgacacttgcccctcctacagagcacatagccgacagttccccaggctcacctgcagactgggccctgggcctgacagcattgctcccagaaacagacactgcatctaccaacagcctgtcctggaccaacgttccacagccatgttgatttacctgcatgtcccactataccagagggcattttcatgaggatgtgaaaattcagacccaagcccaaggacacactcagtgagaacatgaatgggatatcctgtgcccaggcctccaccttctctgcacagttcattggctcctgcaccaccctgagatgggcagggcaggcttcacaaaccctgtgtcagagataagaactgagagaatgacggcttaaatcttggagtcacacagcagcacagccagtgtggcaacctcggcctcttggtctgtgagcaatttctgctataacatgcaggtgaccaaatctgtcacataaaatatcatcagcacaacaatgactaatgaagaaagcatgaaataacagtaaataaatatcaataacaataaagaggttcaaattacagcaataacgcatccatttttttacttaattgatagaaaagtaaaaaaagaagatccattgatttggaggcttcaggaaaagaggtacttcttagctgctggtgagcaactggcaatgaagaagcattctgttcatagccataaaatagtattccaaacccaagaattgatctctaggaaatcatttttaaaataaggagatacatggaaaaagctgttgataataccattaatttataatactgggaaactgagcttcccaaacacctatccccagacaaaatcagtcatggcattcattcctttacaacactttacatctgaggtcagggtgctcagcacgcctaaaccgcaagcctagaccctggtgaaatacctgcttcatgtaggcatagcacatggtctctgcaacacgtttgccttcatcgtagcaggcccgaggtcctattggattcacgtggccccagtaatcctcactttgagggtggacttcaggatctacgatgggagaaaagtgagactgttttcatctttcctttttccagttcatatcaataatgcatatttatgatgcaaaagggaacttcggaaagacccatttagagatggagagatgtattaaagaggcaacctcaggtttccagtccattctcttgagttccagtaggatatgatattaagcaatgacaatattttacttacaggggaaaaaaaaaaagaaaaagatcaggtctcccaattttaagtcttccctctcttccgtaaattgttcttaactttcagagtgctacacaaattacaattaaatagaatctatgtgaagagatatgtggttttgttttatatttataaagttgataactggagcaaatcatgtatttattgaaaaaaaatgaaaaacgcagcatctctggaacatgatgactttgacatgtgccatcagcagaacaaatctgggacccgtgacaagtcaacgtggaggctcctgtagggcaggtggagggacggggtgcccctggcaaatgggtgcctgttcttctagccctcattttacactcccaattcctgtttctctagcgtataaatcaatcacactttaagacataccaggggaagagactattggaagaaaacacgtaacaaattcttttattcacacaagtatatttctggaatatgaatatacacctaatttatttagtacaccaagaattttatacatacttgagtacaactatgatataaaatgtataagtctttgccacgaaatctggacaaaaagatgcattgttataaattcccatcttgtttatcttacccctgaagtctgacttgggactcagtgggcctgagcaggtgcagggaggtaaacagacaggtatcctgccacttgtctgctcagccgatccctctgggtcagcacagcctccgcagcaatgcagaagtgtgctgcaaagaaaggtctatgtatctgctgctgtggtttaaaattccctttcaaagagcaaacttctcactactcagtgagagaaaagttctaaggaaaatacttcctgagagaaaggaaccattgacttaaattcacagaatgtaccagatgattgatcccagacctttttctggggatctttaacaagagctgggcaagctaccctccaaaaaagatggtcataaatttgacaaaggacaagaaagaaaaggctgggtacgcccatctgtccctggactggcaccgtctggactgaaatgcccaggatgccaagcttctaaataagtcccctcacaaaatcaccgtggaataaaacagggacagcttacattgttaatacaaaagtaaagacctagagtcaaaaataatttccaatcatctcccctttccagcattctgtgaggctaagacactaagcaaatactccacaaaagtttactttggttattcaaggtcagaggagagcacctggtgacttccataaattacactctccaattatttaggaagcctaaggaacacaggctcctgtcagacatgcagataataaatgagatgagtaggggaagcaggatggctgtgggaaagatgtcactgttcccctctggacagataccataccccataggtagggagggacacactctgctcttttattaataactgcccaggacttcaaaaaagtagacaatgaactaccttttcatagagattacaaagaatatcactgcatttagaagaatttctctgttgctatgatttttttcatttggtttccttaattaaaaaaaagtctcttctgattttaccctcttacttccttctcttgtccacaataataatgtaaaatagaaaaattacatcatactaaaacctggcttccgctgtatcagctaagcagttctcctgaaccttgcacacccagctggtttggggctgaagagaaatcaacacacattgaaaacacagctcctggtccccactcctcaactccttctcaggcagtgaaggagaggaaggctgtagcttggtaaaacaagctcgtgggtgttctgacactacctgcttaaggttcttccagaactcgttatacaacaggggaggcagtcagcgcatgtctcttctcccagcaagctttaaaggccagcccatgagctcttgggaggtcaggcatgcagcatgcatgactcacatagaagaatgacatgtgctagacaaacaggtaaaaagatagtgtgatttgtggggtgttttcagagcagaatggcagaaacacttctgtggaatcataaatggtgggtctttactggccaggtgacagggtgcagacctccagtgatgtgtgatcaaacaagagaggctgtcccacaaggaagaggagcttggcgacccgggaggccgacaggtagcctcctgtgcacaagaggagcatgggcaggctgggcctcctcagaaaagaacactggactcttctgagacaggatgaaaacagtccaagggctggagtgaacatctcctgagagagcctcctactcacctccatacacctccgatgtggaggccaggagcagacgggcaccgactcgttttgccagccctacagaaagcaatgacatgataaaagagactgaatttacatgtgcaggcacattttttgctggccaatttaagcaatgttttagtattaaagacatttaattatctatccaattatctacccttactgcgtctgctttggcaccaaaataaacaaaacaaatacagtaagaaaaacataaatggattctcagaaggccagtattttgttgaatacttgtcataagcagggccaaacgcagaatctgttagtttgataaagtgtgatttgaggagtttcgtgaagactcctctgcccccaaatattaccccatattttactgggtaactttcccttggttggcagaaggcaaggcccttttctccttaacttccacaatggtcagcttgccacttcctgaacatctcctgggctcttctaactgcccatgccaccctgtctgggtaactctccactcattcttcttcctcctatgcggttcagcttacacagcaccttttccaaagcaactgtcacattcctcaattctgctctgaacccctttcctggactgaccactcacatgtaactgaccagaacatcattatctatggtggtcaagtaagtatggaaagtcttccaaactcattcacagagtcccagtgtacagtggttcactacaggatccaagaacccccctgaccgtcactaaccctgtacttaagacaggcgacataccccacccccaatcgccactacactagaggggggctgtgctggacacccctcagctctgcccccccaccaacagcaggggccaacacatgcccacgaagcactgctaggagggtgagacgagccaggcacatgcaacctatgtgcgcttctgggtgaggctgggtggggtggtaggattctagcgtgcagcagccaggggtatcagtgtgtcagacaatgtagtagcttcaaaatgaaggactctgagatctttttcttcctgattaaattttttgagatatttgtacattcaaattcaattgtacaaagtagtatagggaccttatgtatcttttacccagattcccccaatgctaaaatttgcaaaactagattgtgccacaatcaggacattgacattgatatgatcagtgactatttccactgaaacggacattccattgataaaagtgatagagcatttccatctccaccaggatccctcacagggcccttctacagcctctcctcgctccctcccacctgctgacccctggcaaccactaaccaattctccatgtctataattgtgtcatttcaaggatgatacacaaatggaacacggcctcttaggactgaattttttcatggagcatatttccctcaaaatctatccaagctgcagtgtgtatcaaagttccttcctaatctattgctgtgtagaattcccggggatatatgtatgcactgccgttaatcattcacctatgataggacattctggttgcttctcatttttgacctctacaagtaaagctgctatgaacattcacacaggttttcatgtgaacataaattttcatttctctgggagaaatgcccaagaatacaattactgagtcttacagtagatgcatacttagttttttaagaaagcgtcaaactgttttccagagtaactatacattttatattcccccctacctgagttctttctagtttatagttttctctgaactttggtcacaaacacacatcacaaatgcaatgtgttatatttcaaaaacaactgagtttaaagattttgaaactaagactatttctgtagcactttcatggaatgactcacgcaggatctacagagacaactgtcagggagtgaagccaagggagctatcctgctgctgtagtgtctgggggttacgaaaaactttcatcagagaaagaactctagcacagggtctgggaggtgggcaagttacatagaggaaagggcctcaccaggaaaaagccaggcaaagttcatggcatcttgtctcaagtgcaagatggctaatgacagcgcctctcggttcagaatacaaagtccaatttgggtttctttccagcctaccaatggtctccctttgccttttgtatctctcctggaagactctttaccattcctgcaaggcctccacattcaatctcagtcatagctcaagccctagctcgagtcatttttgcctttaactctaacagcactttgctgaggcctctctttgggagactttcctttcctactaggtatcatcgacgcttgtgcccgttcagcagcccccaacccccatagggcaccaagtgcagaagagcctgagggtaaccccatctgaatctgccccagtgacaggacccacgggcacagtgactgcatcccccgagtaggaagaataaacggaatctccctaaacaccaagtgcatgatcttttcctctatggtctagttctggtatgatggaggggggcgggacagagagagtgtaggaggggtaggcgcttgtgatggcaagaagagggcatcacgcacacctctaagcagaagcagcagcaccctgttctgtctggtgaccagagcaggagacggtaacaaagaagataaagctctttccagataggaagaatgaatcatcttactccaaacaacctgtcccctgtgatggttcattttatgtgtcaacttaggccacaggatgcccaggtatctggttgaacattatgtccgggggtatctgtgaaggtgtttccggaagagaggataatttgaatgtgtagactgcgtagaacacatggccctccccaacgtggatgtatcatccagtcccttacaggcttgactagaacacaaagatggaggaaggtcaactgcttacacagaacatcgatctgccctcggctctctggttctcaggccttggaactacacccctggctttcttggttctctttcttgcttgcagaaggcagacggtgggacttcttgacctccataatcatgtgagccaatctctcgtaacaaatctctttctctaaatctctacacatcctattggttctgttcttctgtagaaccttgactagtaccaccccctaaaatattgcatctaagagataaaccaatctctggctgtcctttcattctcgactccacgctttgttcaaattaaaatttagtgctgtatgtcccaagtctatttgcagaacctgtattaaatgttcctatacttaaatccatcatttacttgccatttttaaaagtggttcctttcttccactttgcaaataatcaaaacccctggagttttttgaaaaaactgtgccaaatttaagcatgcctctaattttaaacattaatatgtgcacattacccactgctataaatctaaggcatgtcatttgtgaatatacacatatgaccaccattaacaatgctctctcgtccatcttttactaatgcgaaccctgaagtccaatctagggcaggtactcagtcttgataacaccccatacagatgtctccatccattccttcaaggagtgctactgaatcacccccgtgtgtaaggccatgtcaacccaacctggggatcagagccaccactgcctctttccagcatgaggcatgccacttatcctcagcattcatcaactggtttcagaggaggggaggggggcaggctgggtggttggtcacatgaagcgcctgtggtcactcccaggggatctgcaccagggtgctgcagcctgattactacaatgcatgaaaagttaagttagaccatctcctccatgacatactctgatgacaaataaaagtcacactgaaataacactgcaaaactgccaaataccacaagcagggcaataagggacgagggaacacactcagatcaaactctagtagaagattcaatgacctatgcttgtaatcatctaaaatattcccagcaacagccaaaaaaacaagaaaatgacaacttacccaacatgtttaatgtcccaatcgtattggtctttaatgtcttgataggattatacatgtagtttggaggggaggctggagatgccagatggtatatctggtcaactaaaggagacaaaacagaagcctattacttcaaaaaagcaccaaaaaaatactgacctcctaggatatatactgtataataaacgtattagtatatctttcactgaaatcaagttattttattcttcatataaactaatttacatttgtaattaggaaaatgttaaacaaaaatagaaagtctaattatttggaaacaaaaacatgtgctgggtcagctgagtctgttctcgtgtaaccagagtcaattcgattactgagttgattgttttctgaaatatttgtcccagatagagcattcaaatcagaaggaagactgatttttttcagacacagaattaatcatgaattttttttttttttagtttgtgaggcaaatatgacttaaaccaaagacacagaactatgggagaaagtagcctctcgtttgtttttatgcatcctgtatacataaaaccagaccctgagaccatggcgagggagggagggaggtttttaaagccatgaatggcaaagcaattcagattccatgcaacccctgcccctcctggaaaggcattcactttaacgtcactacccacagcgttccagcacagaaccaagtcaggtaacatctgcacatagcagagaagtcctcggggaccaacctctccctgtggaatggcagcaacagacacacacacacaggaggaatgccatccttccagacaaagtccatgtcatgccattctacttttagccaatggtgaggaaacacatccaccatccacaggagtgaagaacagggatctgaaagctctgctgccaaaatgagtcctcccttgcacatggatgtgtaagaatacttgcaggggcccctctgcccgggccttccgggctcccctgaccagggaactgctgctgtctttcctttcccagtgccgggaatggaagagctgaagatcaagccttgagccacagcaggtcagtctggaggttctcaatcaatcctgactgtgcactagtcacccagtgaggtgatgcctgggtccccaacaccctgaagcaggctgggagactctagaccttcattcatatatatatattttttttaacatttgaaagccaagtctgggggggaggagccaagatggccgaataggaacagctccagtctacagctcccagcgtgagcgacgcagaagacgggtgatttctgcatttccatctgaggttccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctgagagggtcctacgcccatggaatctcgctgattgctagcacagcagtctgagatcaaactgcaaggcggcaacgaggctgggggaggggcggccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagattctcctcgagaagagcaactccaagacacataattgtcagattcaccaaagttgaaatgaaggaaaaaatattaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagacacaaaaaacccttcaaaaaatcaatgaatccaggagctggtttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggttctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgcgatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcattaaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacttacaacatgggagaaaattttcgcaacctactcatctgacaaagggctaatatccagaatctacagtgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccatggtggaagtcagtgtggcgattcctcagggatctagaactagaaacaccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataataataataaaaaaagaaaaaaaaaaagaatggagaagtcaagaacacacacaaaaaaaaaaaaaaaaaaaaagaaagccaagtctgaaaaccagtgagttaatttagaaatagaaccaatgcttatgggaagaataatctttttgtaaagagaactaacaaaacacaaaatctttaaaattattgatggtctgtcaaaatgcaagttcgctgagaggatctgtccaagtaaaaggaaatcctgcgactgctgttcccacccccacaagttattctgagctgaaaaacagctaaaaataaaagacaaactaatattgtattatacaaattgtaatttaacaagataccttttaaaaatcagttctcacaaagtcccataattctaaggccaagctatcttttgcagtttccagctaggatcagcacagaccgggtcagttcctgctacacctacttccaagctccagggctgcaggtagaagcagcagaccattagccccagaaacaggcactgtgctgcctcctctgaagattcctcctcatacccactgccactttggagcaggactgtgccaagttgaaaaccaaatgagggccaggcacaatggctcacacctgtaatcctagcactttgggaggccgaggtgggtggatcacctgaggtcaggagttcgaatccagcctggccaacatggtgaaacccgtctctactaaaaatataaaaaaaaaaaaatagctaggtgtggtggcaggcacctgtaatcccagctacttgggaaggtgaggcaggagaatcacttgaacctgggaggcagaggttgcagtgaaccaagatggcaccattgcaccgcagcatggacaacaagagcaaaactccgtctcaaaaaaataaataaaatttaaaaattaaaattaaaattttaaaaaatgaacctggccagaccttcagagccgagtacgacaccacagagcccgctcaggtgtgctagacctggagcctgctgccacctgacttatactcacgggcatttctgcttacacagacagggtcaccctacattcctcaaagagagtataaacaactctgtatgggctgtgatcttacacaacaaattattcatcattatctttactcttgaggtgacaaggtatgcagggaaagacaggaaactgcattaaaggctaagagggaagaagtgtgccttgagagtacaggaagcctctccgacatcaaacagaaagccactatcattaacctcacactcttccctcctcgtcgtctgctccagtcctggctttcttcttcaaagctcaatccagacgtcagtctgtatgggaaaccttctcaccatccttggtcagaaataatcccttgcctgcaccactagtccacaacagctcagcgctgccttgtccagagattcacacatgccttcctcactagacgatgagctcactgagcacaagatgcaggcctttcccttcctgatgctctccacagtgtggactctagagggaggggaggccccctcggtcacccacaaatgcagactcctgagcccactgcaggtctcacccttcaggatttccaggcgggcctggaaaccttccatttacaacaaatacccctccacggtgctctggcccaggccagtttgggaacagggctccacaaaagttagctgagagaagagatgagcgtaaactggggtttttccatccccaaaggccattccatctggttcagtgtttcttcctcactggacaggtcagtcccactgctgctccggaaggctgagggccgccccatcagactgtcgagacgttcagttaagtagcggcactgctgcatcctcccatttgagaggaaactgaaaaccctatgaaaatcaaagtttcccaccacccccctctcctttgagaatgtgttcttcctgtaacattaacaataactccagttcctatcctaaaaagggcactgcagcagagtctgttggttaaataatctggtgagaaattctgaaggggagagaagaggggaaattcagagcagggacaaataaccagcaatgagaggtgctaggtaaacagtaagtaacattaataacaaccggcttcggaatataaataaagcagcaaggttaaccctcacagcccaggacaaaggccctgggaacatgtcaactgcacagttcagagtacaccaagcatgagcctgacgttccaaaatccaagctgaggtggggagaggaagtcaaagggggacagaaaggcagcccattcatgggtgcccacagttgctccagagaccgctagagaccctgccacgacctttcacatttacaaggccacgtgctgggagctcagctagaaaaatagaagtctcaagaaatgagcctaaaagagctccaattaatgatcagcagcattcctaccagagagcatgcagggtaatcttatgttgggaagtggctgggtgagggcacagctgcgacttactcggcccttctatgaatcctgactggggaaactcaaccagtcaaaccacaaatgaactccctaaagggtcttaggttgaatttcactgtgcccaaaacccacataaatgacacatacatagggaagaaaaaaatcaccataggaggagaacaactcgggataacctgaaaccactgttcagaacacatcggagaaatcgacattttcttctaccaaaggggaaatccacataaaaactgactgtagcttccactcctttgttgattttcttttttaattttgtcttaagttagtgacatagtctgtgtcaagcctcattctgtgccacacccatgctgtatgaaactgccaaggaccagttcaggatttgtaccatgaaactaaagactatagaaacactaaaacgcaaaacagtgggttagttctttctgtgataactcacgcgattatttagcacatactaaattcccatcataaaagatacttacagtagaattctctttttctacacttgagtcagaggtcttacagaaatactccccaacgagatgtccctctctgcaatgtgaagtctcacagcatggccctagtctttgtctctagaaccagtatttaggatggaaaacaggaatgaagaagatacagaacttctcaaagtataaagaccaaatttctctcggcacaaagaagcagaacagcaagattttcccttcatttcatgtcaaatgtatttacttagggcaaaggctgcacacactagagactggctcagcccccgggagctggggttgcccgccagtgctgtcgactgttctgagcgaggggctcaccttccctgtgaagccaccgcaggggaaagaattttcagtgtcctaggctgctccataggaagcctccaacagctccaaattaaacagagggcgatctctaagagccaccactgcagttttatttacatttgcaatataaactgaaagctgagaaaaaaatttctaaatgatacttcaacaaaaatattctaatcagagctgcatgctttaaatgtctacataaacatggactcaatccccttggcaaacactgtttccacccctcctctttagggtgggtgcccagggttgatggcttggctctcccatcttccctctcctggtgcccccacccccggccctccatagcaactgagcatccaggtaaaaggcaggtaatggaaagggctccatgccttggtttcctcacctataaaatgaagaaaatagctgcctacttcgcacgggtattgacataattaaacttgccaaccataaacagcgattagaatagcatttggaatatagttaagtgttagctatggtcactttcttcttttattttcctggacctcttcaacagagatactacaagttcccggtactggtcttcccacgacacaatgcacatttctgccttttcctgttccccatggaaaagctggtctcaagatccctgtttatacagacggtggaaaagtaaattgggacagcatttcagggaagcacaggtgctctgtagcaggaccctgggaaagccagtgtaccatgaaaatgatgacagagacacagatgtgtggctttctgaagcatggtttatgatggccccaaactgcaatcaacctaaagatccaacaacacaggactaaggaaattacaacatattcataagaagacgacttgctaacaagtaatgctgaagggaaaacccgtgtcttggtaaagagatctagctagtatagccacaaaatggaacactaagcagctgccaaaaaaggtctctatatatgatatagaaagatcaccaggacacagtaagtggaagaaaataagattcaggacaatacataataggttatataaaaagggagaactataaatacctatttgtgttagctgggtcacatacaaacactgcagatgaatacaaagaaaggatcaacagctgtttcctgaggagagctgagaactggcaagaggaagactttaactttacagttttatcttttccatttttatgtttatttatttatttttgagacagggtcttactctgtcacccaggctggagtgcggtgcagtcatggctcactgcagcctcaacttcctgggctcaagtaatcctcccacctcagcctcctgggtagctgggaccacaggtgcatgccaccatgcctgggtaatttttgtagagacagggtttcgccatgttgcccaggctggtctggaactcctaggctcaagcgatctgcctgcctcagcctcccaaagtactgggattacagacatgatccactgtgcccggccatcttttccatttattttttaaaataattgaaccatataaccatattacctattaagcatgtttttaattggaaaaaaaatcacatttaggaaaacaactggatgttagcttcagtgttttttttttggtttttttttttgagatgaggtcttattctgtcacccaggctggagtgcaacggcactatcttggctcactgcaacctccacattctgggttctagcgattctcatgcctcagcctcctgaatagctgcgaccacagacatgcacaagcatgcccagctaactttttgtatttttggtagagactgggtttcaccgcgttgcccaggctggactgaaactcctgagctcaaatgatccaccctccttggcctcccaaagtgctgggattataggtgtgagccaccatgcccagccaacttcctcaacagtttatagaaagattaaaaataattttctatttgctttgtaaaatacctttctatattttctttaacatgtatgtattattttcatcatcaggaaaaaagtttcttttgaaaagagaaaaatatttcagattctcttccatctcattctttatcaaatatataaacaagaaacctaattctttcatttagttcaaagtatgtttaatctctcttgagatttttcctttgtctcatatcttatgtagaagtttgttgtttcatcactaaatatttttgtaattttccagatatctttctgttactaatttctagtgtaattccactctggtctgagaggacactttatagcactctattctttcaggttggctgaggtgtcttttatggctgagaatatgatcagtcttggagaatgttccatgtgggcttcaaaggaaggtgcattctggcattgttggatgaagtgggcattgtgagggcagaaagagtgaagagatggagggcagcaagggggaaattatcaagggcacagaagacctgatgccaaggttgaggacccgctgaaggagaaagtgaaaaacaggcttcaaaccacagaggcagagaagcatcttatgctctcccaacataaatgccaactgagggaacgcaatactctgagcaaaggacaaagcaccagtcatttattgtatgacttcattcaatgtgtgggtgtgtgggtgtgtgtgtttgcatgtatgtgtgtgtgtgtgtgtgtgtgtcctacacacagtcacagaattggcagaaatggcctagagcagctttggtatcaaagctcgcagttaaagaagataatttacttattaaaacaccatttttactaagttctggcttctcagtggtactgaaattatataaacaatagtgtcataaaataaatgtttcttgccatgtgctaaaaaagagaagagagtagtaatattaataggtatcatttgggggaggtcaaggtgggcggatcatgagggcaggagatggagaccatcctggctaacagggtgaaaccccgtctctactaaaaaatacaaaaaatcagcccagcatggtggcaagtgcctgtagtcccagctactcaggaggctgaggcaggagaatggcgtgaacccgggaggcagagcttgcaatgagctgagatcgtgccactgcactccagcctgggcaacagagagagactccgtctcaaaaaaaaaaaaaaaaaaaaaaaaaaaaaaggtataatttgggcagcacttagtgaaatgagggcccagtgctgtgctaagtcctcacagtagttttctattgctgcctaatcaaatttagaggctcaaaaaatatccattcacgatccgatctgacaggtctacaggaccgggcacagtatggctcagctggttctcagctctgcctgcccccaggcagaaatcaaggtgtcagcagggctgtgttcctttcttcagaggatgattcaggatgacagcaaaattcagttccctgaggctgcaggactgaggtctccttacaggctctcagcagggagccattctcagcttccagaggctgccaacactctcccgcacatggctccttcaaagccagccagggtaggtcaggtcccttgcacactgcaaacctctccagcttcccttctgcctggtctccccgcggtatctcttctacccagtctctctacctgactcttccattctctgttgctgcctttgacggttcatgtgactatgtgggggcacacccagataatccaggatcatcctcattttaaagccagctggttcataaccttgattctatcagcaaagtcctgtgacagcaccacctagcatcttgggttgaacaatgggaaagggcatcttagcagggaactgtgagaatctgcttgccaggccctgtcacatgtatgacctcagttaaccccacagcaatcccaggaggaaatccaagaggaaagtgagcccactgagctataatctacatagcctgttatactttacaaaaactacagcttcactccaaaatgaatcctaaacagattacataattaaacgtttaaaaatgaagcaaaaaaccaaccaacaaaattaacaccatggctgctttctaaatattagattaaatattcatctcatcttggaacggttagagcagaaagagaacagaagaaacagcaagaagaatatgaacagatgaaactatgttataaaatgtcactcaaacgaaaaggcaaaaactttttgcctttgtgggaaaaatgctaaatacaagcccaacagttaacattcctattacaaagaactcatactaaaagaatatttttaaaatggactaacaaaaccattggtatttctctggtgaattaacatgttaaattctaaccatatttagtaaccaaagaaatgtacattgaaccaatggttttctatcaaattagcaagatcaaggggttggcagattgggtgctggtgaggacctgcttcctggttcatatatgcatcttctcgccacgtcctcacacggtggaaaggccaacggggttttcccaggcctcttttataaaaacactaatctcatttgtgacgactctgtctccatgaactcatcacctccaaaggccccacctcctaataccatcactgtggggcttgggatgccaacatatgaatttggggtgacaccaacattcagaccacagcagatgtgtactacaggaaagttacttcaacaggtccatgaagttcaggaccaggggtgccacgtaggagagaagacggctattcacactgttataaccactcgttatcacacagactaggacggcacctcatacatattgagacatttcaaaaataaaacccaacatagctttcaatgtgctgagtcaaacagcttaccctcaggaatcccgcagctctggcaaggccacctgcggagctctgaataataacaatgtgcagttttcactcaccctcgatgtagaggggctccaccacgtcgtggttaatcaactcgaagttctcatgtccgatccagtgctccacgtttctcttcctgcccgtgaagaaattgtccaccacggtcacctcgtggccgtccatcatgagtttgtcagttagatgggagcccacgaaccctgcgcctcctgttatctgcatccggacagcgtgtgcagagcattcccagaaaaagcacatgagaacacagtgaggaccagctccacggagagacatctctggtgcagccacgacttaaaactcaggagcaaggcggggaaggaagacagcaaaggttttaaggtagcatcttgactcttactgcagaacaaagaggtcatactatctgtaaactcctaagcagcctaaaatttcaaactaccagtcttggaagaatacagaaaaatcatagttacaaatttcaaaatgtctttgctgactgagaatttcccattagtcaaaggttcttgttttataacaaatgggatgctggacatagctcacgtggctttaatattactgctgagaactttaaaaattactttatagaaaaaacgattagcaaaatgcagagatttggtgaactaccaagaaaaaaaaacttaatatttaagttagattcaaaaactgcaggaaaaacaaatatcttttaaattgtttatgagaacaaattaataagcaatacatgctgtttgtagactaaagccctaaacgcctaagtccactgtgtggttaatttctgaatggtgatgtgaacccagtgtggtatacactcccagccacagagcacgatgaggcagctgtgaggggtcttgacggtaactcagtaataacaaaacctagacccctgcaaaggtgaaaagtcaactgcgcttgaaaaatacttttaagttgaacacaggtattttattcaaattaaatggtgtaactggaggaggataaagggaatttcatctgggggaaggttataggcggtgggagtgaaaagaataggctcagaaaacagacgtgccatgcacaactcaattctctagcctgctgtatcctgttctccactctgccttctcttcaccaaaattctcattcatttcacccttctgtttcaaacggaaagtattaataggaagacagcaatcctttctacctaaaataaaaggtatacaaactcctaggtctatggttttaaaacatgtaattctccatgaaactcctgtttaaaataaatgaaatctcacacacgatgaagtattcaccacggtgagagagtaaagccacctggatttgagtggagtggtagctcatgcctgtaatcccagcactttgggaggccgagacaggtggatcacttgagatcaggagttcaagaccagtcgggccaacatggtgaaaccctgtctctactaaaaatacaaaaaattagctgggcgtggtggcacactcctgtaatcccagctagttgggaggctaaggcagaagactcacttgaacccaggaggcggaagttgcagtggatcgtaccactgcactccagcctgggtgacagagaagactccatctcaaaaaaaaaaaaaaaaaaaaaaaagaagccatctggatgaaaaagatcaaaaatggcagaggagaagtaaggggaggctataaactaaaaatgaaatttgggttgggtgcagtggctcatgcctgtacccaacactttgggaagccaaggtggctggatcatttgacgccaggcgttcaagactagcctgcgcagcatggtgaaaccccgtctctactaaaaatacaaaaattagctacacgcctgtaatcccagctactatggtggctgaagcacaagaatcacttgaacctaggaggtggaggttacagtgagttgagatcacaccactgcactccagcctgggtgacagagcgagactctgtctcataaataaataaatatcctaagtcccccaactgagtgggccccctcttggccaaacggaaccccagagaaacctgaaaagctgagttcccagcagtgatgtgaaaggagattggacatgcctcactatactttctcttttggaatttagacacaactgaccaacgttaatattaaaacagagatcataaacaggacctagggtcgtgccagacaggagctaagtcacatccctccaagtcattctgacccagtgtattggtgaacagacttccttgtcataacttagattcctttctgctgactccaaagttttacacaaagatttactcctttaaccaattacaaagtaaaaaatctctaaagccagggaggtcaaggctgcagtgagtggcaattgtgccactgcactccagcctgtgtgacagagagagaccctgtctcaaaataaataaaataaaatacagaatctcttaacccgcctatacctgtgagcccccacttcaaaatagcctgtctttttgggccaaaccaatgtaaaagccctatatattgatttatacctccttgtaacttctgcctctctaaaatgtataaaactaaactaatccgcctgcctcgggcacacttactcaaggcttcttggttttgtgtttcctggggctgcagttactcatactggatcataatacacctctaaaatattttagagtttggtttttcagttaacaaggccaacctcaagaataaccatcccttaaccaccacatagatattacatatgctctgatgaaatgcaaatcaaatggttaagacaggatgggtgagaccaggcatcctcatgctcgatagctttcatttggctttaccaacagcaccattttccaaatcccctttgccttcaagataagaaactgacacccagagaagttacgtctttgactaaaatcctcagagatcactagctgggacacactaaagctacagtctttctaattacacgctctctactgcctgtcaatttgtctggttcgtgtttcatcttaagagctcccacattctactgctatacctgaacaatgactatgaaaaacgattttccagaaaaataattgaaattcaaagttgactcaccactagagcttaactcacgggatgagatttcattttatcttcacgttattgcattttttccaagttttccatgatttttacatttaaaaacttgcaacttttaaaaagaaatgtaaccccttttaacataactgtttctctatatgcaaatatttctgaaaacaaaatgttcagtggcactctaacattatctctgcacccaaaatacctggcagacagttctgagatatcagagatgcagcgtattaaattacacatgatcatctccaacatctcactagtcttagtactgacgtaaaattgttggaagcaccttagcttgactaaaatgcactggaatttttttttctgaagtaatttccttctacctaaaatacttaagatttatataatatagctggatggttatgcaattttttatcctaatcaatgttagcccattaggcaagtgtttcaaatagaaacaaatttggtgaaagcttagcacttacaaagctctatcaggaacactaatcaccaaacccaaggatattctttgaataacaaggagctaatacccaaaagagaacaggagaaaagaagtaagacctcttacactgagatggattagaacttacacggctttgcatggctttccagtataggggtttgtctcagtgtgctttcttgctcgctcttgtgggtgccaataggcagctaaagtggtctagttcaaggtcagcagtcaaactcatgatgcttagcaaattagcaaaaaatcaaaaaatgtatttcaaagcaagtctcctctttctgttgaagctgtcctaaggcttaccaatttactgaaaaggctttaagttatagcaacaatataccagactcacatgccaaatgcctcagaaatgtgcttaacctatgagatggcagatgaggggaaaaaaaaaactaagtctgtttgctgtggtgatgtgtaaagcaaaataaattctataatactcagcatcgacaggaagatcattccatgtgcacataataaaattcatggcaagattttgcagcattcctgtaacagtgctgctgtgcttttaacgtgtccaccaaaagcacattttggtaatttaatccccagtgcaacagtgttaaaaggtggggtgattaggccatgaggtgaagtaaatggattaatgccattatcagaggagtgagtgtgttatcgtggaagtgtgttccacatagaagcacgagttcagtccctttggtctctctcttgctctctctttacccatccactacgtgatgacatagcaagaagaccctcaccaggtcacaaccccttgatcttggactccccagcctccagaaccatgagccaataaatttgttataaattacccagtcttaggtactctgtcatagcagcacaaaaaggactaggacagaaaatgggtaccagagaagtgggatgatgcttatacaaacacctgaaaatgtggaaaaagctttggaactaggtaatgagtagaggctggaagaatctggaggtgcatgctagaaaaagcctagacttctgtgaatggagtgttaaagaaacagtggtgaggcctcagaagagaagagctgtgggggaagtctagaacttcttagagattacctgtaacatggttgtgatcagaacaattgtggaaatatggacagtaaaggccattctgatgaggtctcagatggaaatgaggaacataccactggaaactggagtgaaggctatccttgttacaaagtggcaaagaacttggctgaaatgtgtctgtgtcctctggctttatgaaggcaaaatttacaagccatgagctaggacatctggtggaagaaatttctaagcaaaatattaaaagaattgcatggcttcttttaactacatagagtaaaacaagggaagagaaaaatgatttaaagacagattgtataactaaaagggaaacagaacaaaaaaaattttttaagtccccagccttaccatataaagaatgaaaaagtgtgcaagagtgcagacaattgaccctttgatacacagagtagtatggttagaaggaagccaggttctgtcccttaagacaatgggagaatgaccctgaaggcatttcagaaatcctccaggcaagctgagaccttgaggccaacgtttccagagaggtgctcgaggtcaccattcattgccctgtgctgccacaagtctctgctccccttagcattcctcagccagcacagctgtggctccggccagtccaggtgcagctcaagctaccgctccggaagatataggctgtaaaccttggtggtgtccacgtggtgctctaattctgcaagtgtgcagaatgcaagagccatgagaacatggcttcttccaactagatttcaaaggatgtcacaaatagcccgggacagggtgggaggtggcggggggtaggcagagactcattgcggtgatacagctgccacaaagactccggaactgtaaagctaccagcatgtaacaccagcctaaggaagttacaggcacagaactccaactcgcgagagcagccaggtggactgagaccaacaaagccacaaggctggggctcccagaggccttggaggtccaacccccaccccagcgtacccaggactcaggccatggagtcaagaaagattatctggagcattacgatttgatcttgtttgccctgttgggttttggacttacttgggaccagttaccctgttctttcctatttctctcttttggaatgggaatgtttatcccacgcctgttccaccattgtattttacaagtagataacttgttttgatttcacaggcccatagctgaaggggaatttgccttaggatgaatcgtgtcttgaatttttcccaaatgatgtttagatgagactttggactttcgagttggtgctggaacaagttaaaatgctgggctattgggatgaaataaatacattttgcatgtaagaaggacataaattctagagacggcagccagaatgctatgggtttgaatgtgtacccccaaaatcatgtgctggaaacttaattcccaatgcaacagtattgggaggtgaggcctaatgagaagttattgggctatgagggccccaccctcatgaatgaatttacgtcattattgcggcagtgggttatgtgtaaaagaatgagttaggtcccctttgtctctctcatccactctctgcccttctgccacgggatgacgcagcaagaatgccccttgatattgcacttgccagcctccagatcataagccaatacctttctacttataaattacccagtctgtggtaatctgttacagcggcacaaaacaaactaagaaaagtagactatcagatttgtgatcaatctgacaacatggcaacaaaacattaaaaaaattaacttttctatgctacttgagacacttatttccaaattcatgctcaaatgcatatacctttttgatgcaatagaaataacctcaaaagagggacatacaagtattaacagacttcagagtctgctcacagcgagagttatgtaagccatctcaaaaaggcaagagacttctataacttccagaagaacagagagattatatggggtaacagtctaatatcgattcaggagtgacaataatattttagggatgcacagtactacagcctaggtgatgggtaaaagaacaaaacaacctgtgtactagtcatttcaacatcaaggtcatatataaatcatttcttgtagaattgcagtgtaaagtgctccacagacctgttccccaaggaaacaaccataagtggtccaaattatttttttaaataaccattaaaagtctctggaaattgtgctaagcacgtacagcaaatgaagtaacatgtattcaagaaaatataaaattcactttgggaggctgaggtggacagatagcctgaggtcaggagttcaagaccagcctggccaacatggtgaaaccccacctctactaaaaatacaaaaattagctgggcatggtggagcacacctgtaatcccagctacttgggagggtgagacaggagaatcgcttgaaatcaggaggtggaggttgcagtgacccaagatcatgccactgcactccagcctgggtgacaaagtgaggaaagaaaagaaagaaaagaaagaaaagaaaggaaggaaggaagggagggagagagggagggagggagggagggagggaaaagaaaagaaagaaaagagagagagaaagggagaaagaaaggaaggaaaggaaggaaaggaaagaaagaaaagaaaagaaaaaagaagagaaaagaggaaagaaagaaaatataaaattaagtaagaacagcaagagtctgcaacacttgagtccatccccacagtttagagtggggaatgtgctgggtgtggccaagaaaatgagaaccccactcaaaagatatggtatctcaacaggaagggccacttagcagtacttcctagacagggaaggctgagaataataggattccagtcacggttgccccaacttgcttagaagggagaagttccatgccaagaggggcaaggaaaaaaaatcaggggctacagcaccctgattataaaacagaggtgttgctcccaccccagcaccagggcagtggttcagaggttttcctgggggacagaggtactgaaaacagtgcactcaaaagctctccctaaagggagttgactttatttgaaagagaaagtcaaatataagggtgctctcaagaacaagggagatgcagatggtaagcaataaatagaaggcaatagatctatgagaataaaaagctaaatccgaggccagcttgtttaacagagagaaccaaggagaggacacttaagaaacctcctggggtcagaacaaatctcaaagactggtctcaaaatctacccctgccaaggggatagaatttaactggatcaggctgaagagcaatttaaaacccacagcattgttgaaaaataaagcaattagctagcaaccactgcagcctaacagctgggtgagatactgcacaggcttaatagagaaatcagggaaagagactgtcagcatgagcctgttagacccaccatcatcccagggggtttggccaaggctacatcctccaaggaacaacagttaaagcttcacactggagtggcggggacggaataggaaacacttcactaaagtagaccagagaagtcactaaacaaataaataaataaataaaataaaacaagttggggaaggtgggggttgggatgagggcacagtatccagaagtgctacaatatactacctaaaatgcccagttttctacaacaaattacaagacatgcaaagaaacagaaatgggtgacccataaacagaaaaaacaacaaagcaataaaaactgtctgtgtgaagtcccaggtgttggatataacaaagacaccaaagcaaccactgtaaatattaggttggtgcaaaagcaattgcagtttttgccattaaaagttatggcaagtgttcaaagaacgaaaggaaaccatgcttaaagaagtacatagataataaagagagattacaaaatagaaacaaattgaattctggagttgaaaaataccacagttgaaactaaaaattcaacaaagggattcaacagtcaattggaactaggctaaagaatcagcaaacttggactgaaagggcttatgcaacccaaagatcagaggaaatgcaggaaactaaacagagcctcagacaaatacaggacaccaataagtgcatcaacatgcatgctgcactgggagtatcagaaaagagaaaggaatacaaaatatattcaaagaaataatggctgaaaactccccagaattgatgaacatataaatgtatatattcaagaagttcaatgaactgcaattaggataaacacaaacaaaaatagatgcacacagacacatcattctagaaatcccgcaaaccaaagacaagataagattttgaaaacagatgtactaggttggatactgtcctacaaagtttatgtctgtcccagagcttcagaatgtgaccttatttgaaaatagagcccctacagacatatttagttaagataaggttatactggattagggtgggactttaatccaatactaaaggcatgcaaagacccatgtgctgctggaggcagagactagagtgatgcctctaccagccaaagaacaccaaggattgctggcaatacgagaagctgggagaaaagcatggaaaaaactcccctcagagccttcagaggggcataggcatggccctgctgacatcttgatttcagacttctagcttctagaactgtgagggattaaatttatgttgttttaaaccactcagatggtggtaactgcaagtcctaggaaattcatatggcagaaaaagaaaaatgacttgtcacatgtaagggaaccccagtatgattaactgctggctcattacaacaaacaatggagaaagcagtggatggcacatgtattagttcattttgtgctgccataaaggaatacctgaagctgggtgatttataaagcaaagaggtttatttggcacacggtcctgcaggctgtacatgaagcatggctccagcatctgcttctgctgagggcttcggagagctttcaatcatagtagaaggctaagggggagcaggcatgtcacgtggcaagacagggagaagaagggggtcccatactcttttttaacaatcaggtcttgtgtgaactcattacagtggggtgtgcaccaagccattcatgatggatctgtccccatgacccaaataattcccactaggccccacctccaacactggagatcaaatttcaacatgggattgggaggctggaacaaacatccgaactctatcaacatatttaaagtgtaaaaataaactggcagtcaagaatcttatatacgaccaaaaataagatatccctagataaacaaaaaatgagagagttcattgctagcagacctaccacacaagaaatactaaaggatgttctttaggctgaaagcaagtgaccccaaatagtaaatggattccagaaggaaaaagaagggaaaggtaccaaataggaaattagttaattacaaggcattcgctcaatgactcacctagagcaaattctagtcctgcaagctccatttgtggtaagtggcctacacagatgaacacaaatacttatctttgttataactacctacagtattcagtatagcaacatgctgtacagatttgtagcatatgagcaataggtcataccatgtagcctaagtgtgtagcaggctgtaccatcgaggtttgtgtaagtccactctatgatgctcacagaacaacaacaaaaacacttaataatgcatttctcagaatgtatccccactgttaagtgatgcttgactgtacatttacggtaaaattattttcaacaagggtgccaggaaaattcaatgggcaatgaatagtcttttcaacaaattgtgctggacaaccggacagccatatccaaaagaatgatgacctaataccctattcaaaaattagctcaaaatggatcacaggcctaaatttaagaacaaaatctataaaactcttaggaaaaaaacatggtaaatctttgtgcccttagtttaggcaagatttcctaaatatgacatccaagtacaagcagcaagagaaaaaaacagactttatccatatttaaagcatttgtgcttcaaagaatgtcatcaagaaagtaaaaagagaacccacagaatgagataaaatatttacaaataatatacctgataagaaacttgaattaagaatatataaagaacttaattcaatgatgaaaagaaaaataacccaattaaagaataggataatatctaatagaaatttctccaaagaagatacagaaatgaccaataagcacacaaaaagatgctcaacaccatgagctatcagagaaatgcaaatccaaaccacaaaaagatatcacttcacacccagtagaaaggctacaatcaaaaagacagacaataagaagtggcgttgaggatgtagagaaactggaacactcatatgctgctggtggaaatgtacaatggcgcagctgctctggcaaacagcagttcctcaaaaggttaaagagagtcaccctatgacacatataacaaacgtacagtcatccctcagtatccacaaggaattggttccaggaccgcaccccacccccatacctaaacgcaaagatgctcaggttccgcatataaaatagtgtagtatttgcatataacccacacacatccgcctgtatactttaaatcatctctagataattataatacctaatacaatgtaaatgttatgtaaaaatgttatactgtattgtttagggaataataacctgaaaaaaagtctgcacatgttcagtacagccataaccattgtgcacctaactacattttcgattcgtggttagctgaatccacggataaggaaaccacagatatggagggcctactgtataaataaactgtggtatattcatataacagattatttggtaataaaaatatatgaaatactgatacaagctacaacatgaacaaaacctgaaaacatactaagtgagaaaagctagtcacaaaaggtcaaatgttgcattatcccacctatataaaatacccagaattggcaaatctacatggacaaaaaacagattagtggttgcctagagattggggtgtggaaggcctaaggggaaaatggagagtgactgctaatgggtataggctttccttggggggggcctacaattggatgtggtaatggttgcacaactctgtgaatacattaaaaactactgaattatacattttaagggtgaactgtatggtatgtgaattatatcccaataaagctgttactttaaaaaaaatgcaacatgaaatctttttggacataatttgttacctaatagttaaaagggtttctttcattggtgagtttatactgatgtttaacaagagcactattagccaaggatacccctgggtattcttcaaagtggtctgtgagctagaaaaggttaaaaaccactgctctcaaatttcatacttcctcaaaaagttaaacacagggtttccatacaatccagtaattccactccaaagtatacctaaaagaatgaaaatcctgtgtccacacgaaaacttacacacatgcattcatagcagcattattcacgatagcctcaaggtggaaacaactccaaatacccatcaattgagaaacagggaaacagtatgtggtacacccatacaatggagcattgtttagccatgaaaaggaatgaagtgtactgattgatgctacagctgagtcttgaagacagatcaaatatcacattatttctttcagacgaaatgttcaaaaaaggcagattcatagagatagagagtagttttagtggtttcccagagctggcgggaggggactgggaaatggaagtgactactaatgagtacaggactcttttttggggtgatgaagaaactgtggaatcagaatgcggtgctaactctgtggacatactataagccactgaatcgtatctttgagaagcgtgaattctatgatatgtgaattatctctcaacgaaaaaagaaagtttcttaatattacaaatactattcaggtgtgcaaacttaccaaaattcttttccgatccttttctgataaaaactttactggtgggtatttctgggtaaagctgtataatataaagagattcaaaaggaaaaagtcaaacatctcatttgaatattttctctgtctaccatcaaagcatgtgccaggttttgggactgttattgtttgctcttctctccactcttgaatgagtgctggagaaaccaaggagtcactagttaacttgaggtcaagagctatataacctgctccttgtttagaatcaagctaaagacgtgacttgagattctatctctgagaagcaaaagcgcaaggagctaccggcttccagcagctgctaaagcagggcaggcactacctctattagtccagataaaaccacaccatgagggagatggccgtgaaactgcctttgcagaattgtaataatgagagaaatctaatatgactggctccatctaacctcacaggctcaatttttgtttttattgtttttgcttattttagtgcagaggccaatataactaggagaggaatttatagttaaacgatgaggcaaggaaaactgacccccctccttgtttcgagattgaagccacattcctaagccgaggttagagttatggtagggtctgaactttgctaaagaataagcataaacaatgacctgccaactgcttagcttagctggcttttctatatgttgcttcctgccccagggtcactcaaacagaggtcgcaagatttgtaacttctccaacaacttctacagataacatcactattgtgaatcctaaggaaacggtatttgaggtatctttcagatttagcattttggcagacagactaagagatgtcacccggtcctcagacttggcttccatgaattgattcagctgcctgaagacagtttagacacccccatgatttcacacccagccaatcgtttcagctccccaggcccccacccaccaaactacccttaaaaactcaagccgccgagttctcagggaggcagatttgagaaacctcgcccattctcacacgtggctggccctgtgattaaactctctcttcgctgtaacacctgttgttctcagtgccttggttttctcagggcagtcggcaagaagagcccaccgggctataatcatggcattctctgggtactgtatcagggtccaggtggaagaaagcagcttcgtgaagtcacaggcccaacgcatgaggaccgctccacaagagcgagaagagatattaatgaaactttgtctcctgctccaggaattttcacaatcacggcatcctcttcctgaccagcgtccctggtaaaacgactgagcatcagcatcttctgtctctgtggatctgctctgaccctaagtctcacttatcttttgataccctcttgctgccctaaggtgccactggtccccagcccacactgatgtcccaggagcagggcagtgtgatctgaatataaaacgtccagtgagaggtaataaacacagaactgaaatattcattttaaaagttattcagttaggaacaaaagtgctttaaataaaatctgagacatcagctttatggtcattatactaattggaaaggtgttgtgccaggtggcaccgtctccatccctgccctgtccccagcacagacacagcactaggatacagaatgcacttccttaatggtcgctgaactgaagggaatatgaagggtcattagacagaagcccctgaagcaggggtttctcatctccagaaagccctgagcgtgcttaaattggagtgaaagggctttctattacaatgcagacgaattcccccattaagaacttccagggtctcaaaagctcaagttccccttgcagactacaaaatcagatgggagagtctgagggcaagggtgggaaccctggggctcccccttgtgagctcaccgaccgtctttagtacttgccgcccataggaagtgcctcaggaaagtcatccatgcagctggggagcaggagcaagttctgccttcagtcaggagcgatgctgttagactggcgggagcggcacagatgtcttgtttgccaagtaacacttcttgtcattccgcctcttcttccctcaccaactcagctaggggacggcactgtaaatctcagagttatttgtgtgcacctctcacaccgctccaattgtcctcatttctctgagctcacgatatccatgtcttcagcctcagtccccaagtggcacacccagtgccgtggcacagctgagactctttccttcccacgactgctcataagcaccgtggctcctccgaactgtctgtcgtgaaaacgctggagccgtctctgactcatgacttcccctcactcaccttcagggctccttctctaccgtgtatatgattttagagtcaagaccgctcgggaatgggaatatagctacatatgggaaaacgcggtgcagggagaaaaccaattcagtgaggagcggaggcgcaggactgtggagtgtgcatccggggccatggaaacaaatgttaatccaagctgtcagcttagaatagtccctatctgaaagcttaaaatgaaatgtggtgtgctacttataccaagaggaaacggccaaaccgttttattacaggaaatgtacttcaaagaaattgaactgaagcaaaggcatggttgcccgacatacgcagtgacgggcataagatggactaaaaaatacttcaaatgcagcgtgctgaaacctttaatttaaaaaacgaaaaataggttgagtttcttgctttgttcttcttcaatatgtagcagccaagttttagatttcatatgtatacgctcaagtaattaaacttttaaaaaactatcttatactcctcacttcttcgagaagccacacatacaaagctgaaaaacaggaaggggagagtgcctgtggggtcctcctcagtatgcatgtcatcctgttttcctccttgcagtaatgggtgacagagcacagtgactgatagagtgcagtgaccatgtgggtgccgttggctgggccacatgctgagccagctgcctgggtgctcccaagcacctgctggactgactcagggctgggcaggagcacaaggccttttttttttttccttttttgagacaaggtcttacactctgtcaccccagatggagtgtagcggcataatcacagctcactgcagccttgtatttcttgtagagatgaggtttcattatgttgcccaggctgggctcgaactcctgggctcaagccatcagcctgccgaggcttcccaaagtgctggtattacaccgtgcctggcccacaaggcttcttaaagacctgtagcaggtgaaaatcctacccagtgtactggctcatccacttattcaggaactttccattaagctccgttctacactaggcactgggggttaagcagcaaaatgcagcagaggcatgaggcctgcattcctaagcgagagagaaaccagcaagcagaggcagaatgaggtaacaaatctttccttacaaccccaaattagtcctttactaatcattaatattttatgccattccagattaaacttactgtttagccagtaagcagtattcttacttagaatttaaattatcatttgccatctattcaaagaacatttaaagatacagagttaaaattaaacaaatggcatataatcaaagtattaagcaatgggagtgtggtaaaagagaaaaagcccacatacaatccatttactcaggattctagaatgacactgtcttctttctttccctgtacaaatataacctgtaacttccaaaaatatctttagttcttgggggccactttgctcaaagtgacaagcacgtcaagtaaacctatttccagttacattcttatcttgtcagtgtcaagatggttgtttgatcatctttatcacacactgagtcaggaaaagtaagctagacggagttccatcaatttccaccgtcacgcttttttagccaggcctacgcttgaccttctgacacagtaatgcaggcacgcggatcacctgacttgctgaccaacctgaaggacggaaccattccagaatgagtcacctgcaagcagcccgagaggcaaatgtttgccctttgccactattttcaaggcggtttcacaggttgacaagaataaattattagtaaattcttaggattgaattcttatttgtgcttctccatccagtttaaaagcacacactcaaagatatcacaaaagtatcaaagagattgcataattctcacatgttgagagctcttgtttgtaagctattgccttagggaagttatcgaattgagacatttttcttttcataaataaattctattgtctaaagaaaataatcactggtggacaagtttttagaccaatatagaaaatgtgtggtgggttatttcttattgttccaatttttctaaaaagaaaaaaaaagcttcaattaagatctctcaattctgctgtcttatcaaaggcagattttctggctcccatccaaggaaatattacaagctgcataactaaagcacagaatcatggcaaaaaaaatttaaagcacaagtaacaaccttatattactaaggaatctgttaaaaattactgacaacttttgttctgataagtgctgaaattaacagtttgcttgactgctcagttgaggataagaatcaagtgaatgacacattttgtttaatgactcttctccagtcgtatttcccttcgatcatttaatgaaaatcaaaggaaaactgctcttcattttttcatttttgttctggacttgataaaaggctcattcaatgctgacacacatcgtccaaactcatcccaataaggggaaaaaatcacatcaactttaataaatgctgtcatttttctttctaaaatttctgaagattcaactgctactctagatagttttccacatacagtacgtgcaagaggaaagtcctggaggctgaggctcagcggcctcgggagtgcctgagagagaacctgagggcaatagtgtcccaaagggtgaggaggggttctctccgaaatctgactcaaataaacatttctatcatattacataattcttctgccctctcacttcacctggactaaattctggaaacctcctcatgaactctggtgacaaaagcagctaaatgactacacatgacacaccataggctccacatccttattttgtggtgtttgcatatggtacatttcaggcccactggattgtcctcctattttggaattctatcccactgatcaatatatgcagaagttcaaggaaaatgtgaggcctggcctcaacttctatgtaataaatttgcagaaattcagacgttcagagtttgaagaaggaagatcttaacacatctagattgattcttctccccatgttctatctgggtattacactcaaagtgggggaaatgcgtatacagacatttatttaggttggcagagtttggagcaaacaaacagaattaattactcaattgagacaaacttattttaactattgactttaagacaaaaagtacacataccttttttctaaatctctgattttctctcttagtggttcaaccatctagaacaataataacaaaaatcagttttaaagcaaaaacacagttctcaacccctttcaccccattctgatgtttcagataaggcaaaacaggttttaatttcttctacaaattaacttccagtttgaaattaagatacaccacttgcatcacaatgctagaattgaacagataaactgtccatttgaactcttactccataaatgcctcggtttctgagacaattaatgtttttgctcacccatcctactaggaagaatgtaaaaggtgtttcaggctcataaaaacagatcaacactatccatctctttttaggaacaatcccctaagcatggcccacaaaagcttaacatcttgtttctgcaattactgtgtatactcatgttatcagctgcagcacataaattgcaggctgtgagtcaacctacatccacgtctgtagacactgtggactcaggcagaaagacagcaactcaagggcttcccaggactccctaagttggcttcaaatccaaagtaagtaacctcccatcccctcccccacagcccatgttacaacggtctggctgtatctacatgtatttaaataggaggtgcataactgagcataggtgctagccttcagctgggtgggtgtgcaacgtctccatctgtgcacgtggcctagcatccgattggtggccattgttcttttcagcacctgtgccagtgagaggatgtttgtactcatctctatctcccaaaggcaatcacttccctttctctaaaaaacgcttacctgaaaagtcatgtaaaagtctaaatccattttgcctttgaggtagaatttgttttaatacatcaaaaatggaccaacagtaacagactgcatgtcctcttaaataagggagtaattttttgagacacggttgcaaaatcacagaacagcatcaagctgccacaataagaatgacagcacgagcaaaggaagtaaaattgacaagtatacagatgaaatagatacaaaaatagaaaaaagactaacctcttcaatcttgctttcaatttttagttcaccattttcctggatagacctgttgagtagaaagctataaaactgagatcaactgaaaggctttgtgactttaagactgtttctgaataaattaccctaacataacccaacggatgcagaccacctctgtctcctgctcaagtatcagtcatgtgtacaattccctccagaagggatgcaccagaggaaaagaagacaaccaaagggaaggactccccttaaatccatctgtgaacatgctcagtattacctaatggattatttccactaaactaaaataatctcactgctatgctacatccaacacaggattttaaatttgaagcaggaagtgcgtctgtaggagtatgtgtttgtgcctgctgggctttcctggggatttaatgtaaaaatggagtcttttaagtaaaaccacagagctcctttaaaagggatctgagcaccccacctagtcatacacagcagcctttgtcaggagacacacacatgccctggtggtaggaatcaaatcgacaccatcccacccaccttgcaaaacccaactccacatgaaaagcctcctgagggcatagtaaccttttaccctggtagacatgtgcagccgcattacattacaataccaacctaatcatcacaatagtgattctcacaacataaccaagtggagcaaattttcctttacatggaaaactattaacagtaccaaatggtttttacaataagtgcttatttctttttgctgatttttttaaaggctatttttttttatttggtaaagagataacacgagttttatttttacaagagtgcctcctgccctatgaagaagcacacacgatgcatacaggcctaacgctggactaaataggtggtctctgcatcgatacccactagctggccccctgaggtcatgggcctgccatggcttcccgaagacagctcccttctcagaaggctttgcaaaagcccctcagtgttcttgctcaatccacccagaaatacaatttacataagctagggtcaaccctttattatctacacaaggagggaagcgggggtggccgaccattgttttacttgtgggccttacttggtaattgttaaaatcagctgcattccttgagaatacccataggagaaaagaaacagctcagatatgtgaatagcaagaacccacttttgttttaaaaatatttttcaattaacccatgacatccatggtatatatgtaccaactgaaatgtgtctataaaatccaaccacagtacccaagtaattaaaaacaattacctcatattaacgaagttgccccaaacagctgtaagagaaagaaaaaaggaagtcaatgtttaagtccacaactttcagggattccaatggatggaatcttaaattttaaccaatattttaaattttacaaagaaaattaacttacgaagacaacaaaatgcatactttgttttcaaaacaattaaatcttactacaaaataagtaaaaacaggatcgtagagtttattcaggccaagtttgagaactgcaacccaggaacatcaattcaagttgccctgaatatatgctcccatcagcagcagtgacaagtgggcttttaaaggaaaaggcagtttctaagttatcaagaatttacattaaaataacataagctactgattggccatatattgttttttgtatcaaaaatcccaggaaaaagataattggttgaggcagctgggcagaaacaaaatacctttaaagaaccggccctgggcatggcagggcatgactttagttccgtgctcatgactctccagcctgataaattttgcaaacctcacatggctcacactgctctgagctgtttttcttttctatctatccctgcagttttggaatacctcttttggggtctagagttggacagtgcaggtgaagcttttttttttttttttttccaagtgacagatctccctttattacccagtctggtctctagtgatcctctcgcctccgcctcctgagtaagtgggactgcaggcgtacgccatcacacctagctaaggatgcatgtgttttgataaacagtatgttctcaacctttgtttgaggaagagctagtcacaaaaatcaaataatcacatgtctgaaagaagtcctaaggttcagtctaacctctcccttgtaatgatgatgaaagcaaacccagagaggttaaacagtggcctgcagtgcggcttaactccaacgggagtgccatcctttctcagcacttaccacatctcccttctatactctaggcacctggtgggcaggctctcctttgcctgtatacagctggccttcagtaaatgtgtataagtcagccctgaatcaacagcagatgactttaaaatgtaatactggaccatgagcactcactttaagttactgagcaggattctttctacggaagcctttcctgagcataggcggtcctaatattttgtacacactcctatttggccctcatgtggccactcagcagatactgaaggccttctaagtgccaggtgcatttaggtgcttccaggtgccgaggaagaacagagagattaaacacaaacgtcctccctgtcccgggctgttaaatttgtgagcttgggaaggccctgaggttaggatctcataaccccaggcatcttcccattgccatcctcttgtgtgtagtaggagtttaatagctactcatcaaataggattcagtatccaaactacacccccacatgaaattcccactctcaagaaggggaatgttgctaattccatagaagcacatctctcttcaaacagaggagaaaacttggtttaaaaaaaagacagcaatatatgaccaaataaataaaagtggcaagaaagcagggaaatgggagaaattaaaataaagctattaactagattcattattcattaaaaaaaataaaaactgcttatgtcagaggcactggaaccagagtaactccatcttgaacagtagctgggtaaagtgaggctgagacctactgggctacattcccagactgttaaggcattataagtcacaggatgagataggaagtcaccataagatacaggtcatgggccgggcactgtggctcacacctgtaatcccagcactttgggaggcagaggtaggcagatcacctgaggtcaagagttcaagaccagcctaaccaacatggtgaaaccccatctctactaaaaatacaaaattagctgggcatggtggcgcatgcctgtaatcccagctacttgggaggctgaggcaggagaatcacttgagccctggaaatggaggttacagtgggctgagaccacaccattgcactccagcctgggcaacaagaacaaaactccgtctcaagaacaaaaaagatacaggtcataaagaccttgctgataaaataggttgcagtaaagaagctgactaaaacccaccaaaaccaagatggccacaagagtgacctctggccgtcctcgctgctacactcttaccagcgccatgacagtttacaaatgccatggcaacgtcaggaagttacctatatggtctaaaaagaggaggtgtgaataatccaccccttgcttagcatatcatcaagaaataaccataaaaatgggcaatcagcagccctcagaactgacctctctatagagtagccattcttttaatccttcattttcttaataaacttgctttcactttaaggactcgccttgaattctttcttgtggaagatccaagaaccctctcttggggtccggatcgggacccctttcctgtaacacttatacctttgaaccatgtgattttgcttttatcttactctcaggaaatcagtaaacatacaggaaaagtgccctcaccaatgtcatggccttatttataatcacacacacaaaaaaggaataagccaaaatatcccataattagagaattgctgtataaattgtcatacagccatttgatgaaatcagaaagccattaaatatgaccacggaactacactgtaacatgatgcagttatgacagtaccagacgaaaaagtatatatacagtgtgactctcacttctgtaaaatgcattgggaaaaaaagactgtgaaatttccaaaatactgagtttaaatggtgacatgagtaactgtttaattttccttgtggttaagtgtttacttacttttaaaaaagtttagttacttttaaaaaaggagggaagagattttaacccttactaaactctatgtccttgttgtcctgttcttgcctttttctagacacctggtgaacacctgggtcagtcctcagctcggacaccacgcactgctgccaccagagtccacaaagatcacctgtgagccaccagttgcccaacccatgtgcgcttttctttactgtgctatatatctcaaataagtatactgtctcattttggctacaggattaagctgctttactgagaataagtattccatgctatggaagcatccattctcttattgccttctgggtgggtagcaccttttggcagacttttcaaatcattccatcgttatttgctttttcagttttttctttcaaaccttttttcaactcactttaaaatgttgatttcaggttggtgcggtggcttgtgcctgtaatcctaatactttgggaggccaaggtaggcaaatcacttgagctctggagtttgaggccggcctgcgcaaactggtgaaaaccccatctcaaaaaattagccaggggtggtggcctgtgccttcagtcccagctacatggcgggggcagaagcagaaagatcgcttgagcccaggaggttgaggctgcagtgagctgagaaagcgccactactccagcctgggtgacaaaagtgagaccctgtctcagaaaaaagaaaaaaagttgatttcacaaaaatctctcaatccttctatcctcagtccatttcacagcagtgaaggctgccacccatcccagacaccttctgtttccttgaccatgatgtcctgagccctttccccttgcccactgcttctccttaatcatctcttcctggggaagcaggtgacgcccatgcttcccaggatcagccctggggaatgatgtccaagccacagccaaagctttaccacccttcataaatggataagaatggatgtaagcagatatggaccagatccacttctgtgtctcagacctcttccactgcccctggaggctggagatgcacctggagacgtgccctctcctccccagctgcacctcctgattcatgctgcaaaggaggcttcatgaatcccttccttccccactcagacctccacgcttcgccactcagacctccagagcaggcccctgcaagcagccccctgcatgtgactctccaccttccctaaaccacttgctgtccccaacccttcagctcgtctacaggtagtgtcctgggcacctgcacctccaagactcatctgagcatctgattctccagaaagcaccttcaaccttccctcctgctccaggagacactggtggccctcctgtgtggccaaggtctgctgcatgttttgttctaattggtaccttacaggtgggtctcactgcaagatgaggcgttttcatatttacatttgttacaccaggcatacatggtccaagcactaaaattcgttgaatgcatgccaagtaatttttcccttttcttacatttatctcttgcttattactttttatcttcagacgcgctataaccaattaatctttacaatgttttcatgtcaagtgttgtggcctcctttcaaattatcaaaagctctacctgctttgcttgagagataattcaatacccagcccagaccaaagaacagacacacacacacagcaaagcaggacaaacccccacgttgctgcacagattccaaagggaaagacacaagcaatttccaacaattatgaagctttagttttgtgtagagtagcctggaaggttgcagggcatagaccttaaaagttaaacattactttaaattaatattgcttttaagtttttgcaacctgcttgagttattttgacccaccttacggtgcttcaaacagatagctgggcattactaacagatgcactctacaaatatttgaactgaattaaacccatttatatagtaccaggaatcaatattaagtaaagtaagtattttaagaaagataattattcagttattgacaaagggcttataactgaatgctcttacacagctttcaagatattttaatttttaatataaatttaaaaaatactttgtatgtaaactgaggcatatcagcttcatagttctcattatgttggtatccagacttcaagctatgcagggaacccagttcaagaaaatctaactcataaaaattttcatttagagtgaaaaattgagttttttaaaggatatgattaaaatgagtgtccttttccaacaaagaaaaaattcaaatgctaacccaacactttcataatctctgagtctaacttgatttcttaaatagtcatcagctatcatgagatcaatccttttagaatacagtcttccaatctgaagtctgtggatctccatggatccctgaatgggtttcagggagactagaggggagtctcatgtgaaagcacatgtgaaattgtgtgttcacaggtctcaaggtcctccaatgaattcaagaccccgaacaaatgaaaaaccatcaattcagaatccataaaagcccgggattttaagaggcacatttgttttagaatagggatatagcctgagtccctgaatgccaggccacacagaaagtacagattcttcaccaggaatccagatctgggtagcaatttcaatggccctatttcaagtaatgttacaaggctggatcaggcaaaatcaccatttccgttttatacctgtccattttaaatggctacagtatgctttagcatgtttttctcagtcattccgatcactatttcaaactggaaagcatatgtacttttacactaagtcacaggaagaaagtgtgatttagggagactgctctcctaccctacgttatctatgtaacactgtatgtaaggcacgcccttctttatagtatgacatcctataaagcagcctgctggatgctcagtgaaatcaggcagcccctggctgcggggtcctcatgcaggctttgccttctttccaatgtttcctaaaatccttccttgctcctccatcccccattcattcaacaaactcagcgcttgcggatgcacaagttaagaccctgcacacattgctttactgtccagaggcgacatggggtctgtgatggaaatgcagcatgtatggggaggaccccctgagagggcgtggagaacccttcccaaaggcctggctgggtgacaagcagtggggggcggggtggatccacctcagactacgggaaacagtgtgcccccattcctgcaataaaaggtggagcagccaccactggctagatgctggaggacttacccctttattgagacctaggcctctagacggaaccatgcacagagaaagaaaaggcatgccccaaaataacagtaacagaggccatcagtcacagggcaaatgcaggtctctttttaaaaattatttaaacatttatttgagtatcttctaggagccaagcaatgtgtgaggtccggtagccaaggttcctaatccacactgccttttagcattgcaagggctctgcaggccccaacactgacagagatggggctgggggtggagcagtgtggatctgattctcccatctcaaccgataaaatctaggaccttccaggccacaggtctgtacttcagacctgctgaatcagaatctctacagaggcctcccagcagctgtattttttaagtaccccaggtgactgtgacccctggcgagggaggaggacctctaccctaagggatctggggacctgctgccaccacctattgcccatctctctgaatgttcagagtccaggctcaggccatctgcctcgtcattcctcagacttgccacacctgcctgcctcagggcctttgcacttacacttctcccaactgcctcttcacctttccccctccctcagttcatccaaggtctcagctcaaaagttaccttataaaagaggtcttctgaccaatctatctgtgagagcacccaccccccaacagcccacttagcctttctttttcttcacagcacttatcaccagctaatatacctatttatatctgtttattgcctgtttgtgcccaataaaaaaatgtaagctccacagcagcaacaattttgttttgttcagtgctgttatctagggtactgagacagacgaacatagtatgtgctccctaaatatttgctgaaagcctgactaaaaagctcccccaaatgactgggaattgctactctagggcagaagtcagaaaactgtaggctgggtgtggtggctgatgcctgtaatcccagcactttgggagtgtggactgctttagcccaggagtttgagaccagcatgagtaacatggtgaaatcctgtctctacaaaaaaatacaaaaattagctgggcatggtggcacacacctgtggtccctgctactcaggaagctgaggtgggagaatcgcttgagcccaggaggttgaggctgcagtgagccataatcacactgctgcaccccagcccaggcaacaaagtgagactctgtctcaaaaaaaaaattaaaaacccacaaaactctattaaaagagccagaatagcaaatattgcagttttgtgggacatctctgtcccagctattcaactctaccactggagagtgaacacagctgaagataatttgtaaaagcatggctgtgctcccacacaactttattgaaggacacagaaatgtgcattttatacaattttcaggtgctgtgaactagtattctttttgacttttttcaaccatttaagaattgttaaaactttctagctcttggatcttacaaaaactagcactgggctggatatggcccatgggccacagtttgctgacctctgctctaagggataccagaatgactaaggtgattccagtccaaggagttcttgtccttgaaggaaaatggtcagcagccacctatatataatgcaccctggagaagtaaaggctgcagtcacctgagtcctggggagtagcgtgaagatggctgtgggatgacttacggacggagaaggagattctggtggaggaagaggattggggggggcgggggcgggatggcaatgccagcagaggcccctggggaggggaagatgcagcagcaaggtcaagatgggcaggatggttgttttcataacaagccccaggagattctgttcatgaaccaaatatgggcaccactgtgttcccttttatattattccaagaaagctgggctccggacagcaggcaatgaacagctgttcagagcatgaagagacagtgaggtgctgtagtctgagcaaatctggaagcagcggtgtgagagacaaatggacgagggaggaggtgaacagagagtaaataatgcagagggcagagcccaccggtcctgagggtgaggacagtaatgtcacaagataagagcaccagaggcagatagttggggcagaggaggatggtctgagataagtacatgcttagctcagggcatcctgtagcaacccacatgaagatgtctcacaggcaaatagaacctgagggctggggcttgaaggcccgcatcagccagaggtgcaacccagggcctgtgtggggcgcacgtagtgagaggccacagccctggggagggcctagtaacagaaccaaggcacgtgcccagtaagagtggcaatgccagcatcactgctgcttactgagcacctactccacgtgggccttttatgttggttctaatcacagcgtcatggtatcaccaccatcccacagcggaagacaggccccaagaggtagccggtgacttgcttgaggacacacagctagcgcccacccatccctgggccacccttccaaaagttaggcctcagtccaaggcctgcatgacctgtcaagggctccagattccttcccatctgcatggaagaaacgcatcttgttcatttccaaacacatcctctaagctaatcccccatcctcaatgccacgtggcacatgctcaaacaaaaactgagtgacatcaacctccatgaaatcctcagtggggcagcgaagcctcctggaatgtgaaagatgccccccatttcaggagaatgaatagcgatttccaaccttccagtgctcagagcaggaacactttaatttagagagacattcaaaatggaaatcttgtacaaacagagggcaccttgagcacactgaaagtattattggcagagaaagttccagaatgctgctgctgcatgcattccaatgctggactgtttgctgttcctctcaagcttttctgaacatgtgagctgtatcgaaaagcttcatctaagttgaaaaacagtttctctgccaagtgcttgcagcaaagctacatggagcctttatacccaaagggatactccaaagtgacacttttaaaacctatccaaaaattatctggcacaccttgcatggggggacagaagtgtctctgtgtccttcttttaagtctgggggtcttgagctgcttggaccacagtgaagagcaaaagatacactatatgatgcctttagatggtcacagatggccgccagtgcttctgccacatttgctgagacacttggtctcagagccctgaaccaccatgcgtgaagtctgaccacgtgaggccagacaggttgcctgtgggcactctaacagccaagcctgagtctgtcctcaaggtccagacctgccagtgaagaagccccctgcaagtggatgctctaacctgggtgtggtcccaggcatcacgaaacaaagaagagccatccccgtctcaaattcctgatccaccaagcccatgggtataaatacaacggtaactgttttctgccactatgttttaaagtggttggttaagcagtgaaacataaccacaaccaaaacagtgccagacctgtcaccacctttaatctattgatgctcatacgcccaggtcacagccctcaaatcaagccaaatatagggctaaatccctcctcacccacagcttgccctaccaagtgtatctgtgccctcctccagtcaaaggcactgctttgcatagagactggcccgcctgggtagaaggcaagggccaagtctgaagtcctcagaaaattctgatccctatccccccacccctggctgctccccacctggctgcagtcctcccacctcccatctgaagaaaacaagtgtacataggaaagatgcatccttactcacctctgaagaaccccaatcatcctagcactctggaaaagggcaaatcttcgactttccttggataaaccctgaggtggcacaactgaaatgtttgcttaaagcagataagaatatgcatcattcttctaagaagaaaagcattcaaagttttgcttaagctgaccagaaggttcgaattagaagatactgctctgtgtttaattctccaaataagaaagggggatgtgtccctgcggtgagggggcttcgcagttgctagttcccaccaaaagaatgaggtgctcaaaggtcaggcatcatgatagaccaaagagtggcagctgctgaacgggaagccgtgcctactcctgaacctgaaggagccttagccctaaaccttggagcatgcccagactagagaagcactctgcagccgccctcagccttccaggcctgtgctcattctaagcggttacacaggatgaaaagtggcccaaataaaaagtcaatctggggtgcctgagcaggctctagcaaccggcatgctccaagcctaaagcaaagggcgcttgcttatcagacctccctgtggtcctcgccctgctctgagccctccaggaagccagaactccaatttgttgtctccagaagcaggcaaaagagcagctctctgcaaccccagctggcaggctctgaaatccagctataaaacccttgtgatgcacaccttcccataggcttacccaataaaatcctaccaatatgcccaggggaaaaaattttgccccaagatgtcaccttttttaaagggtggttaaaagtatgggttttgtagatgatatctgcaccttttacaactttttgcacataaaatgccaacgttaagtaaaaaggacaacttagaggataatacatacagcagggtcaatgtttttgctttttaaagctacatgcattttttttttcttttttctttttttttttttgagatggagtcttgctctgtcacccaggctggaatgaagtggcatgatcttggctcactgtaacctttgccgcccgggttcaagcgattctcctgtctcagcctcctgagtagctaggattacagttgcgtgctaccacacctggctaatttttgtatttttagtagagatggggtttcgccatgttggccaggctggtcttgaattccagacctcaggtgaaccacctttttcggcctcccaaagtgatgggattataggcgtgagccaccaagcccggcctagctacatgcatttttaaagctattcatgtatttgtttattttagaagtctggggacaccaggtaatacgaccttcctatacttttgtattactttaatttccgcaaatcacaagaagaaacttttgaacaccttttttaagtctgtacaggatgctgccatgtgaggacactgcgagaaggcgccatctatgaacaggaattgggccctcaccagatactgaatctgctggggccttcatcttggacttcccagcctccagaactgtgggaaataaatttctgttgctcataagccaccctgtctgtggtattttgttactgcagcctggggtaggacagctcccaaagcagaaactctggggtgtggtctggccatctggccttagcaaggttccaggtgttgctgacgtgacccaaatctgagaccctctgctctgggcacccacctgtgttctcacttgctcagttcctctgaagacattccacattttagtaagacaaagaacagagtcaaatgccagaagaactcctctgtacaaacctcttccatcgcaggcgctactaaattctagacgccccttctccctcttcactgctcttccattgtggttggcagatgctgacaatgtgttcttccatgtgtcccccatctctgtgcccgccgcgtgggggccctggccactgcatcaccatgccacctccttccgggcccttctgtctatgccatccccacgtggcacttctcccgtctttacacggtttgtccaaaaagtctttgtccttttcctgttcaagatttctgagttctccagaacaatctggtcacccgcttccaattatcagtgttgagcatgcaccccacatatatgtatatgtaccactatattatgttctttataacaacagaaataatgtaaaaggacaaggcaaaaagtatgtgtatgtatatatgtatgtgtgtgtatatacatacaagtgtgtgtatatatatataagtatgtgtatgtatacatatacaagtctatgtatatgtatgtgtctgtaaatatatacaagtgggtgtgtgtgtgtatatatatatgtgtatatgtacatgtatgtgtgtgtatatatgtgtgtgtgtatatatgttagagtgtgtgtgtgtatatatagcagctccacaaatctcttttacaacattccacatggagtagggcccatggggcacaccctgccccaccctagtggatgcctggcactggcccccacccccagccccctttcccccgccctatgtctactcctccatcacctgcggcaagctgggcagtgtagttctgagcacacccagtgccccccagccttcctgaaccacagaatgccttccagcttcttctatcacattcgtacttcctgaccaagaaataatcagcgtctgatcattaatgggccttttctctaacggacagcagggcggtgttgataaagcttgctcagcaccaggtccctgtgggctggacggggcacagcttgggagcagggcttcatgttacctttgctctgtgcagcaaagccctgcatggtcactggtgtctggctctctcctcctcctgagggtgcccagtctccctctgtggctccatcatgcatcaggcacaggtgaggcaccctctccaaatcaaggccaatcccaaggctccctgctcatgttcctggacaggatgcccaaaggatcctttgtgatgaagcctccatggtctcccccaccccaccctgaacccccgctcttgctctgacttcaaaccctggctcttcccctgaccctctccacaaaggccctgccctgcacttctcctgctctccgctctctggctctgtcatctttcccaaccctgtgcggcctcaccccctctcagatgcccgcccagaccctttctttgtatcaccatggagtcttccgcctgctcctgtctccaccttcacgatgaggacaaggtccctgtttgattcattctctactttactctgcaagttcaacattacagaggaaatggaagattacaatgagaactttaatatgactgaccttcaaatcccaagacaggcttgaaggtaaagctttaaagttctaaatattgcattctatccttaaggggtttcactcttattcaagaaggctgtaagaacaacagtttgaaggaacaggattttccactagaagtccccactcatacaaagccttctttttgtttacatgagaagacactatgatataaatctaccaatgagttctgtgcaaccatagattcatgaggtagatctctgtgttgaaagatttcctccacggccaggtgtggtggctcatgcctgtaatcccagcactttgggaggctgaggcaggcagatcacaaggtcaggagttccagaccagcctggccaacatggtgaaaccccatctctactaaaaaaaataacaaaattagccgggcatggtggtgtgcacctgtaatcccagctactccagaggctgaggcaggagaatcacttgaacccaggaggcagagattgcagtgagccgagatcacaccactgcactccagcctaggcgacagagcgagactccgtctcaaaaaagaaagatttcctccacatataaagtaaaaaagcaaagcacagaaaaatcaagggcataaaaccatttacattttaaaagcacctaagacattctacaaatggtacaatgcaaaggaaacaaccagtaacccacgggaaggtgaacaggattagctggaagggagcgatgctttccatatacttccagactgtttgactgttaaaattatgaattaaaactaagccccagaaagatatgtaaaatatcaatgacccttgcatgtcactatccaaattataaaccacccttaaccaccaagtaccttcccaggttctccacctcaacttaggatttggctgcaaaaatactacagagagaaagctctgcaataagtatttcagtaacaattatgtgactaattcttagagctggaaataagatacactatctgcacatctccacctgagaaaatcaagtactttctgtcattggaagcaggacaccaataaacttggaaacacgttgcactcacacatttcactcgaggttctagtccagcgtcaccatttaacaagcacaaaacatctcttcatctgaaataccagaggataccatcaaatttggggagaatagggagaaagaaatagaaaaattccagaccacttctgaactccagaaagcaaaaatggactttgatcctgcaaattactacagacaacaaagaagtggactctccttcctcctctcctcccaacttcgcaaatatcaatgatgcctggtgtggcatggtagaaaatgttaccatgctatttcttttgcctttttctacttaaagagatgtaggctccacctaaggatatgtgacaatattttacctcaaacgataacaatggaaaatgaaatatactttccctaaggttaccaaatgaatgaatctccttagttttctgatggaacgaacagatacattaaagaaaaagagggaaaccaaggggagggaatccctcctagttcatgggggcatcccacagggtgggctgcggagaggtcactggagtttcatccctcccacacctgtcaccagtgaggctaagcatcagggccctcatccttacaggcacatccctcagcagccctgtactcttcttccccgctgccaatcacgtccctggctcagggcggggctctggaacctcatctctctctgaaaactgctaacaggccccagctcccggcacatgctcccttctcagcaggctccagcgagcaccaccgattaggtttgagaataaccgttaatgaatctatttttagaatgcctaaggcaaagaaagctggggcaagcggggcgtggtggctcacacctgtaatcccagcactttgggaggtcaagacgggcagatcacctgagctcaggagttcgagacgaccctgggcaacatggtgaaaccctgtctcaactaaaatacaaaaaactagccgggcatggtggcgtgcgcctgtagtctcctactcaggagactgaggcaccagaatcacttgagcttaggagggcaggttgcagtgagccaatctggcgccactgcactccagcttgggctacagagtgagactccatctcaaaaaaaataaataaatttttttaaaaatccatactagttaagaagaaaaagtaaattcagacttctcaccacgacttttaggaggaactactatgatctaagaaacctaggagtgctaacgctgggatccaacgtaacatgtaaagctctattatttctttctgaaagtagggcactttctaaaagttaagaagaagatgggaacaaagtatacaacttaaggattaatgcaaaaggcaaaggagaaatttttttaaaagatggattatgacttcagggctcattttattgcttactgttaagaagttttgttagtaatatatttgatacttgatcttgatgtagaatgaatgcgaaagagaaatttgatggaaatacacttcacaaaagaaagaaattacaaaactttgctgagggccaaaagaaaggtctatctaaagtatgggtgtccaatcttttggaatccctgggccacagtggaaaaataattgtcttgggccacatataacgctaacaatagctgaagagcaaaaaaagcaaaacaaaactcataatgttttaagaaagtttatgaatttgtcctgggccacatgcagcccgcgggcagtggcttgaacaagtttggtaaagaaaagctaggcgctatttctggatgggaaggcaatttaatatgcagaaattatgaggtctgggatttttctcttctttgcacttcattctctagcttttccacattgagcaccttgttttctcatttctcctgtattttgtaattttcaaatgggagcttaaaaaattttaataatggttttaagctagccttttcattttgtgttcaaaaagggcagagagggaaagaaggtgagagagggatctaggaggaccatctccaaaccacagcacccacgggcatgatcctcagccaccacagctgtgccccaacccagagggctgtcagtgctctgggctcattctccatgcctcagtttccccacctatgaaatggagagaacatctcccctcttcacgcctcactgcaggatagttgggtgctgcttctcctgcccaaaatgagggctgcatttcagcatctacactggtgggtgggggtggggtgggaacgcaggcaaggtgaagcctaaggagggcagagagcgcttccgttgggatagtggggtcctctcattgaattaagaacctaggatagaaattctgttttttaaataattaggatgcactggggtaagggagcagggaatcagaattaaattccacagaacagcaaaagaaaccaaaagaaaaaaagaaaaagatcctgatttggcaatgtatgagttttgctgagaagccctgtttacgaggatccattattcacagctaatggccatttccaccagagccatcactagcccctttgatgagtgtcagaataacttggttctttcccttggttacaaccaagccatcctacaccaccaatgttctgttgctgataaaacccagctgcctgctcaagtcttttttaaaaaaaaaaaaaaaaaaaagcaaggtcacccccagtatatatgtcaaccaaattctaacttagaaccagcaggctttgctttcaatttctaaaaatactataaaaatattcaaagatactaagaataacattccaagatctcaccaccctaacaaaattgttttccttttctagcacatccagactccctctgaaaaagactgctttgaagttcaaacgttttctgctgttgctttacttcacttatttattttggttacagcaactctaaaaagcttaaccaaaaagaaactgatggattaactccaaattcactcttggcccttctaaatgcagggcgatgaggaaaccctcagcccccctcagaggagaagttcccacttgctggccgtcactgcccttcctgcctggaaggagtccctccatgttgcaggttactttacaacacacacccacaccttttttcccttgaagctcatcaagtgaagttatcagctctttagagaaatcccttcaattcctcacagtatttaaaacaaattatttttacctgcaaggcaaaggagtattttcattttacaaatggaaaaaaaaaattgaaacagaaggttagaaagcttgcaccacgtgatagggtgagaccgctttattcagaaaagggatgatctggccaggcactgtggctcatgcctctaatcccagcactttgggaggccgaggtgggtggatcacctgaggtcgggagttcgagaccagcctggccaacatggtaaaacctcatctctactaaaaatacaaaaattagccgggcgtggtggcgcacgcttgtgatcccagctactcaggaggctgaggcaggagaaacgctggaacctgggaggcagaagtcacagtgaggcaaaatcgcaccactgcattccagcctgggcaacagagcaaaactccatctcagaaaaaaataaaagtataaaaagaaaaagaaaagggctgaccctgaattaatcctccccacatttacccttcaggtaattcctaggacttgtcatatttgtaagacaaaaagcaagacaagaaatttgcagtagacattaatgtgggttcagtacacatgaagaatctggtaactggcctcacctattcaacatatctatttgtgaaagctctccaacttcacatcagacatgttcttgacttctcagctgtcttagtccatgttcaggctgctatcacaaatatactacacagtgggtggctaataaacaggaatttgtttctcacagttatgaaggttgggaagtgcaagatcaagacactggcggtgagggctcacttcctattcacagacggtgccttcttgctgtatcctcacatggtggaagggaggaatgaactcccttgggcctctgttacaaagacactatcccatgcatgagggctctgcctcctgacctaatcacctcccaaataccccacctcttaatgccatcacttcaaggattaggttccaacatgtgaattccaggggacacaaacattcagatcacagcactggcctgtacagaagtaccatacatatcatataccaggactagaatccagtcacatatctacaaaaggtaggcagctcaggagacatgcacaccacaaagcacatttcaggccacacgggccaaccccaaaatgcaaaactgattatactttgccctgccctaatgtctgaacacttcaggcatgttcatcaaaatctctctcatgctgcacaaattcttatggagggcttactcatgtcattaaatcaagtttatgtcaggtcagacttccacattctgcctttatgggccacaaagactcctgctcctggcattgtgtcactccagcctctgctcattccatcactttcaccttcaactccactgcccaaattgtatccttctgctaaatgccaactcaatgccccaggtcttaagggcatcccattctctccaagtcccagatctcatttctctcatggtactcagcactttaccttgactactttaccttgtccattttcttaggaactatggtggaaaatgggaaaattgttgaaaataaagatgcccaagtcttaaaccctgtttctacctacagaacacttctgataccacgtgtgtgtgcttttcccatactaccaaccaattctcccactctctagacaccaagcaagtggccaatgattccattcaattctggctccttggagagaaggctgattccaggtttggggtagaaaaagaaaatgagcctgaaacatctagacattaaggaagtgctcaaagactaaaagaagctacgggtccacagtgattaaagaaagatcaccatgagtttaacggtgccccctaaaatatgtccacattccaattcctagaatttgtgattgttatcttacttggaaaaaaggtctttttagctgtaattaaagatctcaagacaaaaagatcatcccggattatccagttgggctctaaatctagtgacaaatgttcttataagaaacacccaggagagatttagcagacagaaaaggaggaggccatgtcaccgcagaggctggagcagtgcaggcaaaagacaagaaaccctggagccacagaggagcattccgagggagctcagccctgccaacaccttggtttcagacttctggccaccagatttagaaataataaatatctcttgtttcaaaggcacctaatttggagtaatttgttacagcagccacgggaaactaatacagtgagagaagaaaaagggagggaaagttcttttcaaaacaccaccagttaataactatcaaaagatttacaaaattagaaaatcactaactgcaatccccaacagaaaaatcggtccaggcaaggatcgtcaatggacatgaaatgcactggctggagaacaagatattcgcacaggtggcaagaatcactccacagattgcatactgcaaaaatgtaccttcaaaatgaagcagcatagaggccattccttccaggggtcacactgaacagtgtcaagtgggaccagcccagacactacatgttcccaacgacaccaattagcaagcattgttataaaaatgtttaactgaacttaatcataaggaaacaatcagacaaatccagaatgtgggacatttataggaaaactgctctgggcttttatatatatatatatacacacacacacacacacatatacatgaatatacgtaaatatgtatatacacacacacacatatataggtaaatgttatgagaaacaatcaaacaaacaaaaaaaaatcaggctactatggctccagaaatttagaggcataaaaccaaatgcaacatgtaaatcttgactgggtcctagattttaaactaaacaaaaaaaaattttttaattagctggctgtggtggcacacacctgtagtcccagctactcaggagcctgaggcaggaggatcacctgagtccaggattttgaggctgcagtgaactaagatcatgccactgcattccagcatggacaacagattgaaaccctgtctcaaaaaaacagaagcaaaaaaaaaatctcagaaaggctatcacagtcatttatggtacaatggggggaaatttaaatatagactatatcttagatattattttgttaatttttagggagtgataatggtaatgagattatatagaagaatacctttattcttaggagatatatgtaaagtacttgaaggtgaagtactgttacgtctgcacctttcaaatatttcaacaaaaaaagtatatataaaatatatacaaaaaaagtaagaaaaagaaaaatgtggaaaaaaatgtaggcatctggtgaatctgggcagagagtatttgggtgttcactaaaatattcttttagtagaaaagatagaaaatctgaaaggaaattttgaaaatgttgaaaattcacaatttccagcttgtgcctccaaccctcaggctcctacaggcctaggaggatcctaggaacctgcatttgacaagcccaagctgatctcacgctcgggtcagcctgggaatgccaccggtactaggttgttggattttagctgtctgctgtcccccagggtcctctggcgtcacagtgatatctaacttgctgcacatcctccaaggcagaggctaacaattgtgtcccgaatgaatttatgagggcaattgccgatcatgtgggagctgattatattaagggcaaaactgtaccgtaaccaaagtcccaacctcagggaagtttgaagtctattaccataaacacaaaactaagacacataaaacactctttcatatggttttcaggttttatctcttttcttgttaagtaacactgacaggaaagaaaggtaccacaactaaaatgtcactacaacaaaatccacaatacaccaaaaattacataaatgttactagatgtcacaatgtcacaactgtaatttccttttttttttttttttgagatggagtttcgcttttgttgcccaggctggagtgcaatggcacgatcttggcccactgcaatttccgcctccgggttcacgagattctcctgcctcagcctcctgagttgctgggattacaggcgcccgccaccatgcccagctaattttttgtatttttactagagacggggtttcaccatgttggccaggctggtctcaaactcccgatctcaggtgatccacctgccttggcctcccaaaatgctgggattacaggcatgagccaccgcgaccagccttaactctaactttcaaaggctaaaggtgaaaagataatggctcctaaacccgactaaaacatcagaaaatgtcttttgtctttgatttcttttctttttttgaatataggcaatctattttcctccctgcccctctctccatatccctcctccctgacttcttttttgttcttgtttaaggaatcaatccacgtggacagggagaaggggaagggagaacaggcaccaaaatgctactggataggaaaaagaagataggtgaatatggggacatggagagggcacggacgtgggcgggcagtggaatggcccatttatacttagggtcaagaactgggccaggcctggagcatctgcaatgggtgtggaggcagcagagacaggaagtctgattttcaaagacatctaagaagcaggacaagttccagctcctgtcccaccctggcagaagacaggtggctccatctctggagagggtggaatcagggtctctgacagaggagcccagatccccctgggacaatcaggttactgattaggctacagccctcgctcactgggctccaggatgcaggcagccaagcctccccttcctgcagggaccagggagagtcttgtgacaatagcccgggaggaccaacccgcagcactaaggtcagaaggccccaacaaggaaaggttcagctcacagaaggcagtgcccatccctacagagtcccccactcttaaacatgggcaggccatctgaggagagcctcacacagaaacgggaaggcagcctagaggaaagagatccttcagtaaagagaaaagaaaacaaattttttaaaaatccagagaatataccatgaaatgaagaccatgttttagttttttaaaaaagttcacagaacaaaaaagaactcttatacatgaaaaagtatggcaaaaataaaatgtaaaaaaatcactagaagagtctaaatacaaaaatgaggagacgtcccaaaagtgcaacaaccttaaaatggtagaaaataggaaataagaggattggtccagcaatcctatatcagaatagtagtagtcccagaaagagatgaaatagaaaatgggaggggagaaaatcaccaaagaataattcaagaaaattcccataactgaagaataagtgtttctggattgccagggcacaaaaaatgcccaacatgctggataaaatacaccaaggcctagcactgtggatcttggaacaccacggatgtatcagtcagggcaggcattgttaaactacagcaatgagcagcccaaaagccctcagaggcctacaacaaccaagatttattcttcaagtttatttcaatcgaacagggtcatagcatgggtgggagggggttctgcaagctgagtatcatcattgtcaagctgagttcagaacctaactagagggaaggaaaactctggcagcaacttacactcgcagcgaagtgcaggcccagaagtggaagtagcacttccgctcagctcctgggcaggccactggcacaacaaccatgtgaggccatcaagctcagggagtgaggaagggagggcaatcctaccaagagcctgggggacagggggctggacatgtgtggcgagcactgacaactagacccgaaaggaagatgctacaatcttcagaaagagaaggactggcttgaaattcttcaacaatactggaggccaaaaaggattggaccaatgcttcaaaaattctaaaggaactttttttctataattctacactatcaatctatcagacatgaaggcagaaaatatacttatgggtaaagtctcagaattcacttcccatcacatccaaaccagggagtgaaacaagagggagtcaggaagaggaagtcaggaaacagaagtcctgcagtgggtaggtccaggctgatgtgggtgcaggtggtgaggctggcagctgaccctcagatgtatccacaagttgcagtagaaggccccggggcccttcttcaggaaggggtgctgaccaaggggcatcctgatgctcatgaacatcatgggggaagacgcgacagacaactggcaaagagtttggagttggatctgtcatactacatagaaagcaagcaaattagaacaccagccaattattcgctggagaaaacaaaaagtaacctacaacatgactcactaggaacagcatttacatagtcatgcttgtaaacactgcatgatgagctccgtgagattataccacatctatataggagggtggagagcatgtacaggggcaaagagaagaaaaaaatcatctcccaaagaacaaagtcactaggtaatatctacaactgaaaaatcaggaagccaggtgattcaatggcacaatgataaataccaaaataatcaactaaaagaagtgaaatgcctaggggttgggtgcggtggctcacgcctgcaatcctagcactttgggaggctgaggtaggcagatcacctgaggtcaggagtttgagaccagcctgaccaacatggagaaaccgtctctactaaaaatacaaaattagccgggcgtggtggcgcatgcctgtaatcccagctactcaggaggctgaggcaggagaatcgcttgaacccaagaggccaaggttgcagtgagccgaaatcacgccactgcactccagcctgggcaacaaaagcgaaactctgtatcaaaaaaaaaaaaaaaagaaatgaagtgcctgcttctggggagagggaaatggtggcaggggatactgtttggccctgcagaagctatttaactttttacactatatgcatgttaaaaaaaaatacgttaaaggtaattcaagcagtctgcccaggagctacctagtaggttggcctgatttttgattcagcacaaagggcagaaactgagttctttcaatgagccattagcactgctataaatgtttcaagggctgaaacacataagacacaatccctgtcctcagaatcgggatttcattgagaaaaaaaagccaacatatgaatgggaaagaactcaagtacaatgcaagttagcaggtggtcaaccctaagacatgaagaagagttatgtggtatcaaggaggagactcagggccagagtaggtaacaaagactttgggaaagatgtaaggaggagaaggagaaaggctaacagaacttgagttctgttcccgaaacagggagggcatttctgcaacggaggctggctaacagtgagggtgtatataattgggaagtatggacagttttttcaaacagtggtgagattttacttgtaacagggagggcaagattactaattaggaaaagcagagattagaaaacacagacatcacggttgagggactacattttcagtgtccttcggtgttatcaatcacaagccctgtaacatttttccctgcagagtggctcagacttagcatacctgctccttattaacactgcctccaccctgtgttaaacccctcatagctaaaatcaaccatgtcgtgggctgcaccccaggcctgcctgcctgcttgcctgctctggcccctgtctgcctgggcagcctcatggctgtaattttgttttcacactccaacaataccatccttctttgcattcctagaatactgcctgctcttggctgccgcaggacctctgcacacactgctcctcctagaacacgctctctcctatgacttccctgttaactcctacataagccgtccattctcagctcacttttgattcctcaacaaaacaaacgtacctgattgctctcactcaggagttcctggcatagttctcatgcattccttttcctcacaccagtttgtaatttaaccttcatttccaattcatgcccacctcaccatcttggccagtgggtctcaaagtggtgtcaggtcacagcaacagcatacagaacaacctattagtgatgcagattctcaggccacatcccagaccaactgaatcagaaacttgaggtgggagacaagcagtctgtgttttttaaaaaaaaccctactgattctgatgcatgcttaagtctgagaatcaacgtgctacactatgtggtatagggtctgtaccatcacagcacagaccagttaagttttagcaccccatggtgtctcctagtgccaaattcagggacaacagtaaggacttggtaagatttcctggtcagatgaatgattggttaaaaaactttcctgctgggagcggtggcttacgcctgtaatcccagcactttgggaggccgaggcaggcggatcacgaggtcaggagatcgagaccatcctggctaacatggtgaaaccccgtctctactaaaaatacaaaaaattagccgggcgtggtggcgggtgcctgtagtcccagttacttgggaggctgaggcaggagaatggcgtgaacccgggaggtggagcgtgcagtgagccgagatcgcgcccctgcactccagcctgggctgaacagagcgagactccgtctcaaaaaaaaaaaaaaaacttcccatggctccataaatcccctactttattaattctaaacccttgcagcgactatagaatacccccaaaataaacattgaaactgctgttcgaagacctgggttctagctcctgctcccaggcctttctgggttcaaattttggccctccttctcttactatctgtgtgatcatccataaatttcctaatctctcttggccttaacttcctcacctctaaaataggaatcattatagtaccgatttcccagggttgctcaatgattgagacaatggcactaagaatcatgactcacacagttaagcactcaacaaatgtaggtagtattactgccataataatagttattcaactttaaatggtctttcctcttgggtctcagctttcttactcaagattgaccacacacacactttagactagttcttcctcccttgcaaaactacacacatctaacacccatccgacgcctgaaacctcccctagcaacccggagtcctgctggggttttccagctccacctcctgaacagctgggctgtagcacacaggctggatctactcatacttgccttcctagagctcaactgaagtcacttcagacaagtgaagtacccactcacctctggaatcagatcttggtaacgccaacaggttagcaggtgatttcatttcagtgtgtgtctgggtggctagcattcaaacgcagctcacactgggagctatttctagtccaattttgctacttggtaacgtattaatagcatcaattaaaacattcccaacgaatagatctttaaaaggacggtttctgacttccctaacaagcagagggccgaccacctgcctgcgaagtgcccctcctgccctgtctccaggcagcatgctgtgagcgatgacagaaactggacccgcgcacagagaagctgcaggcacgccctgcccggccacccagctgcctgcctgcttcgcccggccgccgagccccgggggaaaacctagaatggggatgccggtgcgccccgacacctgggcacggccgcgggccggggagccgcccacacttggctccccaagagttaaacgctgagtaattttcctgaggagcaaacagtcggagcgggggctctgccaatggccacagtatttttatccgacttaaccgacaccgcggcgcgacctcggctgtccccaagggtatccccacgcggcacgctccggagtccccgaccgggaccctcgccggctcccagcgcgacatggacgacagcgccgccgccgagtcccccgcgcccgggcaggaggcagagacctggggccgcccgaggactgctaggggcccctccgcccggggtccgcgcccgggcctaagcggtagggggtgtgcgcccaagttggcccgctttgctgcaagagtggaaaggggtgggagcagaaagcgccggccccgcccggggcggggagcaacgcggggctgcagggccgcctcggggccccgaaccaccgccgcccggcccaccgcggcgccggggaatgaatggggctccccagctggcagcgggcgcgcactcacaggcgacgtaggccagcaaggcgatgcccagcagcagcttcatcctcctgcggttgacggcagacacgaggcgcagcagcgccttgctcaccatccccgggagccgcgcgggtccagggccctaccgcgcgggggcccgcctgctgcacaatgcgcggcggcggcggcggcagcggccccgagagccccgcc

SEQ ID NO: 1440 - DNA, 101038 bp, Homo sapiens; identical to SEQ ID NO: 1439

SEQ ID NO: 1441 - DNA, 101038 bp, Homo sapiens; identical to SEQ ID NO: 1439

SEQ ID NO: 1442 - DNA, 71138 bp, Homo sapiens
cgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgccacatttacttagaactagtcttcacttttttgggtctctaactgaagcttcccctttcgccccatttttccatcactgtctttcttgggccacattttgatttcataatagtagttgcttgaaggcagtgggggaagtgggggaattgggacactggaccaaatgtctgatcagctcatcacattgtccacatgaaatggaccgtcttcctcagttcaaaataatcaaatgatagatggagaattctgaaagttaggagctacaactatttgaaataaaactctagttacatagttgaaccgttcaaggtaggttgtttaaaagcagtttgttcacaaacagatatatacacagtagagtaaatttgttattttagcaaacgcttatttagctcatgctgatttaatgagggttcctttcatgatacttaatagttataagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgtaatcccagcactttgggaggccgaggcgggcggatcacgaggtcaggagatcgacaccatcctggctagcacggtgaaaccccatctctactaaaaatacaacaaattagccgggcgtggtggcgggtgcctgtagtcccagctactcgggaggctgaggcaggagaatggtgtgaacctgggagacggagcttgcagtgagccgagatcgcgccactgcactccagcctgggcgacagagtgagactccatctcaaaaaaaaaaaaaaaaaaaaaaaaaagtaagacttattctgctaactgaaaagtctagggatattccttccttagctttaggtatcactggagatcgtcttgcctccgtgatgcttccctcgaaagctttgttcatgtattgagagggatggctgtagtgtaataacaatcgtccgcaacactcagtatcttacagaagggagtgcttttctccttagctctggtggaagtccatgggaggctcctgggtttgtttgcacccatttatgatggtgggaaatgggctaagttaattgcccttatctgagtcatccagccggtttaatttctccttaccccatggatcaaagcaagatgagtccggactggggaagggttggttctccgaaggaaggggtactgaatagattgctcagaggaattaagaccccttggtgtcaaattttagagctacaactgttgggctgcaaggatcattagtctaatagcataagcattttttttaaagttaacctagaaatacttagccattctttagaattaacataattaaacaatttcaaggtaatttttatgtaggcatgaatagcattcagtgaggattttccattagtaatattaagaaaacatagttgtggtataatgagccctgtgataaaaatcttgttgaatatatcaaatttggttccagccctcagatttggggtcttcagaagcacttggtgcatgggttttaagctaacagacatgggaggttggtggataatggtttggatacggttctcctgtcaactttaaaacttaattcatttgttccttcctttattctttttaccagacttaaatgtgtgaactgttcctaggtagtggacctgttgtagatatagtctctttgaaactaaccatgtttctttagtcacctctgtataatcccctcctgccacattaattcaacaaatattaagtattttcactttttgggcttctagaggggttagggtaagcttggagatattactaaagtttataatggaggtaggtacaaaagttttgtaggtatatacgctgtaaaattagatgtgaatcagttgtgtgatgttcattcaaatccggcagaatatcttatttttaataattatgtttggataattgtgtaaacttaacattaattttttaacttaatgaactttttaaactaatgaactttgaaaaacagagtttaaactaattcctaaataattgaagccagcttgataagtcctgatatgcagctccatatattgctccagtgatagacttgttttcttattactaacttgtaggtgttctattaaaatttcctaaaatatacatttatgcatattataataatgagaatgagtacttaaaaactcatttgttctgggtgtggtagcatgcactcataattccagctgaggcagaaggatcactagagcccacgagttggagaccagcctgaactacatactgagacgctgtctcaaaacaaaacaaaacaacaacaacaaaaaacccttttatatgatacttcttcctttataaagtggcttttactaaaaattgattagaccttggtaaatggtgacctagggtgatcaaatgggaaccctgctggttttttatttttattttgtattttatttgaagctccagatataccatttaccagcattgtgtaatttcttttgtggtgatcagtttctttagagagaaagcttctagtcttccatgaaaaagtctgcttatcagctttctaaattttatcctggggaatggaggttggggatcttaacaatcatgtatgcagtctatcaggtacatctatttttagtatgacacctgcattagggttaggttcatttctgtgtggtagatcccaaattatctgagttaagattttattttgtaaaaagttggcaggtaggtagttctggtagcccagggctggtgtagtgtttctgtggagttaattggggctcagattcctttcagctttctgctgtttgaaacctagaatattgttctcaggtccaggttgcaatcatatccaagttccaggtagtaggatggagaaaggcacggggctcgccctttagggtgtttcctggcaactgttccacaacaccctgcctatatgttaccggccattttgtgtgtccttctgataggatgctaggaaaaggaattttcattatgagcagctgtatactcagctaaagggacacagttttgttaataaggaataggatagactgataatgatgtagtcaattagcactccctaccccacttagcagtgcttgatctccaccttagttatatttgatatctctgacatttttttcttttttcttttttttttttttgaggtggagttttgctcttgttacccaggctggagtgcagtggcatgatctcggctcaccacaacctccgcctctcgggttcaaacgattctcctgcctcagcctcctgagtagctgggatttacaggcatgaaccactctgcctggctaattttgtatttttggtagagacgggctttctccatgttggtcaggctggtctggaactcctgacctcgggtgatccacccgcctcggcctcccaaagtgctgggattacaggcgtgagccactgtgcccggccaatctctgacgtttttttgagagtgaacctaccttcagagtagaggatctgggagcctgaagttttctttgaaggattttcaaccataccttctcgttccagcctcacattgaactaccttcagaggtacctcatgtttcttaattcagatccttttctggcttctctggcatgatttggcttctgctttggctcccttccctcttagccagttagattttggctttctctttttcattcacttttcaccttttagtaaattttgttgaaacctcttatatcctgtgtgtcatttcccgttctttttgtccatgttcatgtacatcttttacatttttaaattcttgttttagtgggttttggcggggagcaaagaaggatgtttattcagatttatttgtttaactgtaagaggaacttgtttgcattttcagctctccacagtgcttgtaacaatttacattctcatcagcaggtatatgggagtactttattcttccatatccttgctaatacgtactgattaataatttaatttattgctttttgctaaactgatgggtgagagatagtacctttagtttgcattcctcttattttactgaggttgaacagtttttgtttactggccactttgtttctttttctgtgattgcttgttcttttcttttgcccattttctattgagttgttttttccttactaatttgtaggagttgtagcattttctggatatttatacttttttcattaggtatgttgcaaaaatcttccaatctgtttcttgtctctcaactgtgtttattctatcttttgtcacatggaagttctcccaaaagtgttgtcatctcataatctgtagttaacattttttttcttattcctaatgttgtgcatgtgttatgtgtgattttcctccctcagatttgccaaaggtttggagccaccttttctttgtttaaaaccaaggctttttggttggttttctgcccttgtcattcatttttttaaaaaatgttctttgttccttttttctatctttttgtattgattggttagttttccatctttttggtttttctaatatattttaggactgtgtatttttttctcagtctgtattggttgcatcctactgactttttcatttgtaaaatgaagttgatggaatactcttttaatttctgaaatattttctacatggtagtgttttatagatcagtaaagaaaatgttctgttttacttcataactgttgtttggattctcgttgttggtttggtggtgaacatactctttgcagaacttttccttgtcccacggccatgaaaatttaggcttgcaaacggtttgaagggtgagtaaagcagggttttattgggtgaaaaggaagaaaagggggaaacaggaactctcacaaagctagagtcccagttagagcacatcccgcctgcagcttgaatctcaggttccgcacaggaagaggaggggccagtctcctccctatggaatttcccaaggctccaccttagtgaacaggctggttggaatttctccagggaccccctcccacctggctgtctcaatattgagataatattagcacaatgacgttgctacaatttgttaaccaaatactaatggagagtctgtgtgaaccatactgtaggagacaatgtggaggatataaagatatacttggtccctggtctcaaggaatatctgtaattggcagacctttttggctccgtaattttattccacataggtgaataaacatatgggaagatttaaaatctgatttgtttttctgtgttttgacttttctggtgtttagtaaatcttatcaggactatcatcattctgtgtatctgtaagaagaatcttctgaggtgctttacacaggagatttaagcccacaaagctatctttatggcagaactggactaagatcctgacctcttgattccccagctagttactttttgccatactctctgctgcagtagtgcttgattaatgatttttcatgtgttaaattgggtgaagaaagaagtgtgaaaataaagttcacaaagaatctatgaactccagccaatatctctggcccagcttttctgattctcttgtttcatcctctagttggtggtctggagttgcacatccctaaatacagattgcagctgaatagggttgtgtgaattagcattgcagtattattttggccatgtggattggttgttcttgatccccacaccttccccttaaattaaaaaattcttttccggccgggtgtggtggctcatgcctgtaatcccagcactttgggaggctgaggcgggtggatcacgaggtcaggagttcgagattagcctggccaaaatggtgaaacactgtctctactaaaaatacaaaaagttagccggtcatggtggcgggtgcctgtaatcgcagctgctcgggaggctgaggcagagaattgcttgaacccggaaggtggaggttgcagtgagccgagatcacaccactgcactgtagcctgggcgacagagtgagattctgtctcaaaaaaaaaaaaaaaatttttttttcctttttaaaaattaaatatagaatttaatctttatttaaaaattttaacatttttgtttttttaagacagggccttggctcagttgctcagctgcccaggctggagtacagtggcgccacaatagcctactgcagcctcgatctcctgggctcaagcaatcctacttcaacctcccaagtgggtgcatactaccatacctggctaattattaaatttttagtagagaggaggtcttgctgtgttgtccaggctggtcttgaactcctgaactcaagcagtcctcctgtcttggcctcccaagtgctgggattacaggtgtgagccaccatacctggccaatttttttttttttttaaactagaatttctttttttgttttttgagatggagtctcactcggtcgcccaggctagagtgcagtggcgcgatcttggctcactgcaagctccacctcccaggttcacgccattctcctgcctcagcctaccatgtagctgggactacaggcgcccaccactacgcccggctaatttttttgtgtttttagtagagacggggtttcaccgtgttagccaggatggtgtcgatctcctgaccttgtgatccgcctgtctcgacctcccaaagtgctgggattacaggcgtgtgccaccgtgcccagcctaaactagaatttctaatgggaatttgtcctgtacctatttgtggtatttcaaagaaatgtatttatttcctagtttctttttccccatgagatttttaagttgagttattatatatttgtgccaaagtggttgagttttataaaatactggagaacatatataagtacttctccattgttgcaaaacagtaatctgtaactaccatttgtcatacatgtactcctgtgtgtccaggaactattttaagcacttcatatacagtaccatttattcctcacgcttaaaggaggtattattactctttaggaaaggttcagagaaattgaataattttttcatgatcacatagctaagagttgggattcaaactcagggctatctgacttgaaagactgtgacattataccttttaaatatatttgggattttatagttttggttaaaaaaattcgcttatttctaaaatagaatctatgaagacaccaatttttttgcaccattattttccacaatgtgctagtttttgccaactcctggcttagcatactggctttccctgtgcctacttatacaaaacttgcagcctaggtctactttgttagagatacatcctaggctagagtctgctgctatagtaaagtgtacttaaatgttaaagagaagggtgtggtagattctcttgtttctgtggattccctatctagagaactttgatgcttgtgatctgggctgaactatgagggataataccttgtggaattatattgaaggagtagcttatggtagttggatctcctggaacagattttgctcatggtaactgcagttagcaatggctgctttcttttgtaaagcatttgttgatctctctcattttgttggggttttctccatgctgatcagacattgttgatttccagtgattgccctcctgttgtacttttatttcaacttctataatctgtcctaagatagccattttactttgagggtttcatcacatagcttctaatcattcagttacaggatataaatgccctgttccccccatacagctcaggttttgttagttggcctcaaaaactttggggtgaagagaatgggtataaaaattttagtgcattcagtttagccattcttcttttcctcacccatttgcagaggaagtaacctcatttcctactactcccttccttgtttactttatagcaagggtcagcaaaataaggcctgctcagctgcctgtttttgtatggcctgtgagcaccactccagtgggttagcattgtgagtgttggagaactagcttagctgtttgcctctgttccattctcccctttgcttctagctcctgtcaccctggccagtggccatgctttattgctgcccagacttactgtggtgctgcctacaccagagtaaatattctgcttggcgttggcttggcactaaatggtataatctcagtctggaaattggtgactcagcaaattatctcacctacggccccctggggcaggtgcccacagtagactctccctgagaattttgatctcattggggtagagtaaaactgaccatgttggtcactcctcctgtctccctatggctcctttccatcagacaggtactttttctttggagaatgtctccaggatggcacctgggcagccgtgtgccacaattttgggatggcccaacctaggcaaaaaaggtacagggcagggcaggggtttttcctcttgttatataagtagttacatacttattatatgcttgatttagcctttttcccagcagagtctagaatatcactgttcagaaaaagtttgccagtcctggctttatagccatattggcctccttgctgtgccaagcacacctttaggcgttgttgcctcagacctttagcacttgctgttcccttcttatgggcttgttctttgatagctcctgttcattcacaaaccagaattttaggttttatttttcagagatagaagaaaactttgcattttaccgattcatttgcttggggctagcaacaaaacagagagcaaatagatctagtctttgctttcatggaatttagaatcctttgagagaaaagacaataaacataatcccaccaataatatatcacaaattgtgttaaatcctatgaagaaaatgttcagggacctgagagattataaatggaggggcaactaattttaaaaaggggttacattgactgtatttttttgagacaagatttcacgccatggcccatcctggagtacagtggtgggatcacagctcacttcagccttgacctcctgggctcaagtgatcctcccaccttatcccgctgcatagtccctttgggggactgtaggcccaccaccacacctggctgacgtgtgtatgtatgtgtaaagatgaggtctcactatgtgcccagggtggtctcaaacccctaggctcaggtgatcctcctacctcagcctcccaaagtgttgggattacaggcatgagccacagcgcctggcctagattaactttatcacttctgctgccaccgtggactccattgatccgtgctagcatcatctcttgactggattactacggtagcttcctaactgatctctctacttctgctcgtgcacacctgcagtcagttttctacacaacagtcatggtgactgtatgaaaataagtcatattgctgttttgtccaaaccttttgatgattcacactcttacactatatagtaaaactcagaagtcttacagttgcactcaaggcatcattacttctttgacttcatcacttactattttctcccttgctcactctatgatcatattggtctccttgccatgccagatacattcttaagtaccctcttgtcccagggtattggcacttgattttccctagattggaaattctcagatatctgcttggctcacctcatcacctttttcatgccttttatggtcatgctgttttagagttaaaactttttttcatgtagtcaaatgaccatgttatttaaaacgacaaccttcttacctctcctcatatattcactttattcctcttgtctctttattctccatggcacttaccactgtcttctatataatatttttgcttttttgtcttcccctctaaaagcttcacaagagcacagatttttagatgtttactgctaaattcttaatgtcctaaaactggtgcatagtaagctcttagtatatatttgttgaatgaatgaatgaggaaaactttctttgataacaatgtcagcctagacaatagtgagaaatggtggtaaaaagagtgaaggccctgagcaaggagagcctataatttagtgactcgaatgtatagtgaatatcctgagatgaggctggagagttggatgatagccatatcctgtaagaccttcaacatttttggatgtaattttaagtgtaatgggaatccaccaaagggtttcagtacttaatacttcagagtttatttcctgagtacaaagatattctcctgtataaccatagtacaactttcaaagtcaggaagttggcattgattcattattaccatttaatctgtagaattcattcaaatattgctgattttcctaatattatttacaggttcaggatctaatctagaatcatgcagtgcatttaattgttacgtctctttaatctccttcaatctggaccagttcttcagtttttctcgtctttcatgaccttgacatttttgaagagtacaggctaattactttttagaattttcctcaataaaggcttgtctcattttcttgtgatttctgcatttttgcataggagtaccagcgaagtgatgctgtgttctttctagtgcatatcaggaaaaataagatgtggatttgttctgtagtggtaatgtttatttttatcgcttggttaagatggtgtttgccaggtttcttgaccttacagttaataagcttgttgtactaattagtaaatattttgtggggagatactttgggactatgtaatatcctgtttcattacacacttttcattattttatcatttattgatgaatcttaccagaattagatattatactctgaaaggtaccaaatggtaatttttctaatttcatctagactatggtaccgtaggatagagttttccctattcacctgtttatttacctccgaatggtggtcttttcctcaatgggctcttattttttactgttattttatttagattggttcagtgcttagccattgggagccccttaaagctacctcctgtgcccttttgacatgtcctcatcattttttgagtacttccttaactttctggcatagcaagatgttttagacttgaatattgaattttttcagtctcagcccttgagtcagccatttctctaaggagcacttggctcattttaatgcaaaagattatctgggcagtaggtgtgcttattgctactgtgaagtgttactgcttataggccctcttagcatatacatttaggaaatacatagttacacatttatacttgtttttatttctctctgctacctttaaaaaatgagttaaaaactagctgggtgtggtgacatgcacctgtagtcctggcagctcaggggctaaagtgggcagattgcttgagcctgggagttcaaggttaccgtgtactgtgattgtgctactgtactgcagcctgggcaacagaatgataccctgtctgtaaacaaacaaaaaaagttcacattgatatctccagttccagtttaaaactgtggagttattctaaccttctgccttctcatgtttgtggatttttttttttttttttgagacaggttcttgcccaggctggagtacagtggcgctgtcttggcccactgcagccatgacctccagatcaagtgatcctcccacctcagcctcatgagtagctgggaccacaggtgtgcgccaccatgcctggctaatgtttgtatttttagtagagacagggttttgctgtgtttcctaggctggtctcgaactctgggctcaagtgatccacctgcctcagcctcccagagtgctaggattacaggcgtgatctgctgtgcctggccctttcaggtatttgtatctctgaccttgggaaacttggcttccattatcttcaatgtatttacttaattggatagtttttcctgtttataaccaaactcatagccatgccagccaaaagcttggtctcagatatgttgcccactcctgctgaaaatttgcccccagaaataatcattacaaaaatacccctgatgaaggggtgggggaagtataagggaaaaaggaaaggaggaaagattagaggccagttagaaagcttggcctgacccttttctcctcctttccctgccagacttgctgactgacagctcaccctgatggggggaagtctgctttatattttgtgatcattctggctgctatgcagaaaacaggtcggaaagaatgagaaaggagatggagaggttgtctaggaaacttttggatttctagctgaaagacagtggtagctttgatgtgctgtgtggcagtgctggagacagatagagatgggcttacccaaaacatttaaaagtcggtaaacctgtttttaattggcagtttaccagagatactaatttgtctaatggatacaaacttatttattttagtaagaaatagtatttttaagaaatattttggttttcagagcagatgttagtttgcttttagccaataacagttgataaatatttttctgtggtggtgggtatgactttttgttcatagtttttcactgcatatattttttaagcttctggtttacgtattaaaaaactttttttcatataaaatagctgctcaaagtaagcatgaataatttttgtatcattttaaaccagttgtaattacataaatgcatgtaatatttagctctggtaattattaattctgctctattttttagatattatgatcagatttgttctattgaacccaaattcccattttctgaaaatcaggtaagtcattaattctgtcttaaaattatatggtaatagcacccatttccttctgccaatatcttcactgtctttagagttttatgagatagtgttataaaaataggagcttttagatctgtctaatgcgaatatatgtgcttctgaagaaagaatctcctggaattctgttcatgtcattcttcagtcacttctggggctcatgtagagcaatggtttgtttttctttggacttcattttatgtcagtaggatctgttgactgattaatctgctgtgtcctttcctttgactttttcagaattaggaaggaaactgcacaattcaggaattattagtctcagtttatgtgctttaaaaattattcgcacaagttacatttgcatgtaaaagttgcaaatgctgttttgattaaatgttaattacatgaatgtcaactattttctccttaaaggctagatgttgaaaatgctgataatttcttatagttttattttggagattggataaagattttaaaattagtgatacttttaaattttaaaatagttataagaaaagtactttaaacattcttgtactaaagtttttacaggtgaaataattatatgttgagatttcctttaatatattcctggaaaaaaagtgtaggtggctggaggcagggcaaattgggaggtagatgaaccaagaagggcaaaagactaaagctgctgatggatgtactggagttcattctctttattctctttagtttttctgtatgtttgaaaatttccctaatcaagagtttagaaatttttgtattagattgcaataaataatttaaatgaggtttatttctttctaatctttgtatgtgataatacatatttcaggagcagagagagagttttttaataaacatttaattttcatgtagcatatggaaaagtgaacaaatcacgggtatagcttgaatcttacaaagtgaatatgtctgtataaccaccacctagataaataaataaaatattaacctattccccaaaataaccattctcctacttttgtcatcatggaatagtttttaatttcatcttctaggaaacctgtagtacttacttttatttcccttgcttcacttagcttatttgacaaggatctactacttattttgttccgttgaagtcattgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactgggtatgtaatttttaataaaagtgataggaaaattggtctaactactttgcattgtttttagtttttaaaattgttatcctaatgactctttgtaaatactaaagttttttacatttcattctctttttagcttcaacttttaatgcaattttgaaatatttgtagagagcccatgccttgccaggcactgtcctagttataaaaatgaataaaaccgatgtacttagtttttgggaagatagttgatcatttaaaagtgtaatatgtaatagcctatgaacaaactcatggaagcatatatgaggaagaaagtaattctaccttttgaaagcagacaatgtttgagttaggccttgaaggatggatttgtagaaaataatattacagatacaaaatcataaccataggtcagaagggtgaggacatttgatctaccagctccagcaagataacctctctgtgccttaattttcttatctgtgaaatggagataatactatttctctcattggattctttttttttttttttttgagacagagttttgctcttgttgcccaggatggagtgcagtggcacgatcttggctcactgcaacctctgcctactgggttcaagtgattctcctattcttctacctcagctgggattacaagcacccgccaccacacctgggtaatttttttagtagagacggggtttcaccatgttggccaggctggtctcaaactcccgacctcaggtgatccacccatctcggcctcccaaagtgctgggattacaggtgtgagcccctggcctattccattagattcttatgtggattaaatgagtgaatacatgtaaagtcctaagaacagtgctttattagctgcaatgaataattatattattatataacattgtaatgtatatgtgatatatgtatatttcatgtatatatgtatatttcatgtatattatatgtatatatgtattatatatgcacatataatgtgtattatatgtgcatatataatgtgtattatatatgcatgtatgtatatatgtgtatataatgtgtattatatatatgtatgtatatatgtaagtatataatgtattatatacatatatgtatatatacttacatatacacacatatatagtatatttgtatacatatatacatttatgtgtatgtatagtatatataatatgtatactatatgcatgtattattcatatacatatatgtatatacatatatacatatatattcatgtacacatatacatatatgtatatattatatataagaaatatgtatatatacacatgcattatatataagtatgtataatatgccttatggtatatcctttttatagtatacatatacattaagatatgctataatatatactatataccttctaagatatagatgtataatatgtattatatagtatgtgcataccatatacatacatgtatctatatatcttatataaggtttatacttatatataggtgaggaaatggaaatatatattttatagtagatattatatataatgttaatttaataataattattgttatggcttgtaaccataggttgaattggggattatggagggtgatgatattagaaagcagattgtggagagttgcaaatattatgctcctgactttgtacttttccctcttatataataatagtgcatgtttattgggcatttattttacccaggtactctggaagggacttcataaatagtcttactgaattctccaatagcttaatgaggaaaaggcactattattgccagttgaacaaactggtttagaaagattacgtgattttctgaagtcatatggttaggatttaatgaagctgggatatgaatctagaaggcctaactcccgggactagagagaaacagaccagtgaggagactgatgagagatgatgaggttagacaagctagtgtgtgcaagttacagaagagagggatttcagacttttcagaggtgaagttgactgaatttgctgactaccagtcagaaggaagagtaagagttgaggcttgactctgagatttaataagttggtttgacctgttggatatttattcctctttagtagaaaggttgactctgatttttctgtgttatgtctgggtagacatttctctggcattttgaaataaaggatttaaagctcagaagagaaagatatacattcgggaacaattattaggtgataataaatttattccttctggcagataattgactgagaaaagtatcaaagtcagagctaagtaatataacattcaggggaaatagaggaagaggttctgggaatgaggttgagaaaaagctttcatatcttacaggaaccagggtaaaatagagatgtgaaggaatgccagaagagtttcaaaggtgatgtggtccagtggttcccaaacctggctgcgtattagtattacctgggaaaaatgttaaaggtttatctttaaagatgaagatacagagtgccagatgtgataggagaaagttttggagtagggcactggaattagtatctttggaaatatctccgggtggccgggtgcggtggctcacgcctgtaatcccagcagtttgggaggccgaggtgggtggatcacgaggtcaggagtttgagattatcctgaccaacatggtgaaatcctgtctctactaaaaatacaaaattagccaggtatagtggcgcacgccttgtaatcccagctactcaggaggctgaggcaggagactcacttgaacctgagaggcagaggttgcagtgagctgagattgtgccattgcactccagcctgggtgacagagcaagattctgtctaaaaaaaaaaaaaaaaaaaaaaaaagaaaatatctccaggtgattctgatgatcatcccaggtccaggctggaacatccttgacagagtcattgtggcagaactcaagtcatgtaaggttggagaagtcactggatttagcagagagaagtttctcttggagtatcctgaataagcatcagattgaggggtgaatgggaggtgagggaatggaaacagtaaatgtgggttgctcatttcaggaaatctacagtaaagatttggggacaaagggagcatcattctgagagggagccaaggtgcagaaaaggatttttagtattgttatgacttaagaaatttggtaggctgagaataaggagcagatggcaggagaactaggagacacttgagtgatgaactcaagtatccagaagaactgggaagcaaaaaattagatcataaacaggaggtggttcatcaaggcatttctagtagcaaaaattggtaattaaatgtccttcagtaatgtcttggttaaataaaaggctactcattcatttgaatattgtgtacttttggaatactaagaataaaaatgcatatatgtatttgttgatatgtaaagttatatcaatggaatattgaataaaaggcctgccttagttcagagttgttgcattgtacaactctagggtccccggaattgggctccttgggacactcctcatacagaactcagagtaattcctcctccctcgagttgtgcactccaggcaactcgagtgtggtatagtatccactttgtgaaaagttatgtgtgtgaatgtttatgtagttatttgtgagataccaaaaaataaattctggttaactctggaagatgagatgttgggtgatttttaattatttttttgtagtttagaaaaattgtttgaattttagaaagctgttattttcatgagttattttcgttttgaaaaacttagaggctggaagtggtggctcgtgcctgtaatcccagtacttggggaggccaagacaggtggatcacttgagcccaggagtacaagaccagcttggggaacagacgaaactctgtctctacaaaaaataaaaaaattagccagacatggtggtgtgtgcctgtagtcctagctgtttagggggttgaggtgagaggattgcttgagcctgggaggttgaggctgcaataagccatgatcacgccactgtacttcagcctgggtgacagagtgacaccttgtctcaaaagaaaaaaaaaagataaaagaaaaacttaaaagagagcaagtaagaaacaagaatacagttaaatacttagaaaggcatctttgaaaaaaaggaaaattaaatattgttttgaaaacctggtttaagtttagatggatagaaaaaaataaaggaaaaaaagataaaatagctcttatatgtaaaatctcataaaagctcttatacatgacaaattgtcaaaataaaatgagagactacagtctggtatgataatatttatgggcaacataatagactgagatatgtatccaatatataaacagtttacttttatttcttgtttggaatatatttcattcttgttttttttttttttttttttttttggagaacagtcttgctctgttgcccagggtggatggagggcagtggcatgatctcggcttactgcaacctctgcctctgaggttcaagtgattctcgtgccacagcctcctgagtagctgggattacaagcatgcaccaccacgcctggcgaatttttgtatttttagtagagacggggtttcaccatgttggccaggctggtctcgaactcctgacctcaagagctccgcccaccttgccttcccaaagtgctgggattacaggtgtgagccaccacgcctggctgatatttaattttgttccttgctctctcctgccacactggcctaatgtatatatttattgaattaattaaaattatattcagaacttgaagatattgatcccttgcttttttttttttttttttttttttgatagggagtctcactctgacgctaggctggagtgcagtggcacgatctcggctcactgcaacctccgcctccaaggttcaagcgattatcctgcgtcagctttccgagtagctgggactacaggtgtgcgccaccacgtccagctaatttttgtacttttaatagagacagggtttcaccatgttggccagaatggtcttgttctcttgacctcgtgatctgtccgcctcagcctcccaaagtgctgagattacaggcgtgagccactgcacctggccaatcccttgccttttagtatctagtgttactgatgaaaagtctgatttttgttattttataagtgatctgtttctttgctcttgggaatatttttacagtcttctctttatctttcatgtttagaaatctcaaaagacttaatgggatttcattttattcgtgtgtagggcatttctttttggcccttttagtttgaacacttatatctcccttaagctctgggaagttttcttatatttctttgataattttcttgtctcttttgtctctctttctttggaatactttattagatgttggttgttctgagttgttcactcgtaatttttatattttttcttgactttctgttctttctgagattgcctagatattaattttaaaacttgaaaaaaaattttttttccttcctccgcccttaaaacttttgaaaaaaatttaacaatcaagtttttaatttttaggagctttgtcttattaatttaaaaaatccttttcttttatggatgtactgtctttgaatctctttaaggaatgctaattgtgatatttggaatataatcttttatgactggaattgtctttatttattttgggcttagtttttcagttcgcattgctcttcctttattttgctgcaggcttttttcacaacctggttattttggattttccatatgtttaataaagtaggttagagtagctggtgtttatgtctgctttagtttagaatgaggagactagaactggtttggaagcaagttgaaaactggcctttattacctaggaggccaccaaagtactgtaacaaggagggctttactttatggtacaactctgtggcacaaacatacaaatgtagtgttgttctgattctcctagattggtttgttcagtgttttttgtaaggagccttattttgcctagtggtcaatgccttgcacattatgcaagatcttgaattccaaactgattgaattctgtgagtaatagggagctattgtagattcttttttaaaagttatttttcaattgtgatacaatatacacaatatgccttcttaaccattttaagtgtacacttcagtggtattaagtacatttacattattgtgcaaacatcatctcgagaactctttttcatcttacaaaacaaactctgcccagtaaatgataacttcacagactgggggcggtggcttatgcctgtaatcccagcattttgggaggccgaggtgggaggattgcttgaaccaacgagttcaagaccagcctaggcaacatagtgagtccctgtctctacaaaagatacaaaaattagccgggtatggtggcctgtgcctgtagtcccagctactcaggaggctgaggcaggaggattgattgagtccaagaggtagaggctgcaatgggtgtgattgcactagtgcactccagcctgggtgagagaatgagaccctgtctcaaaagaaaaaaacaattataatgtcccattcttccctcccccctcaacccttggcaactagcattctttcagtctctgaattaaactgtaggtacctcatacaagtagagtcgtagactgcatttaaaaaaaatttcacaacatgaaatttattatcttaatcatttttaagtatacagttcactagtgttgggtgtatttcatattgttgtaaaatacatctccagaactttttcatctagcaaatctgaaatattgtactaattgaacaacaatccccctccccctaccaccatccctgataaccatcattctgatttctgtctctatgaatttgattactctaggtaactcatataagtggaatcatacaatatttgtctttttgtgactgacatttcatttagcttaatgtcctcaagattcatccgtgttatagcatatgatttccttcttgttcaaggctcactaatattccattgtatgtatataccacattttgtttatatattcatcagatcacagacacttgggttgctttcatgtttggctttgtgaataatgctgctatgaacatgggcatacgtatatctctttgagactctgctttcatttttttgggggtgtatactcaaaagtggaattgctggataaaatagcaattctatttttaatattttgaggacctgccatattgttttccacagcagttgtactttttctaatttttattttttattttgagacagggtcttgctctgacgctcagggtgaagtgtagtggcatgatcatagctcactgcagccttgaactcctgggccctagtggtcctcccgcctccgagtagctaggactatagacatgcaccaccatacctggctgtttaaaaacaattttttttttttttgttgagatggggtcttgctgtgttgctcaggctgacctcaaactcttggcttcaagagatcctcctgcctcagcctactaaagtgctgagattacaggagtgagccaccatgcccaaccacgagtttgcgttcctgccaacagtacaggaaagttccagtttgtctatatcttcatcaatgcttattttctgtttgttttttaataggagctatcctaagtggatgtgaggtgtgtagattttttttttttaatcagagttgggttttagcccagctaacctgctagccctttgagaaatgtatttgcatgagggagtaaagcataaggccagctaggaggtaattgcattgacttagatttgtggtaatgaggaattggtttgattgtggtgggacaatgtgattttgagaggtgacagaaaaatggaaataatttattcaaatttaagaaactgagagaaatgacatgaaaatgacttttacatttgaatttgattgtaatagaaatgtggaagtaaagggaaggagagaaagaataacttactgttcttcagcgttttgggtgatgggaatattgttgtggaaataaatgcctgtaagggcagcttgaaatatgggagcatatgacagcaagaaaacaggtctggaaacttgtttttgtgagagtcagcgggatgagagaggtcatagtatttctctttgaaacatttgttttctttagaaaaaataatctgatgaatttttccttctcaattttttacagctcttgcaagcttaggatatgaaaagagctgtgtgttgttcaattgtgcagccttagctagccaaattgcagcagaacagaacctggataatgatgaaggattgaaaatcgctgctaaacattaccaggtatgctgaaaagtagttactacaataatggtcaacactaaattggattaagtggaaaataatttgcatttaggtttatagatacttcttacgcaacagatgttttctaaaacgaatgcacttttaaaatgaatttattcttactgttaaagcccttagataaactgtctatagaccaggtctgttattcctcattgttttataccgagcacctagcacagtgcctggcacataatagaggctcaataattgttggttgaagaaattatgaaatgtctgagatttcatctcaggcatttagggtaaatccattttaaataaattacctaattaaaaaaaatttgtacattattttcatatgttttcttagagtgagacacacttgaaatttcactgttgttacaaaaataaagacaagaaattggcaagaaaataaaattttaactttgagacttgtggagaggtcatatttaaatatggtcagacacataatgttcataagttgcctaatctgttttacgtactgatcatttactaatatggcatgttattttgtggcagtttattttattttatttatttatttattttgagacggagtcttgttctgttgcccaggctggagtgcagtggcacaatctcggctcactgcaagctccgcctcctgggttcacgccattctcctgtctcagcctcctgaatagctaggactataggcatccgccacctcgcctggctaattttttttgtatttttagtagagatggggtttcactgtgttagccaggatggtcttgatctcctgacatcatgatccacccacctcggcctcccaaagtgctgggattacagatgtgagccaccatgcccggccagcagttgtttattatttattcagcttttttttgttttggttaaaagaacagtaaatgattactgttaaataatatatatataatcatgttgtcattttatattactttctaatttacaaagtgttttcatgtacattatttgactctcagataaaccttgtgatgtatgtcatataatgtcattccgattttacatacgaggaggctaaaggtccgaagtcttaataaagcagtctatttgggtttcaatagttctgattccaaatttcatgtaattccaaatgtccttccactgtttcactcccaaacctcccatgaaatttgcttgtctcagaggtagtctgctttttcccgttgtttatgtttagggaagaggtgagtgatgctgttctgagaaagtaaaaggaaaatataccgtaagcaaacaacacgctccaaattgtggcttgccttacagttttgaatgggcatagatgacaaacataatgcatacgctatttctttttgaggctatacatggcaaatattttaaaatgtgaaaacgagctgggcgtggtggctcacgcctgtaatcccagcactgtgggaggctgtggtgtgcggatcacgaggtcaggagttccagaccagcctggccaacatggtgaaaccctgtctgtactaaaaatagaaaaattagctgggtgtgatggtgggcgcctgtagtctgagctactcgggaggctgaggcaggagaatctcttgaaccgaggaggcggaggttgcagagagctgaggttgtgccattgcactctagtctgggcgacaagagcaagactctgtctcaaaataaataaaataaaatacagtagtgaaaacgaagtaaaattttatttagcttttggttaactgtaactcagttagttagtatatgagattttagaaaggtcattctgaattatgaaagaaacattccattctgtgagggttcacagcagggcacctggtatcatggaaagataactggtggtattagacctaggtccttgtctaggctgcttgccacccagaagctttgtgccgttgggcaagttctttaacctctctagtacctccagttccttatctgtaaatgagagactcagacactttgctgttgtagactttgattcactagtttactgaacaagttcagttgttcattcctagcagatactctagtgttataatacttactgactgcagaaacatgctgttcattttaatacatttgactttgagttttctctgtgttgtctatttatctaactcatgacacctttttttttttttcttttttgagatggagtctcgctctgttgcccaggcaggagtacaatggcgtgatcttggctcactgcaacctccgcctcctgggttcaagtgattctcctgcctcagcctcccgagcagctgggattacaagtgtgtgccatcatgcccagctaatttttgtatttttagtagagacggggtttcatcatgttggccaggctggtcttgaactcctgacctcaggtaatctgcccacctcagcctcccaaagtgccgggattaacaggcgtgagccaccgcacccggccaactcatgacaccttttaatcccagactgatttatttctttttcttagtataatttgtttcatgaaagcaaagttattttagtattaacaaaatataattgagatgaaaaatctgatggggaacatttcactagtgagctctgaaggccagacagaaatcactggcaatgggtagtaatgctgttcctcagaggactaggtgtatgtactacctggggtgtcccctaactacggcatgtttaattatttgaaagatgaatttgtttgggaccaaagcaagagcattgcagtactaaaaatattttaatgtttatccccgcctctattctcatgttaattttgaggaagtatatctaaaaatagtttaatcagattgttccattagtttactttgtttttccttgtaatttacttttaatctttgttaaatctcttgttacgctatagagttttagaaagataaccttattgtctgtaggtcagatgttttagattggttttgcataatataaaaatttaaatatattaactgttcactgagttaacatttgaaatgacttttatatgtaacagtaggaaattaagtcttgctgagttcctataaagaaattctttttcccccctttagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagaggtaactccaatttatctttttgttgcatgtgaaaaaaagtgataaggcttttaaattaagaaagtgattagaatataatatgttcaatgtcgagctgtccttcttgaacttgatacatgaattatggaaaattttcagctatccttttctgaatttgtggcacaaatttacatttaagaatgtaggctgtgtttgaagtcatgaaatagatctttagtaattgtctttaaacactccattctggaatagtatttatgtatgtttttaacatgtcagacatttattcgcaaatatttattggatacttactctgtgccagtcactgttctagtttctagataaacggagttagaaaacaacttaggttttggcgacgggagagatgataagcaagaattaagtagacaggataatttcataaataattgctataagatttcagaaataattgctataaaaaataagagaattatatgatagtggctggtggtatggttatgggatagggatataggggaagctgggctaattttagattcattagtcaagaaggctttctttcaggaggtcctctttaaagtagacctaaatgacaagaaggagtcatccaggcacagtccctagccctgggaatgagggaataagaataattcttataaggcatataagttagcatgagagattgaaaatgggctgaatatgtaatatgggctgaaactgaaaataagagataagtcatcatgtggaagaaataggaattggaatacttttttcttttaaaataacagcttatattgagatagaatttatatacactcaagttcaccctttctaagtatacaacataagatttttagtatattcatagagttttgattaccactatcttattttagaacattaccatcatcccagaaagaagccatgtacccattagcagtcactcctcactcccctttcccccactgctggcaaccactaatctattttgtctgttctaaattttgtgcagaaaatgtgatttcatcaagaaagatgttttcagatgcgtgtacaaacttgtgacctcagtgtttatactgagacatgtcagattagctcatatttattttaattataatggtcatattgtattccagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgagtgaaatatatgtttcaactacttccttcagaaatgttcaaggaattagtttcatcatatggtatctgttacatgattttttttggtaggggaatttattgatttgtaagtcatattcaggaatctttgtacattaaaaaattgcagacaacttgggggtgaagtaaaaatgcacataagtgcattaacagtacttattactcagaaaatgatcaataaggaattaatgtgacgattcctggggatttaagatacaccaagagcctagtagaaatttgcccaggattcttgggtattaacagccttcctcttaaaaagagacttgggatctcctctcatgtttttttcatctgaaagacctcatgttcagctgcacagtgttccgttacatcctgttgggccattagttcagtcctgtcatggagagaagaaagtcacctacaaagacttggaagctacctctgcagcattcctggtattccttgaaaatctcctgtttcagaaccaagttgctccagccttaccttgagaactggcatgagtgtagtttgaaatttagatgtcttttattttttcctttttactaataaagctcataaggtattttcatattctagttataaaactgaaaagtctgcaagtagtgatccaggaaggtaggaaattattccctgggagacaggaaagcacacaaggtagtaattcagtttttgattctcttacattttttgtttagatagtgattgtctagcctaattccttggatttttttaatatcatatacttcctaaaagcagtgaggttacaggttagattttgacgttttggaagagccaccactagtataattgctttcctgctttatgtctttggatcttttgaaattaattttgactggaattattttcaaaacaaataggcaaaataacactttatcattatcattggtcatatacttagtgcatttgtctatgatatgtttttgagtatatgacactgaaatattagtgtatctatgatactaaatcatttttatatggctaaaatcatcttcagtaagaactctcttaggatatgaatttaagtgaaaatttactgtcttttttttaaaacatgatgaaacagtaatctatagagcaatttcattagtatatgtgagtaatgatggtttagttaactctacaggctgggtaagggctcataagaaagcttctaaagctctgtgctttgtgttcctctgtgaatgtccattctacttctctttctaataatgcatgcttttctttttgtaaacaaaatgttgacttcatggatcaattaaagagaattgtaaaaacctaaattggcttcagttaacagttaaaaaaaaccccttcaattggaagaaaaaaaatttaattcatagatttcaatccacacaaaatcatgtcgtcttctctgtttacacctaatgactaaccttaatctctaaaccattaatggggtgattctaatttctgtcttcttttcctttttcttcctgcatcccatgttgtctgtggtggtttgtgtggttggactctcccctggtcagtatttttatttccaggaggtgttccctgtcttggctgcaaagcactgtatcatgcaggccaatgctgagtaccatcagtctatcctggcaaaacagcagaagaaatttggagaagaaattgcaaggttacaggtgagtctcttggtaataaatatttaagtaactaacttggatctctcttttttttcctagtgagatttccaagtttgcccataaaaacctttcccgttcatcacccctatcagcagggacaagtgattgtttttatctttagactttactgcatgtttttttgaggtctcatattttatctaaaaaatagatgcaaaatttgcattcaattctcttttttatccatgtttattttaatgtaaaaataattctaaattaattgccatctccagattgtttttgtctttagactttactgcatggttttttgaggtctcatattttatctgaaaaattcatgcagaatttgcattcagttctcttttttggtcatgtttattttagtgtaaaaataattctaaattaattgccatgctccaggagtatgtgtagtgtttaacttgtggcctggtctttgtctaaactggggcatatacttccacaacttgaggacgacagtggagagatgtgtgtgcatatatatatatatacacacatatatctcttgtgaacagcagagtaccttctatgcagttgtgttcatactgttggcattggggttgtcagaaacttgctgtgacattatggcacctgaggcaacttgccagcaggagcaagagctgtttgtatgagttgtttgtgttttgagtattggtagacagaggatagaaagatgacttatggcatttgagttagggaagtttaaatatgtactgatttttagaagatactatggatgtcttggttcattttgtgctgttatagcagaataccacagactgggtaattgataaagaacagaaatttgtcacaattctgaaggctgagaagtcgaatatcaaggtgctggcatctggtgagggcctttgtgttgtgttacctgtggtgaaaggtagaaaggcaagagagtgctagtgagtgagagagagcaagagggagccaaactgctcaatgaagcccctctcttggtaactaaccctctcccatgataatgacattaatctattcatgagggcagagccctcttgacctaatcacctcttattatgcccccacgtcccaacactttgggattgggaacacatgaactttgggggacacattcagaccataacaatggaaatgttgtttaggaggttcagattaattaattagccttttcatgggaaaggatctcacagtgaccaaatcagagaaagtctttttaaaaaagtcagacccagatgtgtctggggcttcactttgattacagtaacttagatttatatataaaaatgattctgaacaaggaatttgtgggaaggattctttttttaaggctagcatatttaaattgtaagtttagtttctttattttctggtttctgggactattagatttaagtaagcccatatttagtctctataaatcagtcagagaaagaactccttttgaaatttaatctcatttttaagtacccctgaaaaaggaaactatttcagattcacacaatgggagggaggtaaatacttttcctcagttatagacacatagattttgcagctttagttttacagctttagttataggttaaagttaagacagaagttgggtgtgatggcacctgcctgtagtccagctacttgggaggttgaggtgggaggatcgtttgaagctagtagtttgaggccagcctggacaatatagtgacaccccttctcaaaaaaaagttaacacagaacacactcactgatccatatttcagaggacagttattctttccggtaggcatgaaatattttttaattgatttgcactcccaagaagacaaacagaacagacaagaagttgaccaataaaccatattcgctgtagtttctcacttagtagagaataataccccatgattctgacggagatcttaggaggtcacactattaaaccaactttctagttatggctactagcaaagagaaataacttattggtcctgtgcaaaccagaaatgaaaataaaatcacaatcaggaaaatcaaaacaatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctgattttgtgcaagtattgttttcttagttatggtactaggttgtaggtattaaggagattgtcattatagaatacttgctgatgtgtttagggatgagggcttataacatctaacttcagtttcatgtagttctgcaataaaagaaaaaatagtacttaattatgtgtttgtatgggaaaggaatagataaagcaaatgtggcaaaatggtaattgttgaacctagctaattattttgtgggcttgaaatttttcaaaattgggaaaataggtatatataaggttatatagttcaattcctgttcctctttttccctctatcctgttccctccatccattattcctactgccccatagttaatttccattaatttcttgttttttttctttctttgaaatagaagcaaatatatacatagacagcacacacacacacacacattgcacattctcacttgtcattcttactgaagtggtagtatgctattaatatatacagtgttgtgtaccttcttttctcatataacaatgtatcctgaagatctcttcatcttaattcagcaacagggagaccatccttagagctgcattgtacttcactgtgtaagccacagtttattgctgtctcctgttgctggatacttgaatgtttccaagatttcactgttataaacaatgctacagtaaaaaatcacgtacacaagttatcttgtacttcagcaggtgtcttagcttaggctgccataagaacaccataaactgggtggtttaaacaacagaaatttattttctgatagttctggagcctggaaatccaaggtcagggtgccagtatggtcatattctggtgagatttacagatggccttctctctgtgtcctcatatggtgaacagcaggaggaagccctctggtgtctcttcttgtacgggaactaatcccctatgaggccccaccttcatgacctcatctaaaccccattattttccaaaggtcccatgttcaaataccatcacattaggagttagggattcaaaatacgaaatttggggagcacagtcccgtacatagcagcaggtatatcttaaataaattaatagaaatgggattgccaatagcaaaatataaatatgtctgtaatttgttacatatttggattgttgatccacttggaatttatcctgatgtgtggtgctagatatggatccagtttttaaagtcttcttccaaatggctagcccattgtccccaaaccatttattttataatagccttgtttacctcactgatctgacattctgactttatcacacattagattcacggtatatattgggatctatttctgcttttattgtttcattgacttgtttatctgttcatactccagttccatatcattttagttatttatacttgagactgttttaatgtctgataggtattatctctcattttttgaatttttctgcctgtccttgcttgtttcctaaattttgtcattttctgggttttcctgactattcttgcatgtgtttcttcatatgaattttcttttgtttaactatgatggaaaacatatataaaagtgtagttgtgtaactatgatggtcaaacatatataaaagtatgaatcattgaacttctgttacccaacttaagtgattatcagtatttcgctattttgtgttttagttatttctcctttcctcatttttttggagtattttacaactatctcacgtatcatttcattcttaagttttttagcctgtgtctctaagagataaagatttaaaaaaattaaaaaacaaaaatttaaaaaattaagaaattttgctagatgggtcattatcccaatctagcaaaattaatattaatattaattagtagttaatagtcataatccagtattatccacatctagtttagttttccctgatttttttctcaggggtcttggtttgttcaaatcaggatccacacaaagtcctcactttgcatttgattgatatgccctctaaatctttaatttgtaacagcctcctccttcccaacttctgtgttgttttcttcactttttcttgttctgtatgttttttactatgatttctgtgatgtctgttttcccttttgctccttgtataaatgtctcagtcttgctttcttaaataaatttgtatttttctttacttttgtgagttctgtcacttcctgtttcatattcttttgctatttggctatcactcactctggtttgggccatccagtcctctgttcttttggtactgtcattgtgttcttaagtgttttagtttagtttagtttttagcatgctgttttcatctgctttgcggcaatatttctttggtgagctttcattatctactggaaagatatactgcttgttttcagttttttccttatggtttttttgtattgagagatgagttgacttttcagttacttaggtttgaatgagattgattttgctgggggttcctgtgcagggaaatgggcaggggttagctttacaagcatcattgtgttaagggctccctcctaaggtccacttctctggctcttaaagcctaccctggattaggaagaatcccactacctctgtacctgtgcttccctgaattcctcacagcctttgcatttcaagttgatgcatctacttttagggtttatattttgctggcattttctgagtgcttatgccctttcttctccctccctacttttctgttctctctttctgctccccctagcaaccctgtctttttagttaatctgtctacttctttttctcaccagctctcttgggatgaggcccctcagcatcacatttttttctgtggtcccctggtggcatgataggggccagttggctttgcctttaccgtcacctggcaaggttttctcatcctgttttgttgttttcagatttgcttaaagtaattttaacttagggtggcacccttagcacttccctttcttccccctctgtgtatagcgtacctacggttctggtactagtgtttgctatttgggggagggttcaaccacatttacaaatcaaatttgatttacaaatttaaaaagtgatttaaatttgtgcaatttcccgtttcctagtttacactgaagggtagcttttgttttgttttggttatctttctctaagcatgataccagctttggaggttaagatttttatcatgttaaggaactataatttctattttacgaagattttaaaaaatcaagaatattgaattttatcaaatactttttcaacatctatggagaaatttgattttttaacttattattttggagaattatataagtagattttctagtattaaaccatttttgtattcttgttattttggtgttttagacttgccttatctcttcatctggtcattttatagatgtagatgctttctatatgcctgagaatataatgtgttctctatttgtggagtctagtgttctctatgtctggtaaaccaaactcgttaattgtgttgctcaaatcttctataatcttacacttttttttaatctggtccagccattgctgagacagatatgttaaaatcttccactttgattatgggtaaatgtgtcaatttctcattataattgtttatatagatactattacatgcaaaatataagaaattttacatctttctggcaaattggcaaatattaaaagattatgtattatatttatccctaataatgctttttattttatatggtgtcactatatctaataccacctaaatttgtatgcggcttatgttcatttttttataaggccaaacttaaaaaaaaattcttattgatgttgacatgttgttcacttcctgtgttgttggataatttttttcagatccaccctttcactgagagttaggccgtttgaggttcctgccttcatgtgaaggagtgaaagaggtgcatctcaattctctgtgttgtgtggtttccagacccttgtttcagttctccatgagggcctttaataagttttaattgctaattctttggatgtagaaataacccaacagccagacagggcacagtggcgcaagcctgtaatcccagcactttgggaagctgagttgggcagatcacttaagatcaggagttggagactggcctggccaatatgatgaaacccgatgtctaccaaaacatacaaaaattagcttggtgtgggggtgcacgcttgtaattccagcttcttggaaggctgaagtgggagaattgcttgaacctgggaggtggaggtcacagtgagccgagatcgcgccactgtgctccagcctgggcgtcacagagtgagactctgtctaaaaaaaaagaaggaaaaaaagaaagaacccaacagccagctttcttcaatgtcagtttatactgatgggctcatggatttcttttattatcttgataatctgcctgtgtgtttatagagatagctgttatgtattatccttcagttttcgggtattttgtgatcggagaatttccaggtaaccctgtcagccacattgctggaaatgcaagtcttcagattaaagattttttttttgaaaccaatgcttaaatacttggtggggaaagagaaataaaatcacctccctcttttttttttttgttgttgacgtttttctttttagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactggtatgtcagttattcagacacactttaatctcatttttctctagtttactctgtttttcctagctaaaaatcacataattgctgttgtatgctttgaatataatttgtattcatgttgtttaaaatgaatatgagaataaatattgtgccagtgcaatgttaagatggaaagtaaacaataataaagcatatgtaaagtatacaatagttagaagacttgaaactgtgtgtttgattaagactgtagcacttgtcattttgttaacttttgttatttaagatgctgccattaaaaataaacaaatatggctggatgtggtggctcacacctgtaatcctagcactttgggaggctgagatgggtagattgcttgagctcaggagttagagaccagcctgagcaactggcaaaaccctgtctctaccaaaaaaaaaaaaaaaaattaactgggcatggtggtgcatgcctgtggctttagctactctggaggctgaggtgggaggctcgcttgagcccaggaggtggaggttgcagtgagctgagaccgtgccaccatactccagcctgggtgacagagagagatcttttctcaaaaataaataaataaataaataaaataaatataaaaataaaccacaaaaatatatatttttttcttttcttttttttttgagacggagtatcgctcttgttgcccaggctggagtgcaatggtgctgtctccctcactgcaacctctgcctcctgggttcaagtgattctcctgcctcagcctcccaagtagctgggactacaggcgcctgccacctcgcccagctagttttgtatttttagtagagacggggtttctccgtgttggtcaggctggcctggaactcccgacttcaggtgatccacctgcctcagcctcccaaagtgcttggattacaggcatgagccaccgtgcccggcctatttctttaaacatgtaaacttctggagtggtatttgtatgagataaatacatgttattatattgtagatgtatacaacagatggtagcctctagctgagattccaaggagaatattctgttactgggaaagggtgattatatgtttatttagcaaacacaaagtgtttaccatgtgccaggcactctttaagcactttacaaatattagctcatttgttttcagaagtgccctgagatgggtactgttattatccctatttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctgttgcccaggctgtggtgcagtggtgcaatctcggctcactgcaacctccgcctcctgggttcagacgattctcctgcctcagcctccccagtagctgggactacaggctcctaccattacactggctaatttttgtatttttagtagagatggggttttgccaagttggccagactggtcttgaactcctgacctcaggtgagccacctgcctcggcctcccaaagtgctgggattacaggccttagccactgctcccggcccctcattcagtttaatcaacagatgaacagtgtcactgaagatccctcaaactcagtgatgaacacatctgaaaaagaaagaaaattaagttcaaagaagaaacttttcattgttgccgttgtccatgaatgtagtgatctaaaaattctctttatcattgtgctttaaatagtgatttagttttgatctttaaatgtcaatagacaataaatatttatagactatgtgaatattggaaagaaaatataaacagtcacttttacagttcgggtttttgtctaaaaattttgttgtaatttctcttcctaattttagatctgtttgagaagatggttcccgtgtcagtacagcagtctttggctgcctataatcagaggaaagccgatttggttaacagatcaattgctcagatgagagaagccaccactttggcaaatgggtaggtagagcttaattttagagcctaaagttttccgtttggttgttctttagtttatgaacattttagtttctgagcttagagctaaatgtcaagagtatataaaatagaaaatgtagacacacacttacaactatttttgttggacactgtatttatgaagctctagcaaatatagttggaagaaattatagaaacaaggtgaggatatgaggactaaaaatttgtattttaagaggtatttatttggaaatgagaagtagaaatgaactcagatacatggtacatttagtgttctgaaccaatttttgtttctgatggactgaatactaagaaaataattcattggtttaaaaaatttttaggtatattttacacacacaaaatacacctattctaagtgcacagttcaattattatatgtatatgtgtgtgtgtgtgtgtatgtgtatatatatatatttatgtatatatatatattttttgttttttgggacagggtcttattgtcaccaggctggagtgcagtggtgtaaacactaaacatggctcactgcagtctcaaccttctgggctcaggtgatcctcctgcctcagcctcctgtgtagctgaggccacaggtgcaagccaccacacctggctaattttttgatatttttatagagacaagatctcactttgttgcccaggctggtcttgaactcctgggctcaagcgatcctcctgccttgacctcccaaagtgctgggattacgggcatgagccaccatgcttggtcatttagttagttttgataaatgtatgtacccatgtaaccggcactatgattaagttagagaacattactgttaccctaaaaaaattctctcatgcccctttcccagtccttcttcttttagcccctggccgctattgatctgctccctgtcttaagtttagttttactttttatacaatttaaaacacgtgtaatcattctagcatatgcatatacagtacttacagtatgtacagtatatacttagaatgtgttttgctttttttcacttagctactgtttttgagattcatctatattatgtgtatcagtttcagtcttttctatggctgagcagtattccattttatggttatagggcagtattccattttatggttatacggcagtattccattttatggttatagagcagtttgttaactctttcacctgttaatgggcatttcagtttctgtgaacattcatgtataaatcttcgtgtggacatattttagttctcttgggtaaatacttaggagacaaattgttaggttgtgtggttagcatatttaattttatacaaaattgccaggttgttttccaaagtggttgttccattttatatcctatctgcactgtttgaaaatacaattgttctgcatcctcaccaatacttggtatgtcagtctttttagttttagctactttagtgtgtgtgtagcagaatctcactgtgatttagtttgcattctcctaattgctaatgatactgagcagcttttcatgtgcttactagccattcatatattttctgtaaagtgtctattgaaatctttttctcagtttttaaaagtgagtttttcttaatagttaaagacttctttacatattttggaggcaagtcctttgtcagatacatataattgagaatataggtgaccctgaacaacatggggttatggatgctgacccccctgcacagtcaaatctgcatataacttctgagtccccaaaacttaactactaatagcctgctgttgaccagaagccttaccgataaacagtcaattaacacatactttgtatatgtattatatagtatattcttataataaataagctagagaaaaaatactattaagaaaatcataaggaagagaaaatatatttactatgattaaatggaaatggatcatcataaaggtcttcatccttgtctatttcaagtttgagtaggctgaggaagaggcggaaggagggttggtcttgctgtcttacaggtggcagaggtgaaagaggtgaaagtccacaggtacacggactcatgtagttcaaatctgtgttgttcaagggccaactgtatttctcttgtagttggcttgccttttcatgtttttagttttgattaatgcatggattttaccatcatttttctctaacaagaaaggaatgtaagtttactctagcatatgataaacaggcagtctgagattttacagagcttattttctgaggagttcattgtattacatcatttcatttgcctttttgtcgttacatagtagatagggatatgtacctcccttcgccatcatgtaactgaaataactgaggaattgttattgtgctacaaaactgagaacagatgaagattctgtaatgaatacttagatcatctattttctgttgacattttgcctagatgatgtgaaattataactattgattctgttgaaagagagcaaaaaagaaaaaaataactattttgtgtattgtttctgacttgttagagatgctgtaacaatcaaaagtataaaagactgcttttttaggatagaatttttgacttttaattacttagactgaaagaagtttgaactgtaagccgacgatacctaatatattttaatgcggtcatagtttttcttattttttgacttttttttttttttcccccgagacggagtctcactctgtcgcccaggctggaatgcagtggtgagatcttggctcactgcaaccttcgcctcccggcttcaggtgattcttgtgcctcagcctcccaagtagctgggattataggtgctcaccactacgcctgactaatttttgtacttttagtagagatggggtttcaccatgttggccaggctggtctcgaattcctgacctcaggtgatccacccgtctgggcctcccaaagtgctgggattacaggtgtgagccactgcaccagcctattttttggcttttaattctgaattgtgggcttcattttttaatgattttggtttaattttatcaatcactgattttttttgtttttctgttaatctttgctttgctttttttttttttttttttttttgagacggagtttcgctgtgttgcccaggctggagtgcggtggcgcgatctcggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcgatctcctgacctcgtgatcctcccgcctcggcctcccaaagtgctgggattacacgcgtgagccaccgcgcccggcctttgctttgcttttaattgatagggcttatccagtttttctgggtgctaactccattgctgttgatttggttatagaatactaaattaaataaagtaagtattgatgaggagttaaattgttttagacttcagtataacatagtatctcattttttcagggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgaggtatgttttataagatttgcttttcaagtataaacactgtgatcccttgatgtccagcagggattgggactggagacttcctcatgctagtacagtgtagttagtattcatcactttggtgaatttactgtggcccagagccttctctttagcataagagaaattctggttgagtgagaatgggtttcattcttatcttaagggtaagtaagtacacactaatgaaactcaaatgaccactgtgtaaaactagtatactgtgagaaatcaactgtcatacaaactgttcagtctttgtaattattgatttattttatgcatagcatgtagcaagatttttctttttaatttaatttgtcttaacctggaaggttaaaccctttaatttatccctaatttcttaaaatatattaaatatatttgttttatattatttatcttataattccaatatctgtagtttttgtgggtttgagtctatgatttgtaatttttgctgattcttgcttatggtggcttgttttctcttgtgttcagtttttttgttactgttttttaaaactttaaaaaatagtttcagatttacagagtctttgcaaatttagtgtagaaagttcctgtatatttttcacctagcttccctgaaagttaaaatcttatgcggtcatggcacatttgttaaaactaggaaattgacattggtacagtattattactcagattttaccagttattccaccagtgttcctcattctgttccaagatccagtacagaatactgaattgcatttagtgttcagtgagttttgattgtgcattcatatttcctgtacttatttgtgggaattcattgagatctgggtttaaggtgaattctagaaagaatttgtgtttgcttctgccataaaaaggcattatatacctggtacctcctcaaacttaagaggttttttcctttcttttataatcttttaattatagtagtaatttatcttaagactttgtgtcacacagatagtgcggtttctagtcccaagttcaggcttttgatcaggaatctcagataatacttcttgttttttcttttttctttagagccaaggtccagacaggcatgttttcttttgtagggcagttttctgttttaaaaattcatccactgagaatcacctgtttggaagtataccagtttgagggtggagagtgcttttgatctgacctctcaccttttattgtccctacctatgtttcttgttgacttttcatgttctaaattcacaatccaagtcaatggtgaactacacagctggtgaactatggatggtgggccagtgctagcttgtggcctactttttttgtatggttcactagttaaggataatttttatcttttttagagcattgtcaaaaaagaagaattctatgtaccgtagactgtggcccacaaaacctaaaatatttactctgtggtgtttgacacaagtttgctattctttgtcctaagctatcagggattgtcatacattgttggtgctagcactgtgtctactggtagattagtatttccttgtgtttctggccccctactatcctgtcatcttatctgtgcattaaaaaggcatttaaaaatatattaaacataattttctgtttgttgtattggaatgaaagtctaaattttatattttttaatgtaattgatcagttttccccttttgtttatggcttctatttatttattttaatcttaaaactttctttaaattgatatatggatgtaaatagtctcttatttattcctccttttttttttttttactgagaaaggtgatagctaattcacccttaaatttataagactttttgttaaatgcattataacttagatgtctgcaagaaaaaagtcgatttatattctaacctagtattcccatctcaccaaattctcacttatattgtgtatgaacatttattaaatgtattaaagtttttataccagaaatgacatttcagggttctttttgcttccttttaaagtcattaaggttgttggatgaagaagaagcaaccgataatgatttaagagcaaaatttaaggaacgttggcaaaggacaccatccaatgaactgtataagcctttaagagcaggtaaaaatgtgtataaatgaccttcatttgaataaattcccaatttcgacccacgtttttgcttgattaaattaggctcagttgtaaattcatttttaccgaaactgtttttcctcagttttagtataaagattaaaaaagttcacaaaagtaatctgccaattgtcagaagtacagatttttaagaaaggtatgaagtgaaaagttaaaatgatcctccaactttcattttctgttccaaactctgtgcatattttattttatttattttttttgagacaaggtctcgctgtgtcactcaggctggagtgcagtggcaggatcacagctcgctgcagccccaacctccagggctcaggcaatccttctacctcaacctcctgagtagctgacactgtagacatgtgctaccatgcccggctgatttttgtattttttgcagagacgaggttttaccatgttgccctggcttgtcttgaactcctgggctcaagtgatccacctgcctccacttcccaaagtgatgagattacaggcttgaaccaccatgcctggcccctgtgcatattttaaaaacataaatgagagcatattacatttatggctttgtaatttttttcatttagtagtgaatcctgggtggtaaaaaaaaaaatgagctttaagttattttgaggccaaatttatgcttcttaagactttgattattaagattttgtgcttgctgagataaatgctatcttcatggtggctggagattagttttatttatctttgtaaaaagttcatatattattgagatttttctaaaaatcttttttttttttaagtcacattgctcttttgacagaggaatacttttaaaataaatggaccagtttttggagagaatgatttcttcttcattcatgagttataggaaaagattaatattaattaacttttatttggcagatagtaaccaccaaatgtattttaaggtatagctatgcttttgattttataagtgattttgtcatctttctaaaaacgagaacgcaaagactgtcaggagctgtttttattatgaagtgaattggggtctatagaaggggaggataagtaaagttggagactagaactcaacatataaccagccgataaacgttgctgttagaatcacttctgtgctctgcaaacttttattttctcccagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggtaagaaggacactttgatgtaggttgtcatctgcttaagaaaaccacattcaagccattttatataatgaactgccaatttcttattgtcaactttaaaaaaatgcagaaataaattggggttgttatatttaaagtagtatatagactgtgtaatagataattatactaatattaactgtcctgtaatagtaacttccatttattgaatgcccttttttgaactaaattttagatacttcataggtcaacagtatttaatttgggttttataaaagagagaagcttggaagtatagaaatttcctgaaatgaaaggactgggtatagccagatacacaaattctttatttcttacattattctatactcctttccaccttgtttcaccggaactacctttgaaaggaagattgacaaggtgtgcatgttaataaatggatagcaccatcatggtatttctactgatgacaggaaagagaaaattgaatagtagggcatctgatttggaaagtcctaaaagaagagaaagtgcaagtataatttaatgacctatcacagggagatagggtaagttagtaggaaaagatagaggtcccaaatctctgcacaggaaaacaagcgaaagggcaagaaatactgctgaaaacttcttgaaaaaagtgaatttcctgggatagtaagttttgaaaagtttgagttttgttccttatttgtctttccatagaagcattttatatatttcatgtatttattccaagacctactggatatctgctctgtgtaaggcactatggtaggtacattggaaaattaacatacaaattacacacaggctttaccctcaatttatgatccattgtggaatattagtcatgtacaaggatgactgtaatatagggaagaagtttaaaaatgtcacagggaaagtataggaagtatgttacgaggatttagatgaagtacttaaatttcagtaattttggagtagttctcttcagaggcttcttaagagattggcacattatgagaacagagtggataggcagaaaaagtaaacgtgtaggatcggagaagggctgagtagtggctgtgtctagagagttatccgaggtacagaggatctgcaaagacagcttttactcctgatttcttgtgacagaaggtttacagacatgttgagaatggctggaatctgtttgtttatttatttattcactaagtgtttgaaggcctactattccagaacagtgctgagcaccttggtccctaacataaagagacaaaaaactgctctgggttacctttagtgtagagtaaatgcacaggtactgggcacctctcaaagggaagagaaggctacatagttgaatgtgcattgaacctggatctaacgggggaacccaatggaacaaggaatgtgagttattgttttgaggacataggggagaaaaggaggtggtcagaagattaacttgtgaagaacaacgaacctgaagaagaaactgcagacccttcgaacagcaataaattttggtaccttttttattttagaaaaagatttctggttagtactttctttgtattctttttggtgtcttgtacatgactcagaattatgtggctttcgtcctttgattcttctgctttcagtagaaaagcaaaaatggtttgtgctaagcaaaatctgcattagtatgcactgatatattgctattttattcagttatatcagttttattaatccttacttgtgttacacaggagaaaggaacttttatagtcaatacgaagtaattttatggaagctagattttcttgacggggtaaccacaaaaatttcagtactctctgtatattcgtttgtcatgtgccttaatcaaataaggcaagcatcaggtttatcaaagctatttcagactggttataatagttgatgacggattttagccagaatttttatgataaaaactcagttttttgattgctgattagagtgatgcaaatgtacatgttttattaaaaagtccaagtttgatggtagggctgttttttcttttattgtgaagaagcctactgtctggttacttattttcagtctctttggacatctggttttagacattgagatactctgacaaattttgcagactagtggtaatttgtatttaaagatttttgtattaaatacctaggatcactgcttgtgattggttgcctatgatgtactgtggcctgaagtccagtctatggttggctggccaagccttggccctaatgtatatggggctgagtctagccagaggaaggaacatgtatttttttgcacaaggttgatgttcagttatactcaaagtgttacatctgctgggagtaatggagggggtacctttaaaaaaaaaaaccctttacctccttacaggtagagcataaagagaattgtttaaaactgtgtgccctcccagaggagtgccttttttggattcacagactagtggaggatctgcaaacacagcttttactcctgatttctcatgacagaaagtttatagacatattgacaatgactggaatctgtttgtttatttatttactcaccaagtgttttttgaaggcctactattccagaactgtgctgagtaccttggtccctaacataaagagacaaaaaactcctctaggttacctttagtgtagggtaaatgtatcaagtttctgcgttcgttgctgtagacatagttgcttatttgccttttctgaaaataaaatgacaaggttataaaagtaaaatagaagattttgttgagggcatttctttctttcttttttttttttgagacggagtcttgctctgtcacccaggctggagagcagtggcgcaatcttggctcactgcaacctctgcctcctgggttcaagcaattctcctgtctcagcctcccgagtagctgggactacaggcatgtgctactgtgcccagctaatttttgtatttttagtagagacggggtttcaccatgttggcctggatggtctcgatcgcttgaccttgtgatccacccaccttggcctcccaaagtgctgggattacaggcgtgagctaccgcgcccggcccattgagggcatttcttgtctcatattgtacttggtgctgttaaatgccacagaggattttaaatctaaaactggggtcaggaagctgtggcttgtgggccaaatccagcctgcctcttctctttgtatgttctgtgagctaagaatgagttttacatttttaaaatgtaaaactctactttctacttcattttttaaatggctgaaaaaaagtcaaaagaatgttttaatatgtgggcattatataaaattgagatttcagtgttaatacatttttgttgaaacatagctgcgctcattcatttacacattgtctttcacactacaaagcagagttaaaagagttgcaacagagactgtggcctactgaggcaaaaatatttcctgtttggtcctttaccaaaaaagtttttaagttcctgatctgaaagacaaagtattgacaacctaggtgatgccattcctgccattctgtttgacctcatctcctgttctgccttttgtttactatgcttcagccagagtggcgtttttttctttcctttgatcctgccaagcttgtgcctgccacaggacttttacatttgcgtttccttctgtgcagggctttcttcccatttccgtggctgttacctctttttcattagtcttagatgtcacctcttctccatctttgtcattgtctacccacattattctatttttgtgtatttgtttaatcctcccctttgcatatttatttaatcctctctggtccccaaatgaaggaaaagactgtttttgttagtagttgtgtccatagcatctagaatggtacccaaaacaaaagtatttgtttgaatgatcatcactggcagcctaacttaataaagggatacatttaattgcagttgaaaggtagctggagttgtgtataagaaataaatatgctaggattctaattatttatatactttgataacatgttaaacctcaaatttgaatttataagaaaatttaggcagtggttttcttattatcttggtcattcatttgtggaagcagtttaattcattttctacttcatttactctgttaaaatgaggccagtgccttataatctgaaatatgttaaactagtgtactgcatatgaatttttttaaaaagatgttcataatataagggatctctatctttgtgtggtagtccacaagttcgttcataaattcgttgtttgaaatggcatttttttttccccagaaagttagaattattgcatttttgaatatcacagaatttgttaactatttgaccctctctgtatcagtctggttggataccatggaagttgtggttagcttttcttcctaatctaagtaatatgattgaatacttaccctttgttagaagttatgttgagcactttatatagattatctcagtctgcacaacagtcctgaaataggtactattatgcccattttgcagttgtgaaaattgaattttcttagtagtaacctgtccttgattgcacagtaactaagtccattatggtctctaagggagtatagtcagagttgaagtgttttttattttctatgtaattacatttttttatgtaattacgtttcactttgttagacccatttgtttccatattcaagttttgaacttaatctcgttttttgagtgtgtaaaaaatgttcatgattcaaaaggtacatacagagaagcctcattccttttccctctacttctttcctgtatacttgctgtaagtaaccatattcgttagtttctggtttgtccttactgattttctttttgcaagaacaacaacaaacaacccccaccccaaattatgcatacatatgtatacatatatacatattatgtatatgtatatttattttctgattttccttctgtcttactcaaattgcagcatactgtatatgcttttgtatcctttttttctcatttaataatatgtcctggaagtcacttggaaggaaacttttattcacatcgtctgatatcaagttctgctaggtctttaaacagactttgtcatatccacccacgtatgattctttctcctcctccttccttttagagtttctgtggtttgatgctttctagactctaggaatcatatttctttctctttccacagccttctcccctgtaccctcttctttccctccctccctttctccttcccttcccccttccttcctctcttccgcccctccctcttctgttcctttcctttccttccattttaaaattaggatgtttaggagatatggatgtaaacaaggccaaaaaggaaattcacctacatttagcagaaacctcgagtctctggtcttcacaaagggatgttactttggacattcctatcaaggagctaactaagactgtggaagaaagagtagaataggaatttttagaaacaggcagttggtaggggaatccatgggaattggaattgctgctggtagtgagaaagacaggggtggagacagggctcgtgatgtcctcttcttcctttgtctttcccccagttttctttctatgagcatcattggggcaagcagaatagagagattgggttgatgttcttggtggtcttagcaaagtatgaagagatgagtgaaaggggcagcttgaaagtgctcattagaaggcacttgaacactatgaatatgaaggggtatttatgaatcaggtgggtataggtcagagagtgtcttgactgaatacaagagataaatctctgttttgtttttgtattttgttttgagacagggtttctctctgtcacccaggctggagtgcagtggcatgatcatggctcactgcagccttgacccactgggctgaagcaattctcctgcctcagcctttggagtagctgtgactgcaggtgcacaccattgcacccaactaatttttttttttcaatgtagaaatggggtctcactttgttgcctaggctgatctcgaactcctaggcttaggtgatcctcctgaagtgctgggattgcaggcatgaacctctacatctggcctaaaactcttaatggtatgaagagaggcacaagaaccctctttccttttcctctcccagtatataaaataaatgtggtatatacacttatatctgtatctttctctatttctttctccatctaccatgcttgcttcatagctgtctctatttctgtcttcacctctgtttctctatatctctctcagtctctctaggcaaaataggatatctacttacctagcaaaatcataccttcccctgcttcacagccatgattgggagggagtagaatgtagagtggctaagagattggttttggaactagtcagacttaggtctcaaatttcacctctgccccttagtagctgtataaccatgtcacttaatttttctgagactcgttatccctatctttggaatagaggtcataaatatatataccccatggggtattgtaaggaatatatgaaattatatttctgaagtgttttagcatggtgcctaacacataagagttcagtaaattgtagatgttggctattgttattaatgctgcttttgttttaatatgagtcaactgaaggtacagtgtctatctatataaacctgacgttcaatttatatttggctctctgagaaatcatctctctctcagcccgaatgaacctttatatattatttccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttattcatctctctgttcatattcatgaacagagaatgaacatgttcatgttcattcacctctctgctcatgttcatgagagaagttattttcttctacctctaacaaagagcaggttagttgtttttagaatatttctactaaacctataaaaagcaaataattagaatgttttaaaaatggttctaaatgtttaaaaaaaggtgatttttttttagatggagttttgctctgtcgcccaggctggagtgcagtggtgcagtcttggctcactgcaacctctgcctcccgggttcaagcagttcttctgcctcagcttcttaagtagctggcattacaggtgtgcaccaccacgcctggctaatttttgtatttttagtagagacagggtttcaccatgttggccaggctggtctcgaactcctgacctcaggtaattggaattataggggtgagccacccccccagcctaaaaaaagatgagtattctccatattagtcttaatgataaaaaaacctaacaaagattaatacaaaacagtctacagaccagtttcagttatgaatatggatgcagaagtcctaaataaagtatttgccagtaatagtcaccaggacgttaaaaaataattattgaccaaggggaggggggcatttattccagtttcagtattcagtattttcacatcaaaggaaagatcacaggtttgtcttaatagatgaggcagaagcatttgagaaaatgagtgttctgatactcagtaaaataagaatagatagaagatagatgcttccgtaacatgaaaatatatatatgtatgtgtgtgtatatatttctgcccaaaactcagtatagtgattaatggagaagcactataaacagttccctctgaagtcaagaacagacaacaaatgtcactgtcagcactatttttaaatactatactgcagtaccagccaagacaatcacatgagagagaaattaaaaaattggaaaggaagaagtaaaactagcactatttacagacattatgattgtacaactacttgaaaacccaagagaaccccaaaactctgcaaataataaaattattattactgaagttgttgatcataaaaataatttgtagaaatcagtggctttcatgtaaataaacctatagaggataagatgaagagacccacttacagtagcaacaaaaaggataaaatataaaatataagtttgtcatatatgagacctatgtgaagaaaacagtatttcaaaaagaaggcttgagcaagttaaaaaacatgttcttggacaggatgactcaacttcataaagatgtcaattctaagttaacttatgcatcaactgggcgtgatggcatgcacttctagtcccagctacttgggagattgaagtgggaggatggtttgagccctagagttctaggttgtagtgcgctatgattgtaccgtaaatagccactgtactccagtctgggcaacagtgagaccctatctctaataacaaacataaataaagaaataaacatatgcggccaggcgcggtggctcacgcctgaaatcccagcactttgggaggctgaggcgggcggatcacgaggtcaggagatcgagaccatcctggctaacacggtgaaaccccgtctctactaaaaatacaaaaaactagctgggcgtggtggcgggcgcctgtaatcccagctactcgagaggctgagacaggagaatggcgtgaacccgggaggcggagcttgcagtgagctgagattgcaccactgtactccagcctgggcaacagagtgagactctgtctcaaaaacaaaaacaaaacaaaacaaaagaaataaacatgcattcatatgcttttgatatgcaaacatgcttttgatatgcaaacatgcttttgattaaaaaaaatcagcagcttttcatttggaattagacaagttgatcctaaagttcaagtagaaaaagaaacaaggtcagccaggaaaacaataaaaagagtagtgaaggaatactagttctaccagatattaaggtatataataccatatttaattaaaacacagtggtactggtacatgattagacaaagacagaatagaaaatagaaatagattcaaatacatacgtgaatttagtgtaaaagatcttcagccaaccagaagaggtggacaactgcccagccatttagaaaataaaagttatctttataccagagtaagttctgagtggaccaaacttgaaatttgtaaatgaaatataaggtgtaaaatagaatggaggagaattccgtaataaagctgggatgagcaggatctaataactcctacttaaaatccagaagccattaaaaaaaaagaaaagaataagtttctcatagaaatatgataaacagagtcaggatatgacaaattgggaatccaatatttgaaacttattcacaggcaaaaggctaatttactttatttagaaaagaactcctagaagtgaacgagaagaaaacccaatagaaaactgaggagaagacgcaaacagaattttgcagacaaggaaatacaaatggctcttaaataaatgaaaaaaaatgaataccctcattcattataaaatacaaattaaaattagtctgaagtaatatttttcagattggcaagaatctgaaagtttgataatatgctttgttgtcacatgttggagaaatagatttcatacattgccgtgagaatacccaatggtgcaatccttgtgttgggcattttagctgtaaagaataataagactgcaaattcaaacatcctttaatccagccattctgtttttgggagtctattctgaggatatattagaatatgctagaaatgacatatttatgagcttattcatttctacattgcaaatagcagtaaaaaagtagaaacaaagtgaccagggctggtgaaataaagctatacttgtatagtgaaatgctgtgcagctattttaaaaatcagggtgttttcaatttactgatatggaaagatctccaagatagttatggtaaaaagacacagaacagtgtgtagagtatgttttgtgtaaaaaggaagaaaataacaaatatagaaattggcttgtttacgcacaaggaagctctggatattctaaggaagaaagattggaatatcgtcatttaaaatattttatatttcatatatctaatttaaaaatcaggtttgttgtaaacaagtatatattttatttacacttgtcaagtattttcagctcagtgattgaaaggtgaatgaaagatggaaaagtaggccatataataatattagcttttgaatatctgagagtttattttgttaaagtcgttgttaatactgaaggccaaaatcctttgaaatcttactggatataatgtataccggaaaagtatacataagtgtgtatcttgttgaatgttcacaaactgcgtacacccaggcaaccagcacttaaatcaatacacagaaaattctcagcaccctaaaagcattgttaatgcatccacccagtcagtcagtctttatctttcttttccagggcaaccgctatcctaacttgtaagaacatagattactttctcctgtttttgcattgtatataaatagaatcacatattatgtactcttccatgactggcttttattctacattatatttgtgagattcatcagtatagttgtgtgtatttgtagatcttttattctcatttctgcatatattttattatgtgaatgtacaagttatttattctactgttgaatattttgagtagttgccagttttgagcttttataaatagtgctggcatgaatgttgtaaatcactgctgtccagtattgctggtagcagtaaaaatatggaaacaagtcaaatgtctggttctggttaattaaataaaactacatctatatggtgaagtactatgcagtgacatatgcaattgaaaatgtaaaatttgtagtagccgtagttaaaaaaaaaaaaacaggtgaaattaatttcaatatttcatttaacccagtatgtccaaagtattattttaacatataatcaatgtaaaattacaaatgagagatattttactttttttcacactaagtcttagaaatctaatctgtatttttttttttttgtgagatggagtcttgctctgtcgctcaggctggagtgcagtggcacgatctcggctcactgcaacctccgcctcctgggttcaagcaattctctgcctcagcctcccgagtagctgggattacaagcgcccaccaccaagcccagctaatttttgtatttttagtagagacgggtttcaccatcttggccagactggtcttgaactcctgacctcctgatccacccgcctcggcctcccaaagtgctgggattacaggcgtgagccaccgagcccggcttaatatgtattttatacttacaacacatctcaattcagagtagccacatttcagatgtttgatagtcatgtgtggctaatggttactgtattagacagtacatgcttttggtgagcatgttatatgcagtgctgttgggtatatatcgaggtcaaaggatatgtgtgtatgctcagttgatattgtcaaatagttttccaacgtgattgtactaatttatattcctcctagcaatatatgagagtcctggttgctccacatttttgcccttagctattctgctgggtttgtagtattatctcattgtatgattttaatttttcattttcctgatgactaatatgtcctttttatatacttattagctggaggctttgctttttaatttctgttttcattgaaatctttcatcagaagtttaaagcgtttaagaagaatgaatattttactctgagctttactttcttttgactaatggtttgaatactactgtcaggttgttgggcatagtactagtggcattttattttatatctttttgctcttttacattattgattttatttaatagcattgatttatatcttttataagtggctaggaaattatcatttgctctataaatgtgttatttactgcaaccatccctagagtttatcaaaggaaaagaaaggtattgtgttaaagctttataatatacgtatatattttagatatttcaaaatctggccttttagaattttgatattgattaaaaacttatttattttataagcagttatttacttaagaagtagttttgttttttttttttgatgaatgtatactagttttctttatgtctggagtgactggggcccttcttgagagggaaggttggatgcggacagtgtggggctttgctgttaattgttaaatcagggcaaaaggtactgtctcagatgttttgggacatgtcatatttacttctttgtgtacgttaatcagtgcagtgaaaagatgattgacatcatgtattacatggagtgcattttaccttaggtattgtttagtgtgattttgggataaatttcaatttactgttagaggagacagaattttctaatatttaatactaaattgtaatagtattttcagcaatatatctttcatgagtttatcttagtgacaggtgatgtgttatcttttaatataaaatatttcaacgccacatttctttgaatatcttcaggaagtttttatctagaaatttgcataatggtttgcataaaaggttagccttttcacctgttttattttgtataaacactgatatagtgattaaaacattagctacataactatgagtcactgtagttttctgataacttttagatagatgatgttaggagttttttaaatccagggactaccttttattagagggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggattgttggatcatattgtagatctagttttagttttttgagggacctccatactgttttccatagtcactgtactaatttgaaatgtagtatattttaaaataccatcattgtttggaatccattttctatgtttcatgtatgaagaaaagaaaagctgatattttatgtgtgttaatttttttctatcatgttaatttttaacactctgtctttgataagggacttgcaacaaagcattgccagagaacctagtgctccttcaattcctacacctgcgtatcagtcctcaccagcaggaggacatgcaccaactcctccaactccagcgccaagaaccatgccggttagtaggcaaataaatattttaaacagaggttttacattaacgatgattacttgttctaacggataaaacatgatttacataggaaggatctagtggttaccacctgcatcaggtaaccaaccttctgatattttgcaatatgtagaacacagcatcattcaagaattcttgacaaaaaaatgcttaacctgaatgtaatcaagcccttaaactttctgtttatagcaaataaaacaaatgataaaataagaagttaaattatgctattaggaaacaattggacaaatctttcacatgggacatttatatgaaataactgagttgatcatttctaaaagtgaatgtcatagattttttaaaaaagaggcatattctagatgaaaagagatgaaagtttccttataatcaaatgcagtatatgaactttatttgcttttggtttataaaaatagctatatgagcttttttgtgttaattaggggaaaattgaatttggagtggatatttgatgacattggggaatagcattagttttttaaggatgaaaatggtattgtgattatgtaggagaatatccttatgagaacttgagtgctgaagtctttagggctagtgtcatgaaatttgcaacttactttcaaatgattctgcaaatatatatggatgtagttatagataaagcagaaatgacaaatgttaatagttgttgaatttcattggtagatgtgtgattattttatatactattttttacaaattttctggtgtgtgacatttttcatgtaaagtttggggactaggaggagatgatggtagtaaacagtacctgtgctgcttccttccacctcaaatgtccaaccactggaggaagcagtaaatgattaaatatgaggcaccaggaaaagagcagtggctatggagtttccacaggttggaaaattattcaactatgatatatttctatagtaataagccggtatttaagaatgggaattaaaaatatatttggttggattctagagtttctcatatgtccttattaattttaattaatagcaatttgagagaaatatgaaacattttatagtcaatgctgactttttcttatagcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtaaggctgcaacattgtgtatcccaagttggctaatgttgtttctaggctctggctaacctgttaaaaacagggtcatcccttctccaaatggaggtgtcatgaatgaataagctacactgtcagcttatccagaaatgaaaataatgttatggtcacttacatgaataggatagctatttcctaggcttttaaaatttatgtttttatattttacatattgggtttatattaaataatcttttctgtattatagagtttagtaggtgtttccttggactttaggtgataaacaggtaccttttctgagcgtagcatagcaaaactgataaggccttgtttacgtccctatacttagaatacttggcatttaataaacagttgaatagaaatttatctaattatgggttgcactttcttaaaggttaatctctgtggtaatttcttaattttaaaaatccaaacatttgactaccttttaagatgtgctctaaattttacttagtaagtacatgttgtctgccaaatattagaactttataagttgtaaatttatgtatatcacagtgaatattgaatattgtggaagaggaatgtatttagatgactagttttgccacgttaaaatgaagggtctccattttttttctttctttaatactcgaatatttaatcttattttcttcagtatttatttttggatagtattaaacacttggtactcttttgttttaattaataacaggataggaatgcttttctctgacaagtgccttgaaacagtttttttcactccactgttctttaatagactaaaaaatagaaatgactttcatgaaaaacgtagttctagaatgattattgttttattttttagtatttgatttaccaatcaagatttttctgttttcttctatcaggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattcttacttc

SEQ ID NO: 1443 - DNA, 71138 bp, Homo sapiens; identical to SEQ ID NO: 1442

SEQ ID NO: 1444 - DNA, 21140 bp, Homo sapiens
cagaaggcctcactcccagactccttgcggagctcgccgcctgattctaggctggtcactactccgagcctgtgacgtttgcggcagccaggccgtcgacgatgcccaggtattccctgaacccggcttgcgtgggaaaggctactgagagtattcctggagagaggaagcccaggcgggaccagctgttggaagattgtgggggtggctacttgccaccaggatatgcagggtcggggacctaggaatcagccttgagcataaagattctgccgcaaacaggaaagaaaagaaagttccctaggtagaaaagtgagagatttggaaagatcagcaactccacccattcaatgattgaataaaagtttcttgcaggccagagactacttccggagcaggacattcggcgatgagctagaccacaaagcctcctctccccaggggcctcccctcctggtgcgggggttcgcagtaataagcgaggggaaacttggaaggcactgtggaaagtataacatcacttttaaggggggaaacgggagagggtttgtaaactatattctagctgttcaattctatgatattcattttaattacctgttcacaagatattcctaaaccttttctcaacaatttatgcttaagcacgtcggggagaggggtcagggagtgcatcacagagcaggataaatctttttctctccttgggatagtgtggagaattgtcagctttccatcaagggataattggttagttataaagctatggttatacttcccgatttccgcaggtgtcgtggctgactgcagcacctccgtctttcctctctgctaggtatttggaaagcagatcctcatattttgaaagaatgttgtgtaaatgaagagcaaacagcccgaaactgagttctgaaggctcacctgtgaaataaatgcatgaattttagtgcaaacatttaaggactcctgttttgaccctttttcttattcctggttcttgaatagtataattacaagccctcaataatttttgtaattgtataggccatgccctaaactacatatatattttaacaattatgacaatcctataaagctgatactcttttttattggctttttagagatagagaaacaattgagcctggggaatagcacagaggattgcatatattaggtgctcaataaatatttgtttaattaataaaggaatgaaggatttaaagaggttaggtagttttcccaagttcacatacataggaagtagcagaatcaggctaggacctatcaggtcttgcccatggttagtttttagtttaatattccattttcacttaggctttaattaatatatatatgattttatcgtgtaaagttatatatctgtgtaaagaaatcaatgaaaggattgttttcaaaatgtttgtggttttagggtttttttttctttctttctttatggtttttttttggcggggggagacaaggtcttgctgtgtcacccaggctggagtgcagtgatgtcaacatgcttactgcagcctcgacctccagggctcaggcaatcctcctgcctcagcctccctagtagctgggaccacgagtgcatgtcaccacacccagctaatttcttttctttttctttttttattttcttttttttttttttagacagagtctcgctctgttgcccaggctggagtgcagtggcacgatcttggctcaatacaacatccacctcctgagttcaggtgattctcatgcctcagcctcctgagtagctggagttacagacacccgccaccacacctggccaattttttttttttttttttttttttttttttagtagagatggggttttaccatgttggccaggctggtcttgaactcctgacctcaagtgatccacccaccttggcctcctaaagtgctgggattacaggtgtgaaccaccactcccagcctcagccaattttttttgtttgttttcttttcttcttcttctttttttatactttaagttctaggatacatgtgcacaacgtgcaggtttgttacatatgtatacatgtgccatgttggtttgctgcacccattaattcatcatttacattaggtatttctcctaatgctatccctcccccatgctaatttattagtagtagtagtagtagtagcagtagtagagatgggatcttcctgtattgcctaggctgatctcaagtgatcctcctgcctcagcctcccatatacttttatattaaacaaaatttttttttacctaaaaacataatctaaaacacaaaaaagaaatgtttcagggaggaaagattatttgatacactggttttgtacttttcccatcttcctaggtgacttaaatgtttgtggttttcaagttgtacattcccaaagtcattgtacctccatatgtgtctgagaagctgacatacacagctatgaaccgtaggggaagacccaaatgtgacagcctcaaatcctggcaataaaggctctgcttatcaatttcagtattcttcagagaactagttcaaagcaacaaaagaaaaataaaatcatagaatgactaatcctcagatgttttaccagattattgttcctcagaaaataatgttcatttgtttcataaattatactgaaataaaatttctctgagcttgaaataaatatttgaaagaattctttttccctcaattttgttttttctgcctctcatgtagtgaaactctctgggaaattgcaaaagctgaagtggaaaaaaggggaattaatggaagtgaaggtgatggagctgaaattgcagaaaaatttgttttcttcattggcagtaaaaatggggtaatgctttctttttttcaattattgtgatgatttaacaaccattggtaaaatatctgttaatactttgattaaaatgtagatacttcaacactttaaccagatgaccaatctggtttagcatgaattaaaaagtgcttattattaatctaggaaaaactataatagtaaacaaaattttagaaaaatatatttaaactattttttatttcatgatttgaaaatattcaggtcttctaccacaattgagtgtaaaagctaggattcatgtaaatatctaagtcagtctctaaatcagtaagtcagtatcttaacaattttatattttagattgttactttacttttagaaatctcattaaaggaataattgaactgtgtcaatgatatttgttacagggttattaattattttgaaatatctggggaaaatatggcagcatttccagtggaccactgattggtaggaagggacccctccccacttgttgtaagtctctgttttacttggccaagcatacagaaaggcgtggaagtggccacacagtgtaggaacatatgcatcatatcttcatgcaactttgcctggcccacaaagttcctgccaggaaggcaaaatgactggtgacacaaaaaggtcaaggcttgccagatgcaagatgctgaaattcatgtagtgccatagctcatttctgtgtggggttcaaattcctgttcactttctgtgctccatgcttccacttaagcgcattgacaaatacgaagctttcagaaactacactctgcatcagcagggctacgtgttcactgggcaacgtcagcgcccaggcagcctgagcacccgtcttgtctccagatgagtcccagaaggccctctctgcacaaccggacaccctccattgggggttttatatacaacattaagattacatatattgggagaaatacctgtacaaccatgaaaaaggttttagtgatgtaagaatataatctgaattaaaaaagcaggacacaagtgtcatacatgacatgatcccaattatacaaatacgtaaataaaaaattctgataaaaattagaaatatggatagtaaaattctaatcacttaatgtttttattttgtttttaatttttttattttccagagttttcatattggcccactttttaaaattcaaacttaattctttaaaataaaattatcgtagagatcatttatattttaaaattttaacccaactatataagtatatattttataagcatgttatttctttttttgagacagggtctcgctctggttgcccaggctagagtgcagtggtgcgatctcagcaccctgcagccttgacttccctggctcgggtgattttacctcaagtagctgggattacaggcatgcgccaccacacccggctaattttttgtatttttaatagagatggggtttcactgcgttgcccaggctgacctcaaactcctggactcaagcaatccacccatctcagcctcctagaatgctgggattacaggcatgagtcaccgcccctggctacgcattatttcacgagtttactattatgatgcacgtgattttcatattaggcatagtacttaacagtttcctacattgtatcttactgccatgtaggtacatacatggatttaaataaatgagtaaataactagtactagtcttatggtacaaatacatttctattacagaaaacattctgtacacagaatattagatagaatggcttatactaatggtactgattactgactccatcatacaaatgcttacatacaaaatacccctaccagtatcctcttagcgctctctgtaacagttattcttgactcccttgtagtcatgataccctgttttgtcttgttttgttttgtttttttgttacttgtgaaaccacccctttttcttgatggcaatatgtggcatatacaaactgttttttgtttttagtaataaaagtaattttgtttctgatgatttgggaactcccttgatatctaaaacttttgagggtattattctttaaaaagtctgtgattctgctgagtgcagtagctcatgcttgtaatcccaggactttgggaggctgaggcagatggattgcttgagcccaggagttcgagaccaacctaggcaacgtggcaaaacccagtctccccccaaaaaaataaaacaattagccgggtgtggtggcactcacctgtatgtagtcccagctacgtggaagactgaggtgagaggatcacttgagcccagaaggttaaggctgccgtgagccatcgtgattgtgccactacactctagcctgggcaacagagggagaccttgtttcaaaaaagaaagaaaaaagtatctgattctgcttcatggagaacattattttggaagataaagagaagcgattaatgcttctattgttcaattaatagtaatcaccctttaccaaagaagcccactgccctgctgccttctctttctccttccaaccatctgttcatccattcggttgacattgatcgaacatcttttatatgctaagcatcctgctagacactgtggaaacaggaatgaaaggcattctccctgggaagcaacttgtgtatcaggacttgtacaccaacaatgacaataccatgagacaaatgctgtggtggaaaacagagagggcacttaactcaccccagaaagttgggagactaggaaagcctcctgaagagagtgatggctaaagcttgaaggtgagaagtaaggaaagagaagtaattcaggtgaagagtgtggagtattctaagatgatcaagaaaaatgtatgaaacagatattccaacaaatgggagaaagatcatactagaggaatgtaataggattttcagtcattgttgactgccattttgatgatggatgttagtttgatactaatctgcccagagtacatggtttttctccaccatcactcacttgcatgggtgcaggcatggaggaggaaggtgattacctggggcagtctttgctggttgggtacagtgcaaagtgagggagctcagggcatgaatggtatttaacagagatgattgtaatgataaactatgggctctgagatggaaaaggagaaaagtgaaggtaggaagaggctgatggagtaggagcgactgttagtggggggaagaggggtgtcaatggacatttgagacctttcactaaggtcaaagagttattactgtggggatgcctgaagaagtggttagagaatgtgttgtttgtacatgtgattttggaagcagtgcagtttccagtgaaactggaaagcttcaagatgtaaccttggaagtgaccatggcagaagcagagtgagggaaaaggcctccattgggaggcaaatgcactgagagctccggatgtcaggtggattgccaagacccatgtgggtgtgaagaagattcatgacagtagctgaaaaggtaagggagattgtgagccagaagagatgacaacaaccctggtggtaaactgatacgagcctctgaggttttttcaagaggagggaggtagagtagttgtttataggtggcactggggagcaaggaggaccctaatgtatgtagggtagtgagaataaatagcttcgtttaacaaggctgcagaggaaggggttcagggtaagtcatattttagttaaggccaacatgtggagagaatattctgaaaaggctgagatattggggagtttgccagtcatggagctgaagtcatagagtggaaggattttagaggaagggaagacagaaggggattattgggccagattaagggatgtttacagagttaggaaattcagagttccagggataatgggtcagaggagagggctggacatctggggcgattgaggcaatgggagggaagatgggattcattttgatggtctctaaatgaacttgtactaggtcaatgtttcttgaattaggaaacccacaagactacagccacatgctcaggggaccagagtgtactaatgaatttttaaattttggattgtaattttaatgataatctaaaacttgatttcagttcccagattagtttatgttaatttggaattgttaccatatagtgctatacatttatatgaaataataataaaagtgatttaaggccaggcgtggtggctcaagactgtaatcccagcactttggaaggctgaggtgggaagatcacttgaggccaggagttcaagaccagcctgaccaacatagtgaaaccccatctcaactaaaaaatacaaaaagttacctgcacgtggtggtgcatactggtaatcccagctactccggaggctgaggcctaagaatcacttgaacccagaggcagaggtttcatgagccaagatggtgccactgcactccagcctatgcaacagagggagactctgtctcaaaaaaaaaaacaaaaaaggcgagggggagtgatttaaatcaatgaatactagtgtaccatgaaaatttgaggaaattggctagatattatttaaaattccttccaattcttattctactttcttgcagagtacattactttttgggtaatgtagcccttattaatttagaacttttacagcatactacatatgatacaagttcattgtaggaaaattagaaaatcctgattttctttttctttttttttttttgagacagagtctcgctctgtcgcctaggttcgagtgcagtggtgtgatctcggctcactgcagcctctgcctcctgggttcacaccattctcctgcctcagcctcccaagttgctgggactgcaggtgcccacgaccacgcctggtaatttttttgtatttttagtagagttggggtttcgccatgttagccaggatggtcttgatatcctgacctcgtgatccacccgcctcggcctcccaaagtgctgggattacaggcgtgagccaccatgcctggcagaaaatcctgattttcttaaaaactttaattaccttcaaatccttcagctagaaataatcattattaacatagtgatgtccccctacatttgtgtgtttgtttctgtctatgtgtgtgtgtgtgtgtgtgtgtgtacttcaaggaagcaggaaaagtattttttaattgaaaacagagacatgctgatctattatgaatgttttactatgtcagtaagtatatttctacattgtcattcataatagctgtatattattctattatatggtttaccataattaatttagccagtaggggacatgtaggttgtttttagtttttcagtttgatgtaacactggccaataaacatccttcaataatatacatttttatattgtacaattccagttattttttaatatatctcattacaaaaaatttactcaatttgatcgtattccagatataatctggagtaattatcttttttgtcaaaaactataggtttttttagtaaaaacaaaaacacatataataagtgttctgtgtttttggcaatccagagttttccaaattattttctttagagcctgaaggtttcctccagtggagcttgtcctgctgtttctcttttatctgtttccttgcaaggggtcttttctttaaaaaaaaaaaaaaaaaaaggattttactattttttaaaaatgatataaaccactgagctaatccctggctaagctgtgaagttaagttgcctgactagtggtaggaattaggccagaacttgtatttccttactcctaaaaagaaacttggggttgggcatggtggctcacacctgtaatcccagcactttgagaggctgaggtgggcagattagatgaggccaggagttcaagaccagcctagccaacatggcaaaaccttgtttctactaaaaatacaaaaattacccaggcatggtggtgtgcacctgtaatcccagctacttgagagggtgaggcacgagaatcacttgagcccaggaggcagaggttgcagtgagccaagatcatgccactgcactccagccttggcaacagagtgagactctgtctcaaaaataaaataaaataaaataaaaataaacagaaacttggaataagtacatcctctggacttaaaacaaattactctaatgcagtatctgaattgcttactttgaacatatttacaatgtgtcctttatttgtatgttacctttttctttatttccacttcaacaattggaattaaaacattttaaaagacactaagcatcggcttaaccagtaattaacattgatgagtagagaaaaaatttaagacagctgccaagttgaccacttaagtgaggtatgatttgctagtatttgtcatctgtgggactttataattataataatagcagtgtagttacactgtgatggaaagttgacagttaactttttccacttatcaaactttagaacaattccgaaagtttctagtttttagtttccaggtaatttatcattcaattgattaaaaatctattttgggccacaattacgaacaataatacaatttttacatatgagtgacattaacgcagtgttccttcttttttaatttccagggaaagactactattattctaaggtgtcttgacaggtaagtgttatgttaacctttaaactatatttatgcttattctagttgtatagggcaagttagctctaaaagacataaggaaggggaacgattttgagacccaaacaaaatatttaattcttagcaaatccttagtataacctttaagagcgcctttaaatataaaactaacaataagccaaaaattatatgagactaatactggatttccctatttgagggagaaatgttaccataattacccaacctacaatagtatttaccttctttttggctatgctactctgatatttaaattatttttgttctacctaatctacaattatttgaacattcattgtaagctttagttgctcaggggtacatttttgaagcacagtgttggtcctcaaactggatattttatcatttattttatatatttcctaacgtatactgtagaagcaggccatcagattaagatttagcagtatgattggtagatgtttcaggaagctgatgaggaaagccttcagtcatttttggaagatatttctctgttcccttcatttgaatacatatatcttataacttctccaaaatcatcaaaagagatggaatttggtgttaaggtcacattaaagaaacatcactcatttgaaaaatatttttaaaggatacaaataataaattcctgcttttgtgtaattcctttcaccaacaatattgtttctcagaggaactatcaacagtaacacctgtattatctttccatatccaggaatcatgggtctttttagaccacatttagacgtttcctgtcataaacaaatcatctaatacaacaccagcttaggataaaatactacaaaatagtacattgagttgaaaagtattaatttctttctttcttttttttttttgagatggagtttcgctcttgttgcccaggctggagtgcaatggcgccatctcggctcactgcaacctccgcctcctgggttcaagcgattctcctgcctcagcctcccgctgggattacaggcatgtgccaccacgccgagctaattttgtatttttagtagagacagggtttctccatgttggtcaggctggtctcgaactcacgatgtcaggtgatccgcctgccacggcctcccaaagtactgggaatccaggtgtgagccaccacgcctggccctgaaaagtattaatttcaattcctcaatagtctacttaggaaaaggttaattttctaaaatataggttaaatatcagatcttatgaattttgtcttaaaagtggcatttggcttgataaaatttctatcttttgggacatataaccgaatattactctctatataacgtattcaaaagatgtatgcaggggtgatattcagaatattcaataaacataattatgtaagtcacaaatttaaaaatcatttctctttcttctccagtctaaggatagatatgggaccgggtgcagtggctcatgcctgtaatcctagcactttgggagggcaaggcaggcggatcgcttgaactcaggagttcaagaccagcttggccaacatagtgagaactcgtctgtaccaaaagatacaaaaattagctgggcatggtggtgcatacctgtagtcccagctactcaggaagctgaggtgggaggattacttgagcccgagaggttgaggctgcagtgagctgtgatcgcgccactgcattctagcctgcatgacagagtgagaccctgtctcaataaaataaaataggaaagtaaaataaagatatgtagcaacataatttggccttaaaaaggaaggaaattctgtcacatgctacaacatggatgaaccttgaggcattatgctaagttaaatgagccagaaacaaaaaaaacacaaatattggggtgggtgcagtggctcacacctgtaatcccagcactctgggaggccgaggcgggcatatcatttgaggtcaggagttcgagatcagcctggccaacatagtgaaacctcatctctactaaaaatacaaaaattggccaagcgtggtggcgggcccctgtaatcccaggtccttgggaggctgaggcatgggaatcacttgaacctgggaggcagaggttgcagtgacccaagattgtgccactgcaaaaaaaataaataaataaaataaaataaaatatatatagtatgattccacttatatgagatatctaaaataatcaaactcagaaacaaaaagtagaatggtagttaccaaggactagggggaagggaaaatgagaagttgtttaatgggtatggagtttcagttttgtgagatgaaaaagttctgaatattagttacataacaacgtgaataaatttaatactactgaattgtacacttaaaaataggtaagataaattctattttatgtgttctttaccataataaaaaattaaatatatatacaccataaaactgcttaccagcaatataagctatagtataaataattcagcaaattgttttaatattttcctaatcattactgattttaaggacttgttgatataatttattaactatcattatctaaatgatgcccatgtttgggctgtgatttaagataaagaactgctagagaactgcgttaaagtcttgcattgtttttgtttttttgtgagacagggtgcctctctgtcacccaggctggagtgcagtggcatgatctcggcttactgcagcctcaacttcccaggctcaagtgattctcccacctcagcctcctgagtagttgggactacagacatgtgctacctttttttttgtagagacagggttttgccatgttgcccaggccagtcttaaactcatggactcaagcaatttactcgcctcagcctcccaaagtgctaggattacaggcgtgagctaccatgcctggccaagtcttgcattgatgttttaaattgacagtcattaggttcctcacatcagggctgagtataaacccagtgtcactttgggaggccgaggcgggcggatcacgaggtcaggagatcgagaccatcctggtcaggagatctagaccatcctggctaacgtagtgaaaccctgtctttactaaaaatacaaaaaaaattagctgggcctggtggcgggtgcttgtagtcccagctactcgggaggctgaggcaggagaatggcgtgaacccaggaggcggagcttgcagtgagccaagatcgtgccactgcactccagcctgggcgacaaagcaagactccatctcaaaaaaacaaaaacaaaacaaaaaaaaacacccagtgtcagtgcttcctgcatggcctggatgtagagatcttgtgcccagcgtggccatccacgctgccagcctcaacacattctctactttgccccagcagtgcctttaggggctaccacatgcatgtgctgttaaaatccactaagacggtgttttgcaggtttatttcttttgtgaatataatttatttcaacgctattatacaaggtaacttctctactaataaagttttcaagaggaaggaaaaatgaatcaggtaaggtgatagcataagaaactaataccacctacaatgataatactatcggcctttattatacagagatgaaccaccaaaaccaaccttagctttggaatatacatatggaagaagagcaaaagggcacaacacagtaagtgtcttttaaagtgacattgctatgcccatagatgggaaagtaatgctgctgactttgttttacattttccatctcatctgtaatcaataaacatacccagttgtacacttcgtagctgtctaccattaaacttcaaatgcagtgtggcagatagaagccaacccaaactgtgaaaacattttagccttctcatttattatgtcttaaaatgctagaataagatacctttttaactttattgtacagttcatgagaatagtgttgtgagttattttctgtctctcaaaaaatctgctaaaatataggtttgacctgtggaatatttatgaaaatatactgtttaaaatctaaattattagcatttaaaaatgcatcttgaagttgatagtactagttgaggtcatatgccctgcttgattataatcctattttcacttgttttaatgtctctttagaggaacatgataaactcttcaggatagaagaagggttcatagtatatgctggcagggggtggggtggggaattcctaaatagaatctttttggagttgtcacctgaaaagagatcatttcttaaagttaagtgtgtagaaggacaatctagaatggagcatcccgctactctgctaacacaggcacatttttatacactgacttagtccaaatatttcctcattagacagtgtataaagagataaaactgcctattgttgcttccaggattcaccaatgaaagtgggttattaaaactgaaatttaaagaaaaaaacataatatatagagatacaggagaacttcatttttgtgagtcacttgaattttgacatgagtaataagcctagaaatgtaattatgcttttcattggaaactttgagacagctctcataagcttaacttttgagaagagctctaaaagcttccctttatcaaattgtgaatggagggagattttccagggaagaattgtttttcccacaaaaattaatgattcaaatatgaacagccaaacaattgtagagattacaggatgaaattttgtcaaaaatccaaaataatatatattcacctaaaacttattttattgacaatctgtctcttccaggctcatgggagcagatacgtaaaaacttgtgtaattttttttctaaactgtgtactatcaagtgggatatttccatattcattctggaagcatcatgtctttctcagatttaattccctaggagtcctaaatagaagcactttgtcagctcctcacaatttcagtgacctgaagtgtcttcagtgtcaggacagaagcagaaatgccattagccaacagtctaggaacgtcttatggaatcagtggtcctttttcttttcttttctttttctttcggagacaaggtctcactttgtttcccaggctggagtacagtggcaggatcatagctcatggcagcctcaaactcctgggctcaaagaatcctcccgcattagcctcccaagtaaactgtcaccacaaattcactacaagcatgtaccaccacactcagctaatttaaaaaaattgtttatagtgatggagtctcactgtgttggccagactgaccttgaactcctggcttcaagtgatcctccagccttggcctcccaaagtgctggggtttacaggtgtgaaccactgcacccaaccctagatgatcttatttctgaacttcttggctgcctagccctgtcagtttcctattattttgagggtcctatgaaaagagaagcagttgtttgaactcttgttcccccacctaccgtgtattattgtcagtggtagcctgtcagattctccacaggaatcaggaacaaatcgtctgcttatacttttgctcaagtaatcttgatccgcagccaggattgccatttgtttgtcccttttcttcatgctttacgtgtgtctaattcattctgcgagcttctgtcttcctaaataggaatgttttcctattcacctgttttatttctatctagaattataaatgttttccaaaagataatacgaaatttgttgaacgggttaatttttatctaaaatctgcataagtatatgctacatatgttatttacaagattgacgcactgttgatgtcttctgtttaggtattactagaattagggcatttgtgtacacatataaacaattctgaatagttcatcatttttctttagagtaggtgctttgatgcattttgagggatgggataaaggaaaaaattttgactgccaagaaagggttgattaaggactgcaatattttgtatgtataattattactgggaagtgctaatgacatataagaagtacttaaacttcaaaaaatcaaaaatttttgtttttcagccaaaagatatcgctcacttttgggaactcggtggaggaacctctttattggacttaatcagcatacccatcacaggtgacaccttacggtaagtgagccagctccaggaaaacctgtaagtacacaggagtgtccctaggaggaatatgagttggcttttctcagtcagaattttggggcacagttttatgttgctgaaggcttatgcccacttcctttctaaatgcctaacctgtaatgctttcaaagaagttttaaaagaaccaagattttggcccgtgctgaactgagatagctgacattccccccagtaacatattttgcaagctgaaaacaaacaaacaaaaatacatcaaattacacttgggcagtgaattcattttgtaaaaataaatttgaaaagcctaattctttctgttatccatctcagtatgagttaattcggctctgagttttttcttcagctgagtattataagctacctttgaatttagtgctaattaatattcttgaagcttcatttaaaggaagactatatgtcggagaagagagaaagtctctccgtttgctgaccttagagaaatagaacttagaggaaaacctcaaaacgcttgagtgatgttttcctgacagtaactcccacatgttggccaaatatgtggaaaattgtgacatttcttagtgttcctgggaactggtcttagctaagaaaaacaattttttttaatctgaaatattttgttcttagagtttaacataaaccattgctgctgcctggatcaaatacaaagggcttgacaattagttgttacatgttggtcattaagctccttggaggattgaattatttcttgttaatgggaccgttgtttttctagaactggctggatacggttggttttatttggtctttttttttttccttttagtgaaatatgatttactttctttcacttattagaaaagtaatatatgcgcttacagaaaacttgtaaaaatactgaaagacacaaagtaaaaggaaccagaatcacattaaaaaataaccactttaacatgttgaggtatttcagccttttcaatgtctgtaaatagacttcgtacaggtttgggatattttatatacatatttagatcttgcttttccacttttgaacacttttctctatgattttatttttcaggaacatggaattttacagttatatagtttttcatttgtctttctttaatggtgacaaataagtgaagctgcctgggaatagtgcctagtggtgtggttgagaagagatggtgaggggccaggtgcggtggctcaggcctgtaatctcagcactttgagaggccagagccagtggatcacttgaggtctggagttcaagaccagcctgggcaacatagtgagaccccatctctacaaaaaaattaaaaaataaaattagccaggcatcatagcaagcctctgtagtaccagctacacaggtggctgaggcaggaggattgcgtgagccagggagttcaaggctgcagtaagctatgatcataccactgtactccagcctgagtgacagagtgagacattgtctctttaaaaaagagagagagagagatagggtgggaggagcttccagttacagtggccagaggctgaaagggtgaaaatacaggaggtggctcttacctgggttgggagtcgcctcctattcaactgacttgttttattacctcactccccttcttgaagcccaaaaggttttggcctgctggggttgtggaaattctaggttctgcaggaagccagatcatcccaagggttaatacctcatttgtgaggtcttgggcttcctttccctggagccccatgacagctgggacctgctttaggagagaggaagggtcagggttatgatcaacagagggaaagggaaagggagccataggcttgggtctaaagtaggttgctgggtggttaaataattcatggaaaaacatttcattcaccatgtcaaaaacactcaaactgtttttgactggaattagtttgacacataatttccttgtgttggatgaagtctcacaacttgagaaaacaatattgccaaatactgttagatactgtttatctttgaaataactgtttatagaattataaatgcattgaacatttccacacactttagacaatttgtaatagaacatttcctgtagtctgaatctctgttttaggagtttatgtaaaaaaattttttggctatcatttgctatgaaataggtaaaaagtaacaaaagtatttctaatatactgtaaacaaaaattttaatcttagaaaaaatttgagtaatttatttttcttttgcttagaataatttttcatttgaaaaaataataaattttatgttatatccatttcatcacaatgaaaaaatgttaaatcatagttgaaacacaaccataccaaaaccctgaaaatgaaattagtacaattaaaaatgtatatactatttttacacttaagcaaaactgcttatgagcttattaaaatgacataaatataattgcctagacaatgtaatagcacaataatttttagaaaatttgataattaatgtgtaaaagactactttctgaatttagaccaacagaattgttactgttttgcttgaattatacaaaatagcctgtttacttgaactaaacaaaataattaaataacatattataattttgtgctatgtcttctagcagaatgtttgctgtgttgatcaaggatatattggttatattggatataatcctaaaccatcaaggattatggttctacatacttattataaccatttttaaaaatactcctagatttacaaatgtttagtttttattgtcgtaaaatatacatagcgtaaaattttagtcatttttaactgtgcagttcagtaacatcaagtatattctcatcaccatacatctccagaactttttgatcttctcaaactgaaactctttacctattaaacaataactccttgtttttccttccccagctcctggcaactatcatccctactgcctgtctctatgaatttgaccactccagtacctcatataaatgaaatcattcattatttgtccttttgttatttatttcatttagcataacgtcttcagggttcttccgtttgtagtatgtgtcaggatttccctcacttctaaggctaaataatgttccattgtgtaaacaaataccacagttcagttatccgttaatccatgcagaacatttgggttgttttcatcttttgactattgtgagtaatgctggtatgaacattggtgtacattatctgtttaaatctcttccttcagttcttttgggtttagactcagaagtggaattgctggatcatctggtaattctatggtgaattttttgaggaatcactatactattttacacagtggctgcaccattttacattcccataagcaatgtacaggggttctaatttctctgtatcctcactaatacttgttatcttctcatttaaaaaaatgttttaggccaggagtggtggcttacacctgtaatcccaacactttgggaggctgaggtgggtagatcacctgaggtcaggagttcgagaccagcctgggcaacatggtgaaacctcgtctctactaaaaatacaaaaattagccggatgtggtggtgcatgcctgtgatcccagctacttgggaggctgaggcaggagaatggcttgaacccgggaggcagaggttgcagtgagctgagatcatgccactgtactccagcctggacaatagagactcctcctccaaaaacaacaacaaaaaaatgttttgacaatagctagcctaatggataggaagttggacatcttttcatgtgttaattggccatctgtatatcttctttggcgaaatgtctatttgagtcttttgccttctttttttttttttttaatatagttgagttggggtctcactatgttgcccaggctggtcttgaactcctggcctcaagtgatcctcctgcctcagcttcccaaagctctagaattacagacatgagccaccatccctggcctctttgcccatttttgaacaggaatgtttgtttttgttgccgagtctaggtttatgtttgatgggcatgaacagaatacaagtgcatgtggtgatggtggtcatgtatctggtggtcaggagtgtgctttcagagagacagaatggtattgcagaaaaacgtgtaactttggatctaaataccagttctacaatttactaattatataaatctgtgcctcagacttctaatctataaaatggacattataacatcttctggagagggttattgtggagattaactaggtagttccctagcaaggtccacccatatatctattttcttctcctttacctgattattgtgttactgtttttgcttcttttattatttttgcttcccttttttggagcacacagtaaaactggatgtaaacgtggcattgtcgatgcaaatgcttggagcttctctatttgaactaaactacttttaattttagttcaaacagaaacttagttccactattgtaacacttaaatattactagaggaaagtattggaataaataaggctatgactttggttttttgtttttgggagtcttagaataatgctacggtttttttttccccttaaggtatattttagttattcttagataaatttcagtacattaggatttcaaaatggtaattattttgagtcttttttgaaaagtgtttttatttctttaggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaacttctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaa

SEQ ID NO: 1445 - DNA, 35973 bp, Homo sapiens
cagaaggcctcactcccagactccttgcggagctcgccgcctgattctaggctggtcactactccgagcctgtgacgtttgcggcagccaggccgtcgacgatgcccaggtattccctgaacccggcttgcgtgggaaaggctactgagagtattcctggagagaggaagcccaggcgggaccagctgttggaagattgtgggggtggctacttgccaccaggatatgcagggtcggggacctaggaatcagccttgagcataaagattctgccgcaaacaggaaagaaaagaaagttccctaggtagaaaagtgagagatttggaaagatcagcaactccacccattcaatgattgaataaaagtttcttgcaggccagagactacttccggagcaggacattcggcgatgagctagaccacaaagcctcctctccccaggggcctcccctcctggtgcgggggttcgcagtaataagcgaggggaaacttggaaggcactgtggaaagtataacatcacttttaaggggggaaacgggagagggtttgtaaactatattctagctgttcaattctatgatattcattttaattacctgttcacaagatattcctaaaccttttctcaacaatttatgcttaagcacgtcggggagaggggtcagggagtgcatcacagagcaggataaatctttttctctccttgggatagtgtggagaattgtcagctttccatcaagggataattggttagttataaagctatggttatacttcccgatttccgcaggtgtcgtggctgactgcagcacctccgtctttcctctctgctaggtatttggaaagcagatcctcatattttgaaagaatgttgtgtaaatgaagagcaaacagcccgaaactgagttctgaaggctcacctgtgaaataaatgcatgaattttagtgcaaacatttaaggactcctgttttgaccctttttcttattcctggttcttgaatagtataattacaagccctcaataatttttgtaattgtataggccatgccctaaactacatatatattttaacaattatgacaatcctataaagctgatactcttttttattggctttttagagatagagaaacaattgagcctggggaatagcacagaggattgcatatattaggtgctcaataaatatttgtttaattaataaaggaatgaaggatttaaagaggttaggtagttttcccaagttcacatacataggaagtagcagaatcaggctaggacctatcaggtcttgcccatggttagtttttagtttaatattccattttcacttaggctttaattaatatatatatgattttatcgtgtaaagttatatatctgtgtaaagaaatcaatgaaaggattgttttcaaaatgtttgtggttttagggtttttttttctttctttctttatggtttttttttggcggggggagacaaggtcttgctgtgtcacccaggctggagtgcagtgatgtcaacatgcttactgcagcctcgacctccagggctcaggcaatcctcctgcctcagcctccctagtagctgggaccacgagtgcatgtcaccacacccagctaatttcttttctttttctttttttattttcttttttttttttttagacagagtctcgctctgttgcccaggctggagtgcagtggcacgatcttggctcaatacaacatccacctcctgagttcaggtgattctcatgcctcagcctcctgagtagctggagttacagacacccgccaccacacctggccaattttttttttttttttttttttttttttttagtagagatggggttttaccatgttggccaggctggtcttgaactcctgacctcaagtgatccacccaccttggcctcctaaagtgctgggattacaggtgtgaaccaccactcccagcctcagccaattttttttgtttgttttcttttcttcttcttctttttttatactttaagttctaggatacatgtgcacaacgtgcaggtttgttacatatgtatacatgtgccatgttggtttgctgcacccattaattcatcatttacattaggtatttctcctaatgctatccctcccccatgctaatttattagtagtagtagtagtagtagcagtagtagagatgggatcttcctgtattgcctaggctgatctcaagtgatcctcctgcctcagcctcccatatacttttatattaaacaaaatttttttttacctaaaaacataatctaaaacacaaaaaagaaatgtttcagggaggaaagattatttgatacactggttttgtacttttcccatcttcctaggtgacttaaatgtttgtggttttcaagttgtacattcccaaagtcattgtacctccatatgtgtctgagaagctgacatacacagctatgaaccgtaggggaagacccaaatgtgacagcctcaaatcctggcaataaaggctctgcttatcaatttcagtattcttcagagaactagttcaaagcaacaaaagaaaaataaaatcatagaatgactaatcctcagatgttttaccagattattgttcctcagaaaataatgttcatttgtttcataaattatactgaaataaaatttctctgagcttgaaataaatatttgaaagaattctttttccctcaattttgttttttctgcctctcatgtagtgaaactctctgggaaattgcaaaagctgaagtggaaaaaaggggaattaatggaagtgaaggtgatggagctgaaattgcagaaaaatttgttttcttcattggcagtaaaaatggggtaatgctttctttttttcaattattgtgatgatttaacaaccattggtaaaatatctgttaatactttgattaaaatgtagatacttcaacactttaaccagatgaccaatctggtttagcatgaattaaaaagtgcttattattaatctaggaaaaactataatagtaaacaaaattttagaaaaatatatttaaactattttttatttcatgatttgaaaatattcaggtcttctaccacaattgagtgtaaaagctaggattcatgtaaatatctaagtcagtctctaaatcagtaagtcagtatcttaacaattttatattttagattgttactttacttttagaaatctcattaaaggaataattgaactgtgtcaatgatatttgttacagggttattaattattttgaaatatctggggaaaatatggcagcatttccagtggaccactgattggtaggaagggacccctccccacttgttgtaagtctctgttttacttggccaagcatacagaaaggcgtggaagtggccacacagtgtaggaacatatgcatcatatcttcatgcaactttgcctggcccacaaagttcctgccaggaaggcaaaatgactggtgacacaaaaaggtcaaggcttgccagatgcaagatgctgaaattcatgtagtgccatagctcatttctgtgtggggttcaaattcctgttcactttctgtgctccatgcttccacttaagcgcattgacaaatacgaagctttcagaaactacactctgcatcagcagggctacgtgttcactgggcaacgtcagcgcccaggcagcctgagcacccgtcttgtctccagatgagtcccagaaggccctctctgcacaaccggacaccctccattgggggttttatatacaacattaagattacatatattgggagaaatacctgtacaaccatgaaaaaggttttagtgatgtaagaatataatctgaattaaaaaagcaggacacaagtgtcatacatgacatgatcccaattatacaaatacgtaaataaaaaattctgataaaaattagaaatatggatagtaaaattctaatcacttaatgtttttattttgtttttaatttttttattttccagagttttcatattggcccactttttaaaattcaaacttaattctttaaaataaaattatcgtagagatcatttatattttaaaattttaacccaactatataagtatatattttataagcatgttatttctttttttgagacagggtctcgctctggttgcccaggctagagtgcagtggtgcgatctcagcaccctgcagccttgacttccctggctcgggtgattttacctcaagtagctgggattacaggcatgcgccaccacacccggctaattttttgtatttttaatagagatggggtttcactgcgttgcccaggctgacctcaaactcctggactcaagcaatccacccatctcagcctcctagaatgctgggattacaggcatgagtcaccgcccctggctacgcattatttcacgagtttactattatgatgcacgtgattttcatattaggcatagtacttaacagtttcctacattgtatcttactgccatgtaggtacatacatggatttaaataaatgagtaaataactagtactagtcttatggtacaaatacatttctattacagaaaacattctgtacacagaatattagatagaatggcttatactaatggtactgattactgactccatcatacaaatgcttacatacaaaatacccctaccagtatcctcttagcgctctctgtaacagttattcttgactcccttgtagtcatgataccctgttttgtcttgttttgttttgtttttttgttacttgtgaaaccacccctttttcttgatggcaatatgtggcatatacaaactgttttttgtttttagtaataaaagtaattttgtttctgatgatttgggaactcccttgatatctaaaacttttgagggtattattctttaaaaagtctgtgattctgctgagtgcagtagctcatgcttgtaatcccaggactttgggaggctgaggcagatggattgcttgagcccaggagttcgagaccaacctaggcaacgtggcaaaacccagtctccccccaaaaaaataaaacaattagccgggtgtggtggcactcacctgtatgtagtcccagctacgtggaagactgaggtgagaggatcacttgagcccagaaggttaaggctgccgtgagccatcgtgattgtgccactacactctagcctgggcaacagagggagaccttgtttcaaaaaagaaagaaaaaagtatctgattctgcttcatggagaacattattttggaagataaagagaagcgattaatgcttctattgttcaattaatagtaatcaccctttaccaaagaagcccactgccctgctgccttctctttctccttccaaccatctgttcatccattcggttgacattgatcgaacatcttttatatgctaagcatcctgctagacactgtggaaacaggaatgaaaggcattctccctgggaagcaacttgtgtatcaggacttgtacaccaacaatgacaataccatgagacaaatgctgtggtggaaaacagagagggcacttaactcaccccagaaagttgggagactaggaaagcctcctgaagagagtgatggctaaagcttgaaggtgagaagtaaggaaagagaagtaattcaggtgaagagtgtggagtattctaagatgatcaagaaaaatgtatgaaacagatattccaacaaatgggagaaagatcatactagaggaatgtaataggattttcagtcattgttgactgccattttgatgatggatgttagtttgatactaatctgcccagagtacatggtttttctccaccatcactcacttgcatgggtgcaggcatggaggaggaaggtgattacctggggcagtctttgctggttgggtacagtgcaaagtgagggagctcagggcatgaatggtatttaacagagatgattgtaatgataaactatgggctctgagatggaaaaggagaaaagtgaaggtaggaagaggctgatggagtaggagcgactgttagtggggggaagaggggtgtcaatggacatttgagacctttcactaaggtcaaagagttattactgtggggatgcctgaagaagtggttagagaatgtgttgtttgtacatgtgattttggaagcagtgcagtttccagtgaaactggaaagcttcaagatgtaaccttggaagtgaccatggcagaagcagagtgagggaaaaggcctccattgggaggcaaatgcactgagagctccggatgtcaggtggattgccaagacccatgtgggtgtgaagaagattcatgacagtagctgaaaaggtaagggagattgtgagccagaagagatgacaacaaccctggtggtaaactgatacgagcctctgaggttttttcaagaggagggaggtagagtagttgtttataggtggcactggggagcaaggaggaccctaatgtatgtagggtagtgagaataaatagcttcgtttaacaaggctgcagaggaaggggttcagggtaagtcatattttagttaaggccaacatgtggagagaatattctgaaaaggctgagatattggggagtttgccagtcatggagctgaagtcatagagtggaaggattttagaggaagggaagacagaaggggattattgggccagattaagggatgtttacagagttaggaaattcagagttccagggataatgggtcagaggagagggctggacatctggggcgattgaggcaatgggagggaagatgggattcattttgatggtctctaaatgaacttgtactaggtcaatgtttcttgaattaggaaacccacaagactacagccacatgctcaggggaccagagtgtactaatgaatttttaaattttggattgtaattttaatgataatctaaaacttgatttcagttcccagattagtttatgttaatttggaattgttaccatatagtgctatacatttatatgaaataataataaaagtgatttaaggccaggcgtggtggctcaagactgtaatcccagcactttggaaggctgaggtgggaagatcacttgaggccaggagttcaagaccagcctgaccaacatagtgaaaccccatctcaactaaaaaatacaaaaagttacctgcacgtggtggtgcatactggtaatcccagctactccggaggctgaggcctaagaatcacttgaacccagaggcagaggtttcatgagccaagatggtgccactgcactccagcctatgcaacagagggagactctgtctcaaaaaaaaaaacaaaaaaggcgagggggagtgatttaaatcaatgaatactagtgtaccatgaaaatttgaggaaattggctagatattatttaaaattccttccaattcttattctactttcttgcagagtacattactttttgggtaatgtagcccttattaatttagaacttttacagcatactacatatgatacaagttcattgtaggaaaattagaaaatcctgattttctttttctttttttttttttgagacagagtctcgctctgtcgcctaggttcgagtgcagtggtgtgatctcggctcactgcagcctctgcctcctgggttcacaccattctcctgcctcagcctcccaagttgctgggactgcaggtgcccacgaccacgcctggtaatttttttgtatttttagtagagttggggtttcgccatgttagccaggatggtcttgatatcctgacctcgtgatccacccgcctcggcctcccaaagtgctgggattacaggcgtgagccaccatgcctggcagaaaatcctgattttcttaaaaactttaattaccttcaaatccttcagctagaaataatcattattaacatagtgatgtccccctacatttgtgtgtttgtttctgtctatgtgtgtgtgtgtgtgtgtgtgtgtacttcaaggaagcaggaaaagtattttttaattgaaaacagagacatgctgatctattatgaatgttttactatgtcagtaagtatatttctacattgtcattcataatagctgtatattattctattatatggtttaccataattaatttagccagtaggggacatgtaggttgtttttagtttttcagtttgatgtaacactggccaataaacatccttcaataatatacatttttatattgtacaattccagttattttttaatatatctcattacaaaaaatttactcaatttgatcgtattccagatataatctggagtaattatcttttttgtcaaaaactataggtttttttagtaaaaacaaaaacacatataataagtgttctgtgtttttggcaatccagagttttccaaattattttctttagagcctgaaggtttcctccagtggagcttgtcctgctgtttctcttttatctgtttccttgcaaggggtcttttctttaaaaaaaaaaaaaaaaaaaggattttactattttttaaaaatgatataaaccactgagctaatccctggctaagctgtgaagttaagttgcctgactagtggtaggaattaggccagaacttgtatttccttactcctaaaaagaaacttggggttgggcatggtggctcacacctgtaatcccagcactttgagaggctgaggtgggcagattagatgaggccaggagttcaagaccagcctagccaacatggcaaaaccttgtttctactaaaaatacaaaaattacccaggcatggtggtgtgcacctgtaatcccagctacttgagagggtgaggcacgagaatcacttgagcccaggaggcagaggttgcagtgagccaagatcatgccactgcactccagccttggcaacagagtgagactctgtctcaaaaataaaataaaataaaataaaaataaacagaaacttggaataagtacatcctctggacttaaaacaaattactctaatgcagtatctgaattgcttactttgaacatatttacaatgtgtcctttatttgtatgttacctttttctttatttccacttcaacaattggaattaaaacattttaaaagacactaagcatcggcttaaccagtaattaacattgatgagtagagaaaaaatttaagacagctgccaagttgaccacttaagtgaggtatgatttgctagtatttgtcatctgtgggactttataattataataatagcagtgtagttacactgtgatggaaagttgacagttaactttttccacttatcaaactttagaacaattccgaaagtttctagtttttagtttccaggtaatttatcattcaattgattaaaaatctattttgggccacaattacgaacaataatacaatttttacatatgagtgacattaacgcagtgttccttcttttttaatttccagggaaagactactattattctaaggtgtcttgacaggtaagtgttatgttaacctttaaactatatttatgcttattctagttgtatagggcaagttagctctaaaagacataaggaaggggaacgattttgagacccaaacaaaatatttaattcttagcaaatccttagtataacctttaagagcgcctttaaatataaaactaacaataagccaaaaattatatgagactaatactggatttccctatttgagggagaaatgttaccataattacccaacctacaatagtatttaccttctttttggctatgctactctgatatttaaattatttttgttctacctaatctacaattatttgaacattcattgtaagctttagttgctcaggggtacatttttgaagcacagtgttggtcctcaaactggatattttatcatttattttatatatttcctaacgtatactgtagaagcaggccatcagattaagatttagcagtatgattggtagatgtttcaggaagctgatgaggaaagccttcagtcatttttggaagatatttctctgttcccttcatttgaatacatatatcttataacttctccaaaatcatcaaaagagatggaatttggtgttaaggtcacattaaagaaacatcactcatttgaaaaatatttttaaaggatacaaataataaattcctgcttttgtgtaattcctttcaccaacaatattgtttctcagaggaactatcaacagtaacacctgtattatctttccatatccaggaatcatgggtctttttagaccacatttagacgtttcctgtcataaacaaatcatctaatacaacaccagcttaggataaaatactacaaaatagtacattgagttgaaaagtattaatttctttctttcttttttttttttgagatggagtttcgctcttgttgcccaggctggagtgcaatggcgccatctcggctcactgcaacctccgcctcctgggttcaagcgattctcctgcctcagcctcccgctgggattacaggcatgtgccaccacgccgagctaattttgtatttttagtagagacagggtttctccatgttggtcaggctggtctcgaactcacgatgtcaggtgatccgcctgccacggcctcccaaagtactgggaatccaggtgtgagccaccacgcctggccctgaaaagtattaatttcaattcctcaatagtctacttaggaaaaggttaattttctaaaatataggttaaatatcagatcttatgaattttgtcttaaaagtggcatttggcttgataaaatttctatcttttgggacatataaccgaatattactctctatataacgtattcaaaagatgtatgcaggggtgatattcagaatattcaataaacataattatgtaagtcacaaatttaaaaatcatttctctttcttctccagtctaaggatagatatgggaccgggtgcagtggctcatgcctgtaatcctagcactttgggagggcaaggcaggcggatcgcttgaactcaggagttcaagaccagcttggccaacatagtgagaactcgtctgtaccaaaagatacaaaaattagctgggcatggtggtgcatacctgtagtcccagctactcaggaagctgaggtgggaggattacttgagcccgagaggttgaggctgcagtgagctgtgatcgcgccactgcattctagcctgcatgacagagtgagaccctgtctcaataaaataaaataggaaagtaaaataaagatatgtagcaacataatttggccttaaaaaggaaggaaattctgtcacatgctacaacatggatgaaccttgaggcattatgctaagttaaatgagccagaaacaaaaaaaacacaaatattggggtgggtgcagtggctcacacctgtaatcccagcactctgggaggccgaggcgggcatatcatttgaggtcaggagttcgagatcagcctggccaacatagtgaaacctcatctctactaaaaatacaaaaattggccaagcgtggtggcgggcccctgtaatcccaggtccttgggaggctgaggcatgggaatcacttgaacctgggaggcagaggttgcagtgacccaagattgtgccactgcaaaaaaaataaataaataaaataaaataaaatatatatagtatgattccacttatatgagatatctaaaataatcaaactcagaaacaaaaagtagaatggtagttaccaaggactagggggaagggaaaatgagaagttgtttaatgggtatggagtttcagttttgtgagatgaaaaagttctgaatattagttacataacaacgtgaataaatttaatactactgaattgtacacttaaaaataggtaagataaattctattttatgtgttctttaccataataaaaaattaaatatatatacaccataaaactgcttaccagcaatataagctatagtataaataattcagcaaattgttttaatattttcctaatcattactgattttaaggacttgttgatataatttattaactatcattatctaaatgatgcccatgtttgggctgtgatttaagataaagaactgctagagaactgcgttaaagtcttgcattgtttttgtttttttgtgagacagggtgcctctctgtcacccaggctggagtgcagtggcatgatctcggcttactgcagcctcaacttcccaggctcaagtgattctcccacctcagcctcctgagtagttgggactacagacatgtgctacctttttttttgtagagacagggttttgccatgttgcccaggccagtcttaaactcatggactcaagcaatttactcgcctcagcctcccaaagtgctaggattacaggcgtgagctaccatgcctggccaagtcttgcattgatgttttaaattgacagtcattaggttcctcacatcagggctgagtataaacccagtgtcactttgggaggccgaggcgggcggatcacgaggtcaggagatcgagaccatcctggtcaggagatctagaccatcctggctaacgtagtgaaaccctgtctttactaaaaatacaaaaaaaattagctgggcctggtggcgggtgcttgtagtcccagctactcgggaggctgaggcaggagaatggcgtgaacccaggaggcggagcttgcagtgagccaagatcgtgccactgcactccagcctgggcgacaaagcaagactccatctcaaaaaaacaaaaacaaaacaaaaaaaaacacccagtgtcagtgcttcctgcatggcctggatgtagagatcttgtgcccagcgtggccatccacgctgccagcctcaacacattctctactttgccccagcagtgcctttaggggctaccacatgcatgtgctgttaaaatccactaagacggtgttttgcaggtttatttcttttgtgaatataatttatttcaacgctattatacaaggtaacttctctactaataaagttttcaagaggaaggaaaaatgaatcaggtaaggtgatagcataagaaactaataccacctacaatgataatactatcggcctttattatacagagatgaaccaccaaaaccaaccttagctttggaatatacatatggaagaagagcaaaagggcacaacacagtaagtgtcttttaaagtgacattgctatgcccatagatgggaaagtaatgctgctgactttgttttacattttccatctcatctgtaatcaataaacatacccagttgtacacttcgtagctgtctaccattaaacttcaaatgcagtgtggcagatagaagccaacccaaactgtgaaaacattttagccttctcatttattatgtcttaaaatgctagaataagatacctttttaactttattgtacagttcatgagaatagtgttgtgagttattttctgtctctcaaaaaatctgctaaaatataggtttgacctgtggaatatttatgaaaatatactgtttaaaatctaaattattagcatttaaaaatgcatcttgaagttgatagtactagttgaggtcatatgccctgcttgattataatcctattttcacttgttttaatgtctctttagaggaacatgataaactcttcaggatagaagaagggttcatagtatatgctggcagggggtggggtggggaattcctaaatagaatctttttggagttgtcacctgaaaagagatcatttcttaaagttaagtgtgtagaaggacaatctagaatggagcatcccgctactctgctaacacaggcacatttttatacactgacttagtccaaatatttcctcattagacagtgtataaagagataaaactgcctattgttgcttccaggattcaccaatgaaagtgggttattaaaactgaaatttaaagaaaaaaacataatatatagagatacaggagaacttcatttttgtgagtcacttgaattttgacatgagtaataagcctagaaatgtaattatgcttttcattggaaactttgagacagctctcataagcttaacttttgagaagagctctaaaagcttccctttatcaaattgtgaatggagggagattttccagggaagaattgtttttcccacaaaaattaatgattcaaatatgaacagccaaacaattgtagagattacaggatgaaattttgtcaaaaatccaaaataatatatattcacctaaaacttattttattgacaatctgtctcttccaggctcatgggagcagatacgtaaaaacttgtgtaattttttttctaaactgtgtactatcaagtgggatatttccatattcattctggaagcatcatgtctttctcagatttaattccctaggagtcctaaatagaagcactttgtcagctcctcacaatttcagtgacctgaagtgtcttcagtgtcaggacagaagcagaaatgccattagccaacagtctaggaacgtcttatggaatcagtggtcctttttcttttcttttctttttctttcggagacaaggtctcactttgtttcccaggctggagtacagtggcaggatcatagctcatggcagcctcaaactcctgggctcaaagaatcctcccgcattagcctcccaagtaaactgtcaccacaaattcactacaagcatgtaccaccacactcagctaatttaaaaaaattgtttatagtgatggagtctcactgtgttggccagactgaccttgaactcctggcttcaagtgatcctccagccttggcctcccaaagtgctggggtttacaggtgtgaaccactgcacccaaccctagatgatcttatttctgaacttcttggctgcctagccctgtcagtttcctattattttgagggtcctatgaaaagagaagcagttgtttgaactcttgttcccccacctaccgtgtattattgtcagtggtagcctgtcagattctccacaggaatcaggaacaaatcgtctgcttatacttttgctcaagtaatcttgatccgcagccaggattgccatttgtttgtcccttttcttcatgctttacgtgtgtctaattcattctgcgagcttctgtcttcctaaataggaatgttttcctattcacctgttttatttctatctagaattataaatgttttccaaaagataatacgaaatttgttgaacgggttaatttttatctaaaatctgcataagtatatgctacatatgttatttacaagattgacgcactgttgatgtcttctgtttaggtattactagaattagggcatttgtgtacacatataaacaattctgaatagttcatcatttttctttagagtaggtgctttgatgcattttgagggatgggataaaggaaaaaattttgactgccaagaaagggttgattaaggactgcaatattttgtatgtataattattactgggaagtgctaatgacatataagaagtacttaaacttcaaaaaatcaaaaatttttgtttttcagccaaaagatatcgctcacttttgggaactcggtggaggaacctctttattggacttaatcagcatacccatcacaggtgacaccttacggtaagtgagccagctccaggaaaacctgtaagtacacaggagtgtccctaggaggaatatgagttggcttttctcagtcagaattttggggcacagttttatgttgctgaaggcttatgcccacttcctttctaaatgcctaacctgtaatgctttcaaagaagttttaaaagaaccaagattttggcccgtgctgaactgagatagctgacattccccccagtaacatattttgcaagctgaaaacaaacaaacaaaaatacatcaaattacacttgggcagtgaattcattttgtaaaaataaatttgaaaagcctaattctttctgttatccatctcagtatgagttaattcggctctgagttttttcttcagctgagtattataagctacctttgaatttagtgctaattaatattcttgaagcttcatttaaaggaagactatatgtcggagaagagagaaagtctctccgtttgctgaccttagagaaatagaacttagaggaaaacctcaaaacgcttgagtgatgttttcctgacagtaactcccacatgttggccaaatatgtggaaaattgtgacatttcttagtgttcctgggaactggtcttagctaagaaaaacaattttttttaatctgaaatattttgttcttagagtttaacataaaccattgctgctgcctggatcaaatacaaagggcttgacaattagttgttacatgttggtcattaagctccttggaggattgaattatttcttgttaatgggaccgttgtttttctagaactggctggatacggttggttttatttggtctttttttttttccttttagtgaaatatgatttactttctttcacttattagaaaagtaatatatgcgcttacagaaaacttgtaaaaatactgaaagacacaaagtaaaaggaaccagaatcacattaaaaaataaccactttaacatgttgaggtatttcagccttttcaatgtctgtaaatagacttcgtacaggtttgggatattttatatacatatttagatcttgcttttccacttttgaacacttttctctatgattttatttttcaggaacatggaattttacagttatatagtttttcatttgtctttctttaatggtgacaaataagtgaagctgcctgggaatagtgcctagtggtgtggttgagaagagatggtgaggggccaggtgcggtggctcaggcctgtaatctcagcactttgagaggccagagccagtggatcacttgaggtctggagttcaagaccagcctgggcaacatagtgagaccccatctctacaaaaaaattaaaaaataaaattagccaggcatcatagcaagcctctgtagtaccagctacacaggtggctgaggcaggaggattgcgtgagccagggagttcaaggctgcagtaagctatgatcataccactgtactccagcctgagtgacagagtgagacattgtctctttaaaaaagagagagagagagatagggtgggaggagcttccagttacagtggccagaggctgaaagggtgaaaatacaggaggtggctcttacctgggttgggagtcgcctcctattcaactgacttgttttattacctcactccccttcttgaagcccaaaaggttttggcctgctggggttgtggaaattctaggttctgcaggaagccagatcatcccaagggttaatacctcatttgtgaggtcttgggcttcctttccctggagccccatgacagctgggacctgctttaggagagaggaagggtcagggttatgatcaacagagggaaagggaaagggagccataggcttgggtctaaagtaggttgctgggtggttaaataattcatggaaaaacatttcattcaccatgtcaaaaacactcaaactgtttttgactggaattagtttgacacataatttccttgtgttggatgaagtctcacaacttgagaaaacaatattgccaaatactgttagatactgtttatctttgaaataactgtttatagaattataaatgcattgaacatttccacacactttagacaatttgtaatagaacatttcctgtagtctgaatctctgttttaggagtttatgtaaaaaaattttttggctatcatttgctatgaaataggtaaaaagtaacaaaagtatttctaatatactgtaaacaaaaattttaatcttagaaaaaatttgagtaatttatttttcttttgcttagaataatttttcatttgaaaaaataataaattttatgttatatccatttcatcacaatgaaaaaatgttaaatcatagttgaaacacaaccataccaaaaccctgaaaatgaaattagtacaattaaaaatgtatatactatttttacacttaagcaaaactgcttatgagcttattaaaatgacataaatataattgcctagacaatgtaatagcacaataatttttagaaaatttgataattaatgtgtaaaagactactttctgaatttagaccaacagaattgttactgttttgcttgaattatacaaaatagcctgtttacttgaactaaacaaaataattaaataacatattataattttgtgctatgtcttctagcagaatgtttgctgtgttgatcaaggatatattggttatattggatataatcctaaaccatcaaggattatggttctacatacttattataaccatttttaaaaatactcctagatttacaaatgtttagtttttattgtcgtaaaatatacatagcgtaaaattttagtcatttttaactgtgcagttcagtaacatcaagtatattctcatcaccatacatctccagaactttttgatcttctcaaactgaaactctttacctattaaacaataactccttgtttttccttccccagctcctggcaactatcatccctactgcctgtctctatgaatttgaccactccagtacctcatataaatgaaatcattcattatttgtccttttgttatttatttcatttagcataacgtcttcagggttcttccgtttgtagtatgtgtcaggatttccctcacttctaaggctaaataatgttccattgtgtaaacaaataccacagttcagttatccgttaatccatgcagaacatttgggttgttttcatcttttgactattgtgagtaatgctggtatgaacattggtgtacattatctgtttaaatctcttccttcagttcttttgggtttagactcagaagtggaattgctggatcatctggtaattctatggtgaattttttgaggaatcactatactattttacacagtggctgcaccattttacattcccataagcaatgtacaggggttctaatttctctgtatcctcactaatacttgttatcttctcatttaaaaaaatgttttaggccaggagtggtggcttacacctgtaatcccaacactttgggaggctgaggtgggtagatcacctgaggtcaggagttcgagaccagcctgggcaacatggtgaaacctcgtctctactaaaaatacaaaaattagccggatgtggtggtgcatgcctgtgatcccagctacttgggaggctgaggcaggagaatggcttgaacccgggaggcagaggttgcagtgagctgagatcatgccactgtactccagcctggacaatagagactcctcctccaaaaacaacaacaaaaaaatgttttgacaatagctagcctaatggataggaagttggacatcttttcatgtgttaattggccatctgtatatcttctttggcgaaatgtctatttgagtcttttgccttctttttttttttttttaatatagttgagttggggtctcactatgttgcccaggctggtcttgaactcctggcctcaagtgatcctcctgcctcagcttcccaaagctctagaattacagacatgagccaccatccctggcctctttgcccatttttgaacaggaatgtttgtttttgttgccgagtctaggtttatgtttgatgggcatgaacagaatacaagtgcatgtggtgatggtggtcatgtatctggtggtcaggagtgtgctttcagagagacagaatggtattgcagaaaaacgtgtaactttggatctaaataccagttctacaatttactaattatataaatctgtgcctcagacttctaatctataaaatggacattataacatcttctggagagggttattgtggagattaactaggtagttccctagcaaggtccacccatatatctattttcttctcctttacctgattattgtgttactgtttttgcttcttttattatttttgcttcccttttttggagcacacagtaaaactggatgtaaacgtggcattgtcgatgcaaatgcttggagcttctctatttgaactaaactacttttaattttagttcaaacagaaacttagttccactattgtaacacttaaatattactagaggaaagtattggaataaataaggctatgactttggttttttgtttttgggagtcttagaataatgctacggtttttttttccccttaaggtatattttagttattcttagataaatttcagtacattaggatttcaaaatggtaattattttgagtcttttttgaaaagtgtttttatttctttaggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaacttctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaaaactgagagcagcattttatattatccagagtttataagaaagtgtagcagggtgcgatggctcatgcttgtaatcccagcactttgggtggccgaggcgggcggatcacgacgtcaagagatcaagaccatcctggccgacatggtgaaaccccgtctctacttaagatactaaaattagctgggtgtggtggtacatgcctgtagtcccagctacttgggaggctgaggcaggagaatcgcttgaacctgggaagtggaggttgcagtgagccgagatcgcgccactacactccagcctgactccagagggagactctgcctcaaaagaaaaaaaaagagaggaagtgtttttcataggaaataatggaacaaaacaaatctatgctggataaatgctgttccaacagtcaacataaaatagaataaaaaaaaaccaggaaggtaatatgttatataaggaaataaaagggtagaaaaaggaaaataataaatatcatagtaatttagggaattgccatttctagttttacacttatgaaatatagcttaggaagtgaaagttaaatattagaacaaattctatgtcaagcaaattaagtaaacatctatgaagagactgaaaatggaatgtttttggaagtaaatagaaattgctaagcacctagcaataaagaattacaacaactcaaggaaatatgtttattagcaggatcatgaattaattgacccatttccggtacctctggtcataattggaagtaaatatgatgtttttcaggtaagctcttccgcttctagctgagtttgttgtacatatatggctgtgctttttatgagggaggtacaaaaataatatcaaaataagaaaaataattattgaaggaatcggttaagtcatgcatcttaaagattttggaaaagacatagttgggacagaaaaaaataggtaaagaaaataaatgcagtgattagaatggggataaggcagatttagaaaatgaatcttgccgggcacagtggcttatgccagtagtcccagcactttgggaggctgaagggggaggatcaattgagcccaggaatttgaggttacagtgagctgtaatcacaccactatactccagcctgggttacacagtgagacacttgtctcaaaaaaaaaaaaaaaagtcttcaacccagtcactggggaatatgacttacttcccaacttttaaatggaagaaagtagaaaattagttccttcttatctttgcttgtcagagaatcgttagaattccacactatgaaatgtgtgcttatatctaaattctattgagctaagtatttaaacaaagaaagatctgttagctgtagttctaagaaggctgcagctattgttcaactctctatgaaataaatatcaaggtaatggaatcctattcctgaaagtgagtttaaaaaaataagaaataatctattctacatttaataatttgaatcttcctgctatagatatttggttatcttgactttttaaaataacatatttctacaggattttgagtctgagaagagaaaggtaatatgcaagacacttcgatttgttgcacattattatggagcatcattaatggtttgtacatttcttgtcctttgggcttgaatggacagtaccaaatttggggaaatcagcaacttgatgcacagctacgaggaataaatgcttttgctaatgcacatggtcccgttgctttcccactgctgaagacctctccttacagagtgtttgataatgcatctgttgaacatgcactgctagatggtctcccccttctttggaacaaaagttctaaattgcttatatccataaatcccaaccaagtttaaagagataagttgatgatctatttattcatttttggtatccccttaagaattagaatctatattcccctaaaagaaaaacaaaaatcaactctatcagtgtgtgtattggggatgggggctctttaaaaaagtgctgtttgttgtaaaagttaaaaacatgaaatctgaagtcatgctccctgggttcgaatctcagagtgaccatttattagacgtgtgatcttcggcaagtcacttaatttcacttaagcctcattgtcctccagggtaaaatggagaaaaacagtaccttcttcatagggttgttgtgaggattcaaagagggagtacatgtgaaatgcttagcacagggcctagaacagaatattactcaataaatgttggttattatatcactgttatcattatctcccatagcaggactaaactttactaaatgtcctttaatgcaataaaatataacaacttttttttttttttttttttttttgagacagtctcactccgtcacccaggctggagtataatagcatggtctcggctcactgcaacctctatctcctgggttcaagtgattctcctgcctcagcctcctgagtagctgggactacaggcacgtgccaccacacctggctaatttttgtatttttaatagagatggggtttcactatgttggccaggctggtcttgaactcctgacctcatgatcgaccctcctcggcctcccaaactgctgggattacaagcgtgagccaccatgcctggccaaaacatttttatttaaaaaatttccagctgggtgcagtggctcacacctgtagtcctaacactttgggaggctaaggcgagaggatcatttgagctcaggagtttcagaccagcctgggcaacatggtgagaacctgtctctacaaaaaattttaaaaattagctggccatggtggcacacaccagttgtctcagctacttgggaggctgaggtgggaggatcacatgagctcaggaggtcaaggctgcagtgaaccaaaatcacaccactgcactccagactgggcttgtctcaaaaaaaaaaaaatttcctttacatttgaataattatttaatggtctcttttttcctccaaattaaagcactcagaggaacctagagacaacatggtctagccgcttgctttcatggctagaatattttaactgaaagtaatatgtacaaaatatgtattgtcagtttttatacctttcaaaacattacacatttcattatgtattttcttaaaaatgatcaccttttatgtttgaatcgtatttgcttacgtattaggttgacacagtactttgggaaatgttctttactattttgagaggatatggggaatttaaagtgaatggctcatcgagggtacagaggtaaagatcttgcagttacttatttttgccactagagagggtcacacatttaattctggttataaagttagctgagggaaatccctgtatttctttaggaacagattacatttgatggagggtccagtctggtctcatgggtacaaatttagatgaagtcaggtcaacgcagtccacagcaagcctgggattaaccatggcccaggagatcaaacaagatcagggaccagggaatgactttgagaatggcttcatctcagcttttaataagcctaaaggaacagggtttgggttagtggagtacttctggaccaccaaaggaaccataaggcctttcaggaagaatgtagccaaagtgatcaaagcctcatctttcagtttcacatctcttcttaccctctgccccatttaaggaagaaagttgggtactgctttgcaaaattccatgaaatttagcagggttttttttttttccaacactatagttgatcctatatagtgcagttgagaatattgattcaatattatgaacaatctaattaagttaataaaaacaaaacacaggccaggtgtggtagctcttgcctctaatctcaacacttggagggtgaggtgggaagatcagttgaggccagaagttcaagaccagcctgggcaacaaaatgagaccttgtcttgacaaaaaatttttttaattagccagtcatcatagtgcatgcctgtgatcctagctacttaggaggctgaggcagggacgattgcctgagcctggcagtttgaggctgcagtgagttatgatcacactgctgcactccagcctgggaagcagagcgagaccccatctcttaaaaaaccaatatgctcctcgccccccaaaagaacaggagaagactgataagtagaaccagaatcagagaagagccatgaggatggcagggacttaaaattattatatatgaggaccaggagaatatcacctaaaatgtgataactctctaatatagttgaaggaatgttccatggaaaagtgactaaattcattctttgctattctaaggtccagaaaaaggaatcaatagagtttactcaaaatatgaaagcacattctaatactaccattatctgaaaacaatgaattatttggggagatgagtttccaggcattgagtttgtttaagcagaaggcctacagttctttgtgaaggatgttttagaagtgattgatgcagcagatggaggagttgggttagaaaacatctaatgttctcccagccctatcttctatgaaatatgtttgtgattaggtttttcctttctcataaagaaaataaaattaaacagagcagttatatttctaaaattcagttaaagttttctgtatgtattttaaaacatggtctcagtagaagcattacaattatttcaatgctttctttaataaatgtgtcagatcttacatatacatgagtattctcatttgaatactttctctgagagcattaagaactttctgttcttaatccagaatgaggcttatcttgtggaattaccattggaaccataacgctgatacctttgcttcacaattagatttcatttcagttcaaagttgtttttcccacttccatacctcttagtcattttgacttggctgtgaatgacttttggtatctacagaaatccaatctagcttttaaagatctgtagggtaaccatatgtcctggtattcatctgatgtcacagcttaattattaatagtacccaacccctttcattctctgaaatgttctggttctggtttccctagttatataccagcactgaaaatattcagtagcttaggcaccaaaagcaatttaaaaagaagttaaaaaattaccttagtgagtatcagcatcattagaccagtctgcagtcccacagtgactctttggaaggcagcaatacgcccttggatgtgaaagctacttttgaggtatacctcttattttctaaccaacccaactgcattttggaaaattttcttttagaccataatgagtatgtttacacacatacagcccataaacatacattcatatatatatattttaaagaaattatttgacagtgattatggtccatttgtgtgagtagctgaaatgatgagtacataaacacaagtcctttccacatcatgtactcattaagtttgaagaacgagttaaagttaccaagatttctttattcaggttttgttttgtctactcaaacagaagtatttgctgggcaacaaaacagtgattctctttgtaatctgtatttgttcaaagccatatttattttacctgtttctgtgattggaaaatagagcatgtaatttgttctcctgatttgtttaaagtttaccagtaaatcagaagctctattactaaaaatacgtggagttatcaaccagttggcatttggcattgacaaaaggtactgctaagatattttttatatcatttattgagtgattgatttagccaatgttgtctcatctgattattgttctactcagtctcttgtgtcttgaccaggaaagtgacccagatggcttttcttaaagggataatttctttttaaattattattattttatttattttattatttattttattattatttttaattattaatattattatttattttgtcaagactcaacataaaggggataatttcatattatttcctgcttcttatattctttaaatatttcttaaattttacaaccaaaatgttacataacatttagtttgaggctggaataaaataatgataatattatactagctccctgatttcttttacttcctttcccacacttcagtagcttccctctactatcactttcttttactgatttgaaatggaattgaaaattttggtatgtatcttcttagccttgctacttctcttggttttgatttaaggtaatagggtctgtcactttttttcctataaaatgtttatttatgctatatgttaatttttgaaatcacttaaattgatagtcactcattcattcggggcaatgctctcattagtggctaaatgtaaaactagccgataatattgctgtcatatttacaggagagcgtggcagcaaatctaattgctaaactaatttagaatctttctcttctccacgtagcaaatcaatatgtgtggatcagaataaaccgctgtttatcacagcaggattggattctttcggtcaaataggttagtgaacttattaagattgttcaatctttttttaattgcttattgattttgtcctactccatgttcactttgtctccaacatactcctatttctggtttcattatcattgctgttatttcctgtgtgtttgtttatatgcccagtattaatgtaacatgcatcacattgacatgtttgtgatggaagtgatgtcaccacataagagactgatttttcatttctgatctctattccactgaaaaacaaattgcaagtattttctttccccaactgatttccaggtacttttaaattttagctccttggctttaaagaagctaggagcatagagtagtgaggaaattcaaagctacatattacaggcaattagcaagtatatgagagactgaagtggtagagtaaaccaaaaagaacacagttgtaacaattaggtatgatttgattttttgttatgaaatagcatgcctcatctaatggaatgtatttcctaaactcatagactctataggcttctgaatcaaaaggaagtttaagagtttatatctcaaggcccttaccttcccacagaaactgttttcattgtgaagatctttgagcctcgcacttctttatcctctgcaggtggcgtagtttgcttttaaaactctaatgggcagtagggttttttttttttttttgtatttcccatcctctgttagtcttacaagctaaaggtgacttgacttcaaatatagaaatctttgtaatgagattatagattaattggaatgaaaggaatggaggtgattttgcttagtgaatggtcatggagactgatgtttatgattataattagcaccaacttaattccagtagcagtgagaatcactgttgtactgatagataatgctgatggaattcttttgcttctatgaatagttggaggccagaagagagttcataattgctgaatttaaaaatcatggcgcctagatctcatcggaattaaaaacttttgctctatgaaagcccatgtgaagatgaatagacgtgccatagtgtgggagaaaagaatttcaaaccacatatatgacaaaggactagtgtttagaatatataaactcaacagaaaaataaataatccaattagaaagtgggcaaaagacataagcagacatttcatttcagagaggacataaacatagcaaagcagcacatgaaaaggtgtttaatatcattagttgttagggaaatgcaaattgaaaccacaatgaaatatcactatacatttaacaggatagctaaaataaaaaatagtgacaccaccaaatactggcaaggatgcagagaaaccagatctctcatacattggtggtgggagtgtaaaatggtacagccactctagaaaacagtttaacagtttcttacgaaactaaacatgcaactaccatatgacctagaaattgtgctgttgggcatttatccaagataaatgaaaacttaactctcacacaaaaaatctctaggcatatgttcatggcagctttatgtttagtagtcaaaacctagaaacagcccagaagttgttcagcaggtgagtgactaaacaactgtggtacatctgtaccaggaaacactactcagtcatacaaaggaacaaataattgatacacacagactggatgaatctccagggaatcatgctgagtgaaaagcagccaattagaaaagattacatacagtgtgattctatttataaaaaattttgaaatgaaaaacattttagaaatggaggcagattagtggtggtcagagggcagggatagaactatggatggggagaccaggggaggggtcgggaaggaggaggttatgtctataaaacggcaacacaggatctttgtgctagtggaattaagttggtgtctcgactgtggtagcaaatacatgaacctatgcaggtgataaaattgtatagaacttaatatacacacagacacacaaaggaatacaagtaaaacttggcaaagctgaataacatcagtggagcgtatcaatggctttcgcaccaaagtggtaaggatgtcctggaagatcaccagtaaaacagttttggggaacaatacagttgttggaaatagaaagatgggaaatatccagttacaaattgcaaatggcagcaaagttttaaatttttcaaattaaattatacaagtaacacataaagatatctccttgtaaaaaggtaaaagagtacatacaaggagcaaatttgtgttctttccaatttcctatgcctttacacacatgtgtatatagtgtaaaaaaactatttgctttaatgtaattatgtgttcagtctatatcattttggaatttcccctttttattcaatataccctattattcagtaccttttaattcaatataccaatataccttagtagtttttccatattaatgctgtatgtgggtctatttcttattttaactgttggatagtgttacagagcatggctatgcatagtaattaatgcactgttcaccactgatgaatattttggttgtaggtcaatttttcactgataacaaattatactgcagtgtgaaatccttaatacagtaccagtttgcaggtgtttctagggcaaacactaccaaaaactggaattactggttaataggatatagatacaggtataggtatagggtgtggagaatgagagttacagtttacccattactctttgcctcctcttctttcagtactagaatctgtcccagtgaccttgctatgctgggtagggtaaatttttatggtgactatattaaggagagggaaaatgagtgatccgagatgtatacctttgttagtgtcatttcttttattggtggagtttgtaatattttaatcattgcagtcatttgtggtaaaacttgctattttaggatctcctcctgttcctgaaaatgacattggaaagcttcatgcccactcacctatggagttgtggaaaaaagtgtatgaaaagctctttccaccaaaggtacatatttctaatttttttaaaagcaagacttttagcactgtctaacagttataggaaatgtgtcaaagggcttattatgataactttgttttcatcttttatgctcaaaaatcaattaaacatttgctgaaaatgtaaataggcactgtgggggttaaaaaaaaaaaaaggtaagacatggttcctgctccactttcaaagagagttatctggctgttagagaagggagagacaactgaaaggggacctggcagaattggaagtgggcctcagtggtgatgagaaaagctagaaagatcatagagagcctttgtggcaggctgaggaatgggagcttggtttattaggcagatggtagccattgaattttggtttatgggcgtgaagtgattttgagatttgtaatttcagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattcttaccttgctgctggagagacattttcttaatagtctttggtttgtggaattacatgaagagctttgtttttgattaggacattcagacatacctatactttccttgtactagaaaacgtatcttgcccagttaaggactgaaagcacgatctgaaagcacacagacatacctgacataacccaggttctctcaggaaaatgcttaaaagtggacaccaccatcccatgtatcactagatagccccatttgaacacacaagtctgatgtaagaatgttaagagttggcaaattcaccatcactcaaatacttagatttttcttttctttttctttttcttttttttttaagacgagtctcacactgtcgcccaggctggagtgcagtggcatgacctcggctcactacaacctccgcctcccgggttcaagcaattctctgcttcagcctcctgagtggctgggattacaggtgcctgccaccacacctggctaattttttttgcttttttagtagaaacggggtttcaccatcttggccaggctggtcttgaactcctgacctcgtgatccatccgccttggcctcccaaagtgctgggattacaggcatgagccagtgcgcctggcctagatttttctaaaaacaaacaagcaaacttagattttagttttatttgataaaatgagacgttgtacagaatctgtccttatatgagtaaacttatatatgctaagcactagatcgaaagccccagcaacttctcaggtggcagtcacgttgttgcgagggtaacctgaaaacagctgtcagctgggagtaggagccagggtttttttctcagtattcaccttcgggggctgttggagaagtaagcaaaacattttatgtaaacggtccagaagacttttgaaaaatatgccatgaatatttagaggttttatagctgtagcaaagtgagaggcatgttgtagaaacaggaaaatgaccttatgtaacccttattatgtttgcagcctggctataaggattagttggaagtcatccctgattaatatttatctaggagtcaatgattaactgttgttgttgataagaatatctgtttatattgtataatgatcacttttattaagttcatatacatcagtattattaaaggattagggtatttgtgagcatcatgagttttcacattcaaatctgtcttctctaaatgacttaaaaccataagaattttgtgtggaaaaggaaggcagccccacagtacccatatcacccttcattcatctcttgtatctcactgccagcagatcaccaattcctgtcatctcttggttcgagatttttttttaacctacctgaaaagttatgctgtcctaagtttgcctctaaaccacttttatttgtgtggttttagacgaattgattccagattgcacacacaggaccttaacataattttatgctttagctgtaaagataccctaacaattaccagtgttgttgctgttatttcattgataatccgaatctaaattttgacattctactatataaaatttttaatttgaatattatttcatactatttcatgagtagttgtgagaccttaagttgtttccaattgtgtgctgtgaagtcagtcctcaaggatctgaggattggtaggaagacccctttcatctttcctgcagacttagggtctttcgtgattagccctctttaattatttaaagttctgtcttttgccagacttcacatgggcaccagaaaatacttaagtagtattttctgttttttaaaagtcctctagctttagagcattcccgattttaagggaatgcgaatgtggaaagcacttgctgagcccttctacctcttttgtgtttttttctttttctttgatactgtgtcttgctctggcatccaggctggagtgcaatggggagatcatggctcactgcaaccttgaactccagggctcaagggatcctcccatctcagcctctcaagtagctgggactacaggcacacatcaccatgcccgggtaatttttttgttttttgttgcccaggctggtcttcaactcctcgcctaaagcaatcctcctgagttggcctcccaaagtgctgggattacaggcatgagccactgtgcccagcttcttttctattatttttgttaaagcaaaaaaaaaaaaaaaaaaaaaaaaaaaaaaggttacagttaacatttatttttaaggtcttcttggccaaccacagttatcttcggaaaactttacttgctatccctttaaaacatcaatgcattattttgaggccgtatcattgtcatgttgaagatctagtggacttggtggtttttgtctcatattggttattcctttttctccctctggcatggcctgtgtgatagccctagttttctcacagtctgctgtctgcaaaagggagatactaccagcaaagaatctcaaaacaacattttcacctttgtcattggtaaaaataatttaacttccagttaaagacaaagtttgcagtaaacaatttgtttattctttatgagttaatctttaaaaccgcaagtggtagataactggtgaactgaattagctttattagaaaaaaataaaacaagctgtaaagactacatatgattattaccatgaaaattcttcctagaatccaatgaggaagttaaaggaaaaaaaaaaacacacaaggaaaaattcttcctaagtctatataccattttgaaacatttaacatttaaattttagtaacttagggtataggtatgaaaggtacgctctgcaatttttctgaaaattagaatggattttcttttcatagcaactgtgaacttcagttatgttagccaaagggcattgattgcctcatcttgcagagtaaccacgttttatttgaagtagtgacaacctttgtacagttatttagacattgaacaacatgtaggaggccaagaggcatccccttagatggtcccttttacatgtcagttgccttgtgcaggatagccacctccactaaaatttatttatgaattgtaaaggtaagatatactccttgtgaaaaaattcaagagctatagatagatgtatataaaatagaaaatggaagtatcctgccctctccctatctgtgtgcttttttcatgtggcacacattatgttttcatgtggccactgttatttttgctggctgccttggaagccacctgtgaatgaacgctaattatttaatcagtccttactgggggacatcaaagttgtttccagttgtgctgagacagagcaatgggtttccttcttttacatccttgtgcattgctctattgttatggatgataaatttctaaaagtaaaatcactgggacaaaggatacacacacacacacacacacacacacacacacacacttttttgtgacaggatctcactctgtcacccaggctggagtgcagtggcgcaatcacagtttactgcagccttggcctcccaggttcaagcgatcctcccacctcagactcccaagtagctgggaccacagcgcacaccaccatgcctggataattatttttctcagtttttgtagagacacggtctccctatgttgcccaggctggtctcaaattcctgggctcaagcaattctcctgccccagcctcccaaagtgctgggactataggaatgagccaccgcacccagcctgggtatgtattttttaaatattttgctaacttcaaccaagtttttgattagagctgaacagcaaacaattaaaataagatcacttttgaatacttgaaggatgacagatgtctagttcattagttgaaagacaattcatatgtattatgtagtttatgtacataattttgtctgaaagtttaataaattcatctctgagtgctgcttagccacacagaaactctgaagacagtatttctagaaaataagtcctaagcataatcatttacaaaataattggcaagaaatatttagaatgataatgctactaaggattcattgatatatctaaaaaatgagaaggcagttttaaggtgcctccttgaattagtaaagttgatttttcttaaagtgatacatatttttgttttaggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactacctacctctaa

SEQ ID NO: 1446 - DNA, 35973 bp, Homo sapiens; identical to SEQ ID NO: 1445
